United States Patent 7,977,087 (DETECTION INSTRUMENT WITH THE USE OF POLYNUCLEOTIDES MAPPED ON BARLEY CHROMOSOME) - sequence listing, part 2

SEQ ID NO: 3762 - DNA, 554 bp, Hordeum vulgare
gtatttggtttctattacgcttggcacgttgcagtctctgctcattgtaaaccgatcagacaatcgagctgacacggtggctctactatgcaaccacgaagtccctcgcctcagcaccgaatgtgcacctatatgacgtatgcacttgtcataaattacatttcctgcgtcatcctttgtgatgatctctgcgcctctgcgtagtacaggctacagcctagcgagggtctgactgtatgctggatcgatgcagacgacgaccttgccgacgctcttgccagaatgaagatactctaccgcatccaccgcggaagcaacgcccaggaatttcttagggtcgagcgagacctttagctttccagaggcatacaactcaaatagtttatcaagatgttcttgccacatgtgagcatgttgaaccaggaaaaatccagccacagtttgacttttagcaagaatcttctcacatagtccagtgtagttcttcggcttccatccctcctctccttgatactgagagatcataccaattacaatgagacgtccatggactg

SEQ ID NO: 3763 - DNA, 518 bp, Hordeum vulgare
  UNSURE (511): n stands for any base
cttggaggcacaagaagtctaagaggaggggacggagctctaagaggaagaagagtaagagtttggatgttccatctgatgctagctctgaggaggtggaggttgtaggctctagccctatctcaacggacagcaagaaaacgggcaagagctcaaggaagaagagtagcagtcagtctgattctgaagattcgatcccttctgatgccatcattgatgaaaaggaaattgaagagacagatgagccagagattgacccagaggcaattaagttcaaggaaatgcttgaggctcagaagaaggctgcactggagaatgagatgcctgttggaccgatgccactcccgcgtgcagatggtcatattagctatggtggtgcactgaggcccggtgaaggtgatgccattgcacaatatgtacagcaggggaagcgtatcccacggcgtggtgaggttggtctttctgcggatgagattcagaagtttgaagatttggggtatgtgatgagtgngaagtag

SEQ ID NO: 3764 - DNA, 525 bp, Hordeum vulgare
agagtaataactgataagcataaggtaagtaccagtcgacacaaaacagaagttacaaaaatgcaaagccgacatcactagtactacatgaacaacgggaaaaacatgcataactaatagtggcaaccatttcttgtaaaatagctagaaataattactcagtcatctgtagtagcaaatggatcatgcgaaggtcctgtctcttggccaatggttcttgaaaccaagcgctgcaaatcagccataaccttgtgctctctctttgacttctcctcgtagttaaacatggccagtgctctcttatcctctgcactataaacttggttttccttccttatacggatagcattcatcctctggtgcctacttccactcatcacataccccaaatcttcaaacttctgaatctcatccgcagaaagaccaacctcaccacgccgtgggatacgcttcccctgctgtacatattgtgcaatggcatcaccttcaccgggcctcagtgcaccaccatagctaatatgacca

SEQ ID NO: 3765 - DNA, 552 bp, Hordeum vulgare
gtacccccgggcctgcagggaattcggcacgaggaccgccgggaagcgcatcgaacagaaattggtggattacaacaaggaggctgagcgattcggaggatactcatacgaggagctatctgaagtttctccagatcaccgcttcattgcgtacaccatgtatgacaaagataaggattccttcactttactggtcagggatctggtgacgggcacactatgcgataaacctcgtgctgatcgggtctcaaatatttcatgggccatggatgggaaagcactggtttatattgttacgaatgaggacagaaggccatataggctgttttgcagcattattggatcaaataaggatgatattcttatattggaagaacctgatgagaatatttatttgaacatcagacatactaaggattttcggtttataacgttaaatgtcttttcagacacgcactcaaaggtctatttgataagggcttctgaccccttgtccagaatgacactggtatgggaaggtgaatcccaagttcattgcattgtggagcacca

SEQ ID NO: 3766 - DNA, 595 bp, Hordeum vulgare
  UNSURE (21),(24),(26),(33),(34),(51),(57),(58),(65),(83),(86),(87),(95)..(97),(103),(109),(110),(124),(125),(133),(134),(146),(148),(149): n stands for any base
ggtcacgtgttccacaacatntancntccatgnnttaagaaaagggatacnggacanngcaaggnttcggtttattacaagcncanntttcaatnnntttacncaaatnnttgaaactaaatannaaaggggnnaaccacaacatncnntcccgttgccaactggtaactgctcccaatgtaatagtgacaatgatgctacacggtgactgcacgccgtgctgggcgttgaccttatcagaaggcaacgtaccgattgccagaaaacagaaatcgaagacgcatcgttcacatcacaactcctgaactgcagctgttttgtcctgttctgaatggtactgtgcgaacaaatgtacatttgccatccatcctgcagggtgtcgaccagagtaatgtgcaagaccatgatgctaaccgcggctaatccgaattgcacgggatggaagttctgtttgtgcagtgaaacaagatcaccagtgcaaataagctactccaactgaatccccatgtgcagtacttcatgcctatgacatctttccagcttcgcatcggtagaagctcccacatcgacaaaaactttaaggtattcatgtcca

SEQ ID NO: 3767 - DNA, 10 bp, Hordeum vulgare
  UNSURE (1)..(10): n stands for any base
nnnnnnnnnn

SEQ ID NO: 3768 - DNA, 553 bp, Hordeum vulgare
acacaaaggcacgtccataaattatgacatttgatatggtacaaatgattgcccctaaaccactcgctacatctttcacctaatcatctaatagagccatcaactcaaaacattaatttcaaacctgaaacaaagtcaaccaacccagtgctcactagtcaacaatactagctatagctaaatacatggcatcagcaatgtacacacaaatgcaaaaacctcatagcacactggtccatttacaatgctaattacttggcaatcgacccaatagattgaccaggagattatcccatagaaggggattctggttcagaaccactaattgatgtaaatgttgatagtgaatcatcgccgaagttcaattgtgatacagatagccgccttgaatctccaaagtatctattatagcgactggaatatgatttgggtgtcgaaagctcaggggtggcactgcctagggatgaccgacgaggtgttggggtcattagtccattactgttcccatttgaacggtacccgtttgtctttctggttaagttgctcgttctct

SEQ ID NO: 3769 - DNA, 10 bp, Hordeum vulgare
  UNSURE (1)..(10): n stands for any base
nnnnnnnnnn

SEQ ID NO: 3770 - DNA, 898 bp, Hordeum vulgare
  UNSURE (800),(818),(829)..(830),(869),(875),(883): n stands for any base
ttgatagtaggcactatatatggtagacgtacaacatcgtggatgaagtttatataaactgagaatgtgaagcaggcggctgaaacaagtttcaacttccaaacatttgttgcacaatgtgcaaatgcgcaacacttatttatccatggcatagaagcttgcgttacgtagctgggaaggcccggaactagtagtacaagctctaggccgagaggagctgcgcacggcgagccatgttgagcgccaggagcttgtccctgggtggcagggtgtccttcaccacgtcgacggccaggaaccggtcgaaccaggccttcatcagagggagctcctcgtcggtgacgatgctggcgccggagacctcctcgatgaccggcagccagtacgcgtaccacccaaccacgacgtcgaggtagccgatggcgtcgcccccgaagaacttcttcccctccagggccgtctccagcgtcttcaggcaccgctgtgcctcgcgcaccacctcccgctgcgccttgccggtcgccgtgaagaccgggtagatggcggcgttgcacttgtcgtcggcgaacctggcccagaacctcgcctgagcccggtcgtgggggtcggccggcatgatggggtagccgtccttccacgcctcgtcgatgtactcgacgatgatggtggactccacgatcggcttgccgtcgtggaccagcaccggcaccttcttggtcaccgggttgcggcggagcagcgcgtcgctcttgctggcgaggtcctcgtcgacgtactcgtacacgacgcccttgagccgnagcgcccactccacccgnatgaccatggnngctcgcccacatgccgaacaccttcacgcccttcttcgncattgntggacctncgtgcctcgtgccga

SEQ ID NO: 3771 - DNA, 237 bp, Hordeum vulgare
  UNSURE (29),(47): n stands for any base
tcatgtacctacaaaggtcttggggcagnagtcattctggaattagncccgacaacttctagattttcaacatgatactgtagatgagacagatggaggatatgatccattcaatcaactaaaagagaggttcacggactttaagcaacggaactacgtggaaaattttaccaattataaaaaacttgctgagcagcaaacaccggggttcatggtggttgcttgtgctgactccag

SEQ ID NO: 3772 - DNA, 557 bp, Hordeum vulgare
ttcttgtgttcccacatgccattccaaaataattatacactgataaaacaaacattacaaagctgtatcttattgttacaatgatacaccaacattatacagatgttacagtacaagctctgccaaatgtggcagcattatacattgtttcgttcgactatggttatgcagttttactagccgctgtttcacaattctaaaaaggaaacgcatagcaactggattgaattcactttgtcccggcagtttacagactttactctggtagtaatatatctgctgtgtcgaacttttactcctttgcagttttattcatcagagtataaataatgcttattcattgatcaagcccaggtagacctgttctttatggcatacttactgccaccttccagccctggacggtacactaatgtccacttctcaaatgtgcaatcaataaaattgtagtatcccccatgaaggttcaaatttccttccttcaccctttcctctatccaagggtatgttaataagttcaacagcgagctattaattgattccttttcacagtgtct

SEQ ID NO: 3773 - DNA, 525 bp, Hordeum vulgare
cgcacgaggaagaatggctgcactgacctcagcttatcccaatgtggtaagaaaagagacgttactgccttcggggctcaggtttttccagaaccattcttcccagatggcagcattggattatatggtgtccttggagagtgatgtgttcatccccacttatgatggcaacatggcaaaagttgttgaaggccatcgcagatacttgggattcaagaagacagtgctacttgaccggaaacttgtagttgaactcgttgatgagtacaaaaacggcacattgagctggtccgatttctcctcctctgtgaaggcatcacacaccagccgcatgggcgcgccatccaggaggcaggtgattcctgacaaacccaaggaagaggactacttctacgcgaatcctcatgagtgcttgcaccaaccagatgagctatcagctctatgataccctcggatatatacacattctttccggagccgtgggccggcttggattacatttcttgagtaggcataattggagat

SEQ ID NO: 3774 - DNA, 543 bp, Hordeum vulgare
cgggggaagaattattatttgtcattcagtagcgaacaaacatggtacccaaaaggccaaatgtacaatacaagaacttataaccatcaccatcacaatgtatgtatatgcatcacatcacatcagatgcaagctcaattcagaaactgaaaacccctactcgtgcgtgtatttttttcccttctaactcctatcatatgtacaacacaagatcacacgctgtttatttcgacaaccaaaaagctggcaaatcatgcctatctgtgtgtattatcacctaacaaatggcactatttatctctcaggtgcctgtccccatcaatgcaattgcagctagatctccaattatgcctactcaagaaatgtaatccaagccggcccacggctccggaaagaatgtgtatatatccgagggtatcatagagctgatagctcatctggttggtgcaagcactcatgaggattcgcgtagaagtagtcctcttccttgggtttgtcaggaatcacctgcctcctggatggcgcgcccatgcggctggtgtg

SEQ ID NO: 3775 - DNA, 533 bp, Hordeum vulgare
ggaattcggcacgagggtagtctggagtgcattgatctcaggttatggggcgcacggccatctcgctgaggccgttggcctgtttgaggacatgaagctcgcaggggtgaaaccaaatgatgtgactttcttggggcttttgtcagcatgcaaccatgcgggtgctgtggagaaagggtggttctactttcattccatgaaacccgaccacaagatcgagcctcgacaccagcactatgcttgtgtggtcgacctgcttgctcgtgctggtcagcttgacagagcttatcgatttatacttgacatgcccatcaagccagagatgagtgtgtggggtgccttacttcacggttgcaagatgcacgagcactcgaacatggccatggctgagagggcagcacagcacatctttgagttggagcaatccaacgcggggcattatgtgcagctggcaaacatgtatgcgtctgcagggatgtggagccatgttgctggtgtacgggccaccatgagagagaggggtgtcaccaaag

SEQ ID NO: 3776 - DNA, 540 bp, Hordeum vulgare
ctggctgccaagaactatgtgaaagaatacaggatatgaggagtttttcctaactacataaaggaactcaacaactggcatgccccacttcatggccagtttgactttgagaaagaaggcagagtaaggcgaaaatctcagcggcccttggatgcgagtgatcccaggcatggaagttgtgcgtctctccatcaacctcaatggagctgcatccggttgctttggtgacacccctctctctcatggtggcccgtacaccagcaacatggctccacatccctgcagacgcatacatgtttgccagctgcacataatgccccgcgttggattgctccaactcaaagatgtgctgtgctgccctctcagccatggccatgttcgagtgctcgtgcatcttgcaaccgtgaagtaaggcaccccacacactcatctctggcttgatgggcatgtcaagtataaatcgataagctctgtcaagctgaccagcacgagcaagcaggtcgaccacacaagcatagtgctggtgtcgaggctcgatct

SEQ ID NO: 3777 - DNA, 485 bp, Hordeum vulgare
  UNSURE (800),(818),(829),(830),(869),(875),(883): n stands for any base
ttagggatcttttgcccacactgatcaaaagagagacaaggcaacatttctcttagaggttattgaatatatacggtttttgcaagagaaagcacagaagtacgaggcttcatttccagaatggaaccaagaaaatgcaaagttactcccatggtcaaacatgtattttcgatcatcttggaaaaatgcacagagtaaagggcaaatcccagaagatgcctcgcctgacccttcacaattcatcagaaatggggcctcccctggattcaatatcacaggcaaacttgatgataaccacaccgcggtagcatctgcagctatctcaggggcacaggatcaggcagaaaccgaccacatggctagtgtgtcctgtagatcggcggatactccaacaaatattttgaataatgtttcgccccagtcccaaccacaatgggcagacccatctggggtggatgattgcgcggtgaacagtgacgtgttaa

SEQ ID NO: 3778 - DNA, 552 bp, Hordeum vulgare
gggtgcgactttaacaaaagatagacagagtcggtcgagtcatcatatcttacaggttacatgggggagaaacttcgcatacgaatggaagcctgtatatatactactactactacaagagcagcttcacaatctgcaatggaagcttctttgttttgttttcacttacttcgataaataaaaaggtggcgacgcgaagattaaatgaaagaatgcaccatagtcttggtgccacataatgtacatgcaatctcaaggtctccgctggcaatgccgcagaggaaagaatgatcaatccggtcttgggtggagaatgtggcgatggtcgccgtcgtcaggtgttgcccggcttataccgcttcgttgcgtgcggaagctcttcggcagcggcggcgcccagcatcgcctgctgatggcccatcatgtcgttcgtcgggcctagatcggtgtgctccttaaaactggaggattgtccagcggtaggtcttttgacagctcgcttgcccaggttgatctggacagagatgttggcttgggacaaatcaatacccg

SEQ ID NO: 3779 - DNA, 342 bp, Hordeum vulgare
ccgaatttttttttttacttaaaaagtttgaatttatatcaaatcttcaaacaccattgacatagagatggacaccggagggaagtcgtcgaagggagggagtgccgagtttgaattggcgaggattggcaacgaaggcagaactgtgcagacacagagcaagattggtgatggttgcaaatcagtctccaagccgttcaaggagctgccggtcagtaactcgatgtccgtagccgagtctgtcagaaataagattgagaagaagcaggccgagaccgcgacagaggaggtggtgccgagggtaagcttcaaattaggtttgctctcctggcagtttgatga

SEQ ID NO: 3780 - DNA, 546 bp, Hordeum vulgare
  UNSURE (6),(33),(34): n stands for any base
acaagnacacaagttacgaaatcattatcatannggggctagtcttatcatactactatcaacaattagcatacacacaataagctataagtaacagttcacatgttctcagatgcaggcatgacccttcaccgagccaacatcttcaacaagcttcataacaggcctacgtggaattgattcccatgcgtaaggctgtatagatcccatcaccgagatatcatactggctttcaatgagcaaggaccaagcaacatttatctccactttacaaccaccaagctcaaaacctttctgacttatgttgctgaatttacttggaaagacgacacttccactgaaatctccggcctgcatccgaatttctagccttccacctgattttacagatacaacttgcctcgacagatctagataaccgtcttcactcacaggcattttttcagctcgtgaatcaaacagcaaaacatgcccagatgggtgcttaccattgccttcactattgtcctcaggtagtacggagcaaacgactttgattttgccaca

SEQ ID NO: 3781 - DNA, 517 bp, Hordeum vulgare
tgcgcctccgccgtcgccgaaaagaccgccggggaggaggaggccgccggggaggagttcgagtaccaggccgaggtcagccggttgatggatttgattgttcacagcctgtacagccacaaggaagtgttcctccgggagcttgtaagtaatgcgagtgatgccttggataagctgaggtttctcagtgtaactgacccatccgtgctggctgatggtggtgacatggaaataaggattaagcctgacccagacgctggcacaataacaatcaccgatagtggcattgggatgacaaaggatgagctcaaggactgccttggaactattgcgcaaagtggtacctccaaatttttgaaggctctgaaggagaacaaggagcttggtgcagataatggacttattggtcaatttggtgttgggttttattcggcttttcttgttgcagagaaggttgtggtgtccactaagagtcccaagacagataagcagtatatctgggaagccgaggctaaca

SEQ ID NO: 3782 - DNA, 560 bp, Hordeum vulgare
  UNSURE (25),(26),(36),(37),(46),(47): n stands for any base
tggatgcctacagaactaactaatnnctctcatggnngtcattctnncgttctcagtcctgaccttcggatggggctcaacaacctccgttacaacggcttcagaagagtcgttgacattggtctcagcctcctcggtgccggatctaccccatctcccgccaagggcgatggtcatcatctcgtagatcttgccccccaactccgctggactctcaggtgtgtatccactggagatcagggcagtctcgtacagcaactcaactgccctcttggcttcggtgctctcaggctcgttcttgcaagcagcactcaagtccttgacaatagggtgttcgggattgatttcaaaaattcttcttcctctcatgaactccaagcttgatgtgtcaccaagcgtttgtgctttcataagcctttccatgttagccgaccaaccaaacttgccagacacaagaacacatggtgaagagctgagtctcttggaaatttggacctttgcaactttgtcacctagctgctgctttatccagtcacaaagaagagtgtattcctgcttgc

SEQ ID NO: 3783 - DNA, 518 bp, Hordeum vulgare
cccgtcagccccgtcgccggcttcttctcccccgtcgcactggaccggcgggaagtcggtacccatccgggctcgattcgcttcttgcgggctcccgtggcggctgaccttcaagaggttctgcggcgttcggccgggcattgaggagccatgctcaccgtcaagtccgaacctgcaactgcaatggatgcagtgggtgaatcggaaattgaggagcatgaacagaaggtaaacagatatcaagctgaacttgcagcacgcatcaaggccaaatacttctctaataaggcttccgacggaggaaaaatctttgaagaaataactattgttgaaggagaaaccatccattcaagcaggtggccatgcacaagttcgtatgcgaaccctgtgaattttctccgagagaagaacaaccatgagaggagggattctccatcttcagcagcagattcctctgccaagaacgattcttcatctgtggtagctgaagccgcgccaaagaataatgcagttgtttc

SEQ ID NO: 3784 - DNA, 546 bp, Hordeum vulgare
atattactgaaaccgattaatgagatgaatgcagtatcacctacaaacatgcagggcaaattattttaaagaaaaagataagttgcatgcttcaggtagcatatactttgagaccacaaaaatgtgttcccaaccagtgctgaaaccggttcaacgaaatgaatcaagcaccgtcaacatacatctgctggacggatttttatttcatgataacttgcatacttcaggttgttgcacgtcttcagacttaagaacatacaacaacccactagcctgccgttacccatcaggtctccttggatgcctctctcttggaaggtgttagattgttttctgttgccgaaacaactgcattattctttggcgcggcttcagctaccacagatgaagaatcgttcttggcagaggaatctgctgctgaagatggagaatccctcctctcatggttgttcttctctcggagaaaattcacagggttcgcatacgaacttgtgcatggccacctgcttgaatggatggtttctccttcaacaatagttatttctt

SEQ ID NO: 3785 - DNA, 479 bp, Hordeum vulgare
ggcaatggggaatggtgatttgtatgcccatggtcatggatttcatgaagggagcatcagcaagggtgagaatggagggatccattcaggtcttgatccgtacaccgactcaatgtcgttgcttcagtcagcacaagaagcactggagaatggtatgatcatattcctctttagtttattctcgcaaaatatccctttcactttagcttgatgcccaaacgagtttgttccattaggttgagcaagtttttgttactactatttgacatgcaaatctgcatttcacatagtctacttactatcttagaccttagagggtgtagttcagaatttcaactactactgagtattaccattttgagattaaactgtttggtttccgaaaacaggctactttattagctggaaacatctgaacacttgatgcattatagtgatcaacaataaatgggagagcacatgcatccattatgtttgta

SEQ ID NO: 3786 - DNA, 552 bp, Hordeum vulgare
ttgtaatttttattaacactttcaggatacagagaagagagaaacagcaagaagatttgtgaataagtacagtaaagtgatggtaactaacaaaatctgagttgatgttacaaacagaaaatttataaggccaccaaatgcctaatagattacatgaagtaacttttcaataatgtctacacagaggctcatccgcagagaaactttctaacctcatcaagtaggtacaaattcgggaggagtgggcaagaaccgcgccacgaatgtccacacggcgacgcacagcagcactaactgaacggaacaaaaaagcgaagctcgacttgctccggcctgcagcttcaggacctctgaagcgttcgacagctctttgcactgtgactctagcttctcaaccatctcctctagcgtccttgctctattctcggtgcgccgaagcttgacctccagctgtttatggtcctccgacagagacttctgtgcttcatgaagagtgccctgaccctcggtctggggttgccaagcttctgaagctcttttcaggatgaagca

SEQ ID NO: 3787 - DNA, 1246 bp, Hordeum vulgare
  UNSURE (1)..(7),(15)..(17),(19),(23),(25)..(27),(29),(30),(33),(34),(38),(41)..(43),(46),(54),(55),(65),(66),(87),(90),(91),(94),(133),(140),(340),(1024),(1175),(1232): n stands for any base
nnnnnnnttgaaaannncnaagnannncnncanntgtngcnnnctncagtgacnnttaaatgggnntttgacttaatcaccaaatgntgnnggngttttttgggtgagggagggcccccaaaaaaccccgggntgccacngtttgcgtggatgaacattggtgatttttcttgcttgcggaagggggtccgacctccaaaatagatgatgatcggtgctgttcagagtatggggaacactgaactccctgacttgacgttttatgatgatattgtatgttgctccaccatttaattgtgggtgtgggggatcaacatttttttttttcccgcgggatgcnacacccctttactaatttcctttggggggcggggttattagtcctccccctcccttgttattctcttctgttttgtcttattatttctttttttgtctgagttggttgtgtataataaaaaaaaatattttctaccctgtcgtgtttgtgtcgtatcttttcttttcctctctctgtcacttcgttttttctcctgtgttttgtttcttgctccttccgctttcggtgtcatttgttctgttcacttttcgttgtatttttgtcgcgctgtgctgcattcccgcctgcttgcatacgtctccggtagtgggttgtttgttggtgtggttggcggtttcctgtgcgtatgttcttcctctctctttttatttctcgtctaccggtcctttcgattgtgtgtttgtgtgttgcgtaactacctcttgtctatataaccgcatttcggttttgttctgctcttcttacaagtcggtattgcctttcgaccggtgtatcttcctgtgcattcgatttttttcgttccccgttttcctggttttggctttgtggcgtgcgtaaggtttggttggttagttgagtcgccggttaggggtattcgtgccgttgctgtttgccgtcgatgttagtggtgtttcttacctcttctctattgtttctatcttcgtgttcccgtatgccaccgcntgggtcgtatgtttcttttcccgttagtatttcgtggagttgctgtttgacgagtcgtgcgtatgtgctggtcgtgtttccggtacgtgttggcaccttctctctatttcttgttcccgtaggtcaatcttcttgcctcttctgtttctgnctcagtcgtttctgtcacgtcttattatctctgtttcttgtcgttctctctgcggcngcgagtgttgttcg

SEQ ID NO: 3788 - DNA, 406 bp, Hordeum vulgare
gaaatataactttcgccatttgattacttggtgtgctcgcattaaggtaacacaaaatatacattcggcagtaaaaaggtaacggcaagcaaaatcattcactgcttccagagaatgggaaaaccctaatcaaggcatgaaacgtctcaggtaccagcagttatatatgacatgcctatcttactctggactatctgtcttcaaggcttcaacggttcagcagatgtaggaaatatgttgcatatgacacaggacaattatattagccgtatggaagatggtcctgtaatagcagcaactttctgagccttctgtgtttcaaatttatacagttctttgagctctttctttgctttccgggcttctctcttctcttcttttaccgcagactttctagctttctttt

SEQ ID NO: 3789 - DNA, 551 bp, Hordeum vulgare
gtctccccgggcctgcaggaaattcggcacgaggcctgcgtcaccgtgccgtccctcaacgtcgccttcgacatcggccgcggcccgctcttcgctgtgcgccaggaccacctcttcatcacccacgctcatctcgacccatcggtggtcttccaatgtatatagcaacccgtgggctctacaatttgaaacctccaaccgtatttgtacctccgtgtataagggatgatgttgaggagatgcttcagatccatcgtagaatgagtcgaattgagctggaagttgaattagttgctcttgatttgggagaaacatatgaaatacgcaatgaccttgttgccagaccatttcagactcaccatactgtgcccagccagggctacgtcatatactctgttcgaagaaagttgaaaaaacaatatgctcacttgaagggaagtcaaatagtaaaattaaagcaatcaggctctgagattacagataccatactgtacccagaagttgccttcaccggagatacaacatctgattttattcttgacccacggaat

SEQ ID NO: 3790 - DNA, 544 bp, Hordeum vulgare
gcacttgcttcattaaaatactcagtaagctgtacaaggtttattttctaagactaggaacaaaagataagaaacgtgcacatatgacctcataaaacagtcatatctataagatacattcagcaataaagtagcagttcctaatgtgaacatacgttcagtggatcagggtgagaaaacaccaggtgttctacttctgtacacttagctatattcagatttgaagccttctgtcagagcaacaaccttcgaaagtaacttcggctgtagcctggaaacagctttccggatatcctcaagactatatcgattcgagaaatgggtgagtataattgcctcatttctaaaccattgggaatgctccattatctcagatagatgcatgtggccatgctctcgagcatgatcaacatcgacttggtcatctaggaaggttgcctctgttataagaacctttgctctcagggcatccgcattccgtgggtcaagaataaaatcagatgttgtatctccggtgaaggcaacttctgggtacagtatggta

SEQ ID NO: 3791 - DNA, 518 bp, Hordeum vulgare
aggatgttgatgaggagaaggaagagaaggaaaagaagaaaaagaagatcaaggaagtctctcatgagtggaacttggtcaacaagcagaagcctatctggatgaggaagccagaggagatcaacaaggaagagtatgctgctttctacaagagcttgaccaatgactgggaggagcatttggctgtcaagcacttctctgttgagggtcagcttgagttcaaggctgtcctgtttgttcccaagagggcccccttcgacctcttcgacaacaagaagaaggccaacaacatcaagctgtatgtgcgccgtgtcttcatcatggacaactgtgatgagttgatccctgagtacctgagctttgtcaagggcattgttgattcagaggaccttcccctgaacatctcccgtgagactctccagcagaacaagatcctcaaggtcatccggaagaaccttgtcaagaagtgcattgagctcttctttgagattgctgagaacaaggaggactacaacaag

SEQ ID NO: 3792 - DNA, 552 bp, Hordeum vulgare
ttatacagcagacaaattctattctgtgactaactgtgaatcttttccctgccataagggaaaattaacatttagctggactgatggacctagaaaaatgaacccagaaatggcggcctcacaagcttaagagaaaacatactaaaagcagatgaaagcaataagcagggaatatagaagaaatatagctaacatatagtagaaccaacaataaccgaactgttccacgagtaccacaaataagctaaccgcgcttaatgtttggccagccaaaagacaaaaccgatacagctaagacgtgccaaaaccatccaacgacgacactaagataaaagcaactagacggtgcagggcatggacatacgacgacgcgcagccttggcgcttagtcgacctcctccatcttgctctcaccggcatcatcctccaggggcggcatgtcggtgtcgttctcaggcgcctcatcgtcctcatcaatgctcaggccaagcttgagcatgcggtggatcctggtgccgaaggtgttggggtcctcaaggctgaagcccgagg

SEQ ID NO: 3793 - DNA, 517 bp, Hordeum vulgare
ggtgatccgcaatgtctcttatacggggattttgacactcctaacaatgacggaattgacatcgaggattcaaacaacacggtcatcaccgattgccacatagacaccggagatgatgccatctgcccaaagtctagcacagggcctgtttacaacttgacagcgacaaattgctggatccgtactaaatcatgcgctatcaaatttggaagtgcaagctttttcaactttgagaagatgctctttgacaacattactatagttgattcacatcgaggacttggaatgcagatccgtgatggagggaacgttagtgatgtgatattttcaaacatcaaaatgcgcactaggtactaccatccttcatggtgggggagagctgaaccgatctacatcactacctgtccaaggcaccctgattccagagaaggcaccatttcagatgttcgtttcatcaacatctcgtcagtatcagaaaacggtgttttcctggctggatcgaagcacggcttgcttc

SEQ ID NO: 3794 - DNA, 543 bp, Hordeum vulgare
gcagaaatagtacagcatgctgtttgggattggatcgtttatttacacctcttcccaaaagaatcccccatacatgcagacagcagaatcaataaaaagtgctgtttggaattgggatcttttatttaaacatgtcacaaaagaatcatgacttattcatcgtggatacgtgatacatatcgacataagggtgagattcagctggtctgctattgaacatccagcgattgccaatcgtggaacgacagcccgtcgatagtggatggccggaagaggagcgggttaacatcccaccctttcaggcttcctctcgaccatctcatactgacattgtcaacctccaggcctgagatgtgctccagcatcataccgccagtcctgtgctttaccatctcctggcacccaggcctgtagtcatacaggcccccagtgtaatttgtccacctcttgtaggtcaggtcaacattctggaacttcaagttgcgaagcaagccgtgcttcgatccagccaggaaaacaccgttttctgatactgacgagatg

SEQ ID NO: 3795 - DNA, 519 bp, Hordeum vulgare
gctaaaaggcaacgaccatctcatttaatggcttcacattcttcaggcctccagtcccctgttatgtcttcacactccgtcccaacttcgtcaaagtggggaccatcttcagcatcaaggggaaaaagggcaaagtcgactacgccactggcattaccatccatggatccgacctcattgattagccgaaaagtttttacgagatggccagacgacaacaacttctatgaggctactataacccgttacaatcctgctacgggtgaacatgctcttgtctatgacatgggcaaaacaactgagacatgggaatctgtcaggctttgtgatatggcacctgaagatataagatgggaacgtgatgatcaaggcatctcaaatcgagatggttggggcccttctggtccattgttgaagaggaaccaaagcaacaatggtagagggagactatctcagaatgagcatccaaatgaatatgctccacctcaaaatggcatcaataggaatattggtgaaatt

SEQ ID NO: 3796 - DNA, 555 bp, Hordeum vulgare
gagggccttagttactgattactattattccaataccaacttttatggggaaaataccattatttttgtacactacagtacagccagtatgcccactgcaaaactcagtgtgcataggaggaacaaaagaaaaacagagatttcggccaaggttaatcagctgccggcacccaacacaaagaatcttcagctgatttatgttaacaacaatttctagaaaattagtcacttctagtccattagagaggaaaggcaccgttaaagctttttcattccatctggtttcatcctttacaggtctgaatttgggcaggcaaataagctcatctcatggagcagccactgccaaatccaccttcttttgatagtccagttttccatcacatggcttctttgcccagtgatgatccaggaaggtggcaatcttccaacatacttctcgtaacaactaacaggcaatgccgttcctacccgtgtgatcaccagcagaacccattcgggcttccatggccttatcctcactttcgctatctgatgcatcgtcaagactggcaa

SEQ ID NO: 3797 - DNA, 462 bp, Hordeum vulgare
ctctcaaaacccctcctaaccctagccgcctcccgcacgcttctcctccgctccgctccccacctcgagcagctcagggacgcagccatggcgacggagaccgagaccttcgccttccaggccgagatcaaccagctcctctcgctcatcatcaacaccttctactccaacaaggagatctttctccgcgagctcatctccaactcctccgatgccttggacaagatcaggttcgagagcctcacggacaagagcaagctcgatgcgcagcccgagctcttcatccacatcatccccgacaaggcgaccagcacgctcacgatcgtcgacagcggcattggcatgaccaagtcggacctcgtcaacaacctcgggaccatcgccaggtcgggcaccaaggagttcatggaggctcttgccgccggcgccgacgtgtccatgattgggcagttcggtgttggg

SEQ ID NO: 3798 - DNA, 442 bp, Hordeum vulgare
tttttttttttttttttttttagaagaaatatagctaacatatagtagaaccaacaataaccgaactgttccgcgagtaccacaaataagctaaccgcgcttaatgtttggccagccaaaagacaaaaccgatacagctaagacgtgccaaaaccatccaacgacgacactaagataaaagcaactagacggtgcagggcatggacatacgacgacgcgcagccttggcgcttagtcgacctcctccatcttgctctcaccggcatcatcctccaggggcggcatgtcggtgtcgttctcaggcgcctcatcgtcctcatcaatgctcaggccaagcttgagcatgcggtggatcctggtgccgaaggtgttggggtcctcaaggctgaagcccgaggtgagcagggaggtctcgaagagaagcatcaccaggtccttcacc

SEQ ID NO: 3799 - DNA, 550 bp, Hordeum vulgare
gtcccccgggctgaggaattcggacgaggcgagttcgtccaaacggcacgctctttgacctcatccacggcaaccatggctggcgcatctccttggccactcgcttgggcatcgcccacgactccgctgaggcactctcctacctgcattcgggggcttcgactccaatcctccatggtgatgttaaatcttccaacattcttctcgacgacaaccacaaagctaaagtctccgactttggcgcctccatccttgcaccaaccgatgagtcccagtttgtcacacttgtgcaaggaacttgtgggtacctcgacccggaatacatgcaaacatgtcagttgacagacaagagtgacgtgtacagctttggcgttgttcttctggagctgctcacatgcaagaagccatttaatctcgatgccattgggcaggacaaaagcctatcaatgatgtttatgtctgcgatgaaggagaataggcttgaggttatcttggatgatgggatcaaggacgaggacaacatggagattcttgaagaaatagcggagct

SEQ ID NO: 3800 - DNA, 549 bp, Hordeum vulgare
agttattacgatgaaaagtcaattacagttgaaatagttaatgagaaatagataacaaacatatacaaattgattgattgttttgagacaaaataattaggtgcgattactcaacgccctgattgcagatttgtcacagctttcttctcgatgctgaaatattgatcactgacaatcgtcgagtggaccattgccgagggttccccaagtaagctttccatctcttcagggttccgttgcacccatggatgatgcataaccttcctcagcctatcgagcttctctgcaacttccttcattgagggcctgttctcaccagacatctccaaacaatgctttgccagctccgctatttcttcaagaatctccatgttgtcctcgtccttgatcccatcatccaagataacctcaagcctattctccttcatcgcagacataaacatcattgataggcttttgtcctgcccaatggcatcgagattaaatggcttcttgcatgtgagcagctccagaagaacaacgccaaagctgtacacgtcactcttgtct

SEQ ID NO: 3801 - DNA, 542 bp, Hordeum vulgare
ggtctgcaggcaattcggcacgaggggaagctgtaaatggtggcagagaccttcacatctccgttactatgccatccattgaggtgggcacagttggtggaggcacgcagctggcctcacagtcggcctgcttggacctactgggcgtcaaaggcgccaacagggaatctccgggatcgaatgctaggctgcttgccacggtggtggctggtgcggtcctggctggggagctgtcccttatctctgcgcaggctgccggccatctggtccagagccacatgaaatacaacagatccaggaaggatatgtccaatgccgccgcttgctgaagcgcatggcatcacttgggcccttgccagaagcaaatagacaaaaacccagatcaaaatgttcgccggatacataatccccccttcacctctgtgggagtggacagacgaggaaggtgactcatcacaggttaattattttgttgattccttgtgtggaatggcatgggcatgctcaggaggtgaagagggaaaccccgtcggatgaaccgt

SEQ ID NO: 3802 - DNA, 556 bp, Hordeum vulgare
gagaacagattacgttaacttaaaaacatcttctttacaagcgagccagcaagggtaacagacactaggatagaaagatcaaacagacgaaactgaattagttacaatgctactacaagcattcccgaagcagtaacaggagggaacagagacaagtgtgtaaagcagaagcgggtagtaatgtaagctttggacaaaaacaaccaaggtggtcagattcaagacgggcagaacaagaggtttggtgggaagaggaacaacaacatcaagaaaataaataggcttggtcatatccagggtggaagcacagggtggtaaatacaggtgctctcttgtcctcctggtaaaccatgaccgatctccagacaaacggttcatccgacggggtttccctcttcacctcctgagcatgcccatgccattccacacaaggaatcaacaaaataattaacctgtgatgagtcaccttcctcgtctgtccactcccacagaggtgaaggggggattatgtatccggcgaacattttgatctgggtttttgtctatttgcttctgg

SEQ ID NO: 3803 - DNA, 542 bp, Hordeum vulgare
  UNSURE (4): n stands for any base
gggnctgcaggcaattcggcacgaggctgaaccgaaatcccgattcccgttctctccggaacctcccgcgccggcgatggcgacgtcgtcgccgccccgcgtgtgcgtcaccggcggcaacggctttataggctcgtgcctcgtcaagctgctcctctcccgcggctacgccgtccacgccaccgtccgcgacccacgtgacccgaagaacgcgttcctgacggagctggacggagccccggcgaacctgcggctgttcaaggcggacgtgctcgactacgacaccgtgacggccgccttcgccggctgcgagggcgtcttccatgtcgccactccggtgcccgacaaaaagatggttgatccacagaaagagatgatggaacctgctgtcaagggtaccatgaatgtgctcaaggcttgctcggctacgaaagttcataaactcatcgtggtctcgtccatcgccactagttgcttcaacccggattggcctcgagataaaatcaaagatgagagctgctggtcagacaaggagctctgca

SEQ ID NO: 3804 - DNA, 552 bp, Hordeum vulgare
caatatctctctattttcctattacaaactttatatcagcattttgaccagacggtatgttcacaaaactggaatcattgctttgagagtactcctcccgagtttgccttctctggaggaaagtgagcacaaatgcacaacatttgcatttgcatccatcctgaatggactagtggaggagtcaagaaatagatacctaaaccttgcttatttttgtgaaacacatttcacgatgtttcaggccaaatgcaatattaatggcacaataatgggatcattctcattcctggataggcggcattcggtagatgaatggaagccggcatggttcgtcatctgaaaccccaagaagccctgcttttttgtaggactcgatactatccgcgagtgtctcctcgatcttccttggtttccaccctagattcttcagcttttccgaagtgactccaacgttgaaatccacatcaaccatcttgtctacataactgtaattagggtacatgctcttcatgattgccagcagatcctttaggtccatttgctccagtgagc

SEQ ID NO: 3805 - DNA, 448 bp, Hordeum vulgare
gccctccctgtccccgcgcccgctctccttctccaccgcgtccaagacggcccggcggccacggccgaccgccttcgcctgccgcgcggacgcctccccggaagggtcatcaacctcaaccacccggcgatggttcgcctcgctagccgccgccaccgcagccgtggggattgatcgtcgcccgggtaggggaggctggcgccgtgtcgaccagcaggagagtttttaggagcaacaagattccggagagcgacttcaccactctgcctaatggcatcaagtactatgacatcaaagtaggaggtggggctaaagcagttaagggatcgcgcgtcgcggtacattacgtggccaagtggaagggcataacattcatgacaagcaggcagggcctcggtgtcactggtggaacgccatatgggtttgatgttggcaattctgaaagagg

SEQ ID NO: 3806 - DNA, 550 bp, Hordeum vulgare
aaatgaaactgaatatatataatctatgggaacttgcttattctccaatgagctggaaaaaagctccaagaaagaaaaatattacactatggtgcacttatgtacgcaacagcaacactgaaatctggtacatctagacccctttcttgcagtaacactctccagaatgttcaaatatacatcattttctgaagaagtcaatgcacaattatccttcaacgatcttcacaggactcccaaatggactctgtttgattgatagtagttcgacatccagctcaatagttgcattaggaggaatttcttgaacgcccttttttccataagctagctccggaggaacaatgaccaacctctggcctccaactttcattccctcaaccccgagatccaatccttttagaacattgcctctttcagaattgccaacatcaaacccatatggcgttccaccagtgacaccgaggccctgcctgcttgtcatgaatgttatgcccttccacttggccacgtaatgtaccgcgacgcgcgatcccttaactgctttagc

SEQ ID NO: 3807 - DNA, 520 bp, Hordeum vulgare
cgagagagtggttgtcgtgtcatcctggtcgccgtcgagatcaaccccaaagactggccccaaggtaaaatcagagatgagagctgctggtcggacaaagaattttgcaggagcaaccagagctggtaccctgttgctaagatcgcggcggaggcagcggcgctcgagtacgggcgggaaaccgggcttggcgtggtaactctgaatccggcgctggtgttcggtcccctgctccagccgaccatcaacacgagcagccagttcctcatctacttcctcagaggaggccctgacgagacgagggacaagctgtggcacatcgtcgacgtccgcgacgtcgccgacgcgctgctcctgctctacgaggcgcccgaggccaccggcaggcacatctgcgcgcctcacttcatcaccgcccgggagctgctgggcctgctcaagagcatgtaccctgggtacccctgcatggccgaggacagcatacgtgacatggagcacccggctccgatgacctccggaa

SEQ ID NO: 3808 - DNA, 552 bp, Hordeum vulgare
caatgcattttttttctgaatcgtgacctccaacttcttccgtgacatttattttgttcagaagaggggggaaacggcatggcgtatcatcaccaccatccgcgtcctgtagaaacccggcctcccggcagcattcgacggtatctgtgatcgtctccctcagtggccgagagctccaccccagcttctccagctttccggaggtcatcggagccgggtgctccatgtcacgtatgctgtcctcggccatgcaggggtacccagggtacatgctcttgagcaggcccagcagctcccgggcggtgatgaagtgaggcgcgcagatgtgcctgccggtggcctcgggcgcctcgtagagcaggagcagcgcgtcggcgacgtcgcggacgtcgacgatgtgccacagcttgtccctcgtctcgtcagggcctcctctgaggaagtagatgaggaactggctgctcgtgttgatggtcggctggagcaggggaccgaacaccagcgccggattcagagttaccacgccaagcccggtttcccgcccgtactcga

SEQ ID NO: 3809 - DNA, 525 bp, Hordeum vulgare
accagcaccagctgctccggcttctcctccacctcctccggctgcccctgctgctgccgctgctgcaaagcaacggccgctctcaccctatgcagcgtacgaggggttgaagccaccgtcttccccaacccccagcaggagcagcagcaagaaaaaggacgacggcgattctccttcgccaccgccctccgccgcctctccggatgcggcgactaccaccaccaccgccgaggctgcagccgagtcgtcgtcgccgctgttggattccaacgccaatggcgttcctcccaccgccgcccctgccactgctgatccagggcgcccgctttcaccatacgccaggtacgaagacctgaagcctccaaccacgccaactccatccgcgccaaaagtatagagcggccggcccggcggttactttcatttaccttttcttttcctgctcgatcggcggcctctgcccgagcgcgagctcaaggcacgtgtatatgccaattttccttcttcgagaaaataccaatgtac

SEQ ID NO: 3810 - DNA, 551 bp, Hordeum vulgare
gtcagattcttaaatatataataaaaatggatgtgttcatcggtcgatgagaggcccgggactccttttcgggaaaaaaaatatgcatcttgccatcctcgtgtacattggtattttctcgaagaaggaaaattggcatatacacgtgccttgagctcgcgctcgggcagaggccgccgatcgagcaggaaaagaaaaggtaaatgaaagtaaccgccgggccggccgctctatacttttggcgcggatggagttggcgtggttggaggcttcaggtcttcgtacctggcgtatggtgaaagcgggcgccctggatcagcagtggcaggggcggcggtgggaggaacgccattggcgttggaatccaacagcggcgacgacgactcggctgcagcctcggcggtggtggtggtagtcgccgcatccggagaggcggcggagggcggtggcgaaggagaatcgccgtcgtcctttttcttgctgctgctcctgctgggggttggggaagacggtggcttcaacccctcgtacgctgcatagggtgagagcgg

SEQ ID NO: 3811 - DNA, 554 bp, Hordeum vulgare
  UNSURE (20): n stands for any base
gtacccccgggcctgcaggnaattggcacgagggggccgttgaggaggccaaaaaagaaacggaaaatcttcttgctcaaaaggagaagttgatgtctgtttttaaagagattgagaagaaagcttttcttgttcaagaagattataagaagacccaggagatgattgacacccataaagaggagcttgacaagacaaaggaagactataataaaacaaagaaagtggctcttagttcatccaccatgacattgattccaaaacatccactagttgtgctcatgggaagaaagtttacacagagtattctgtcactggcattcctggggacggtagatgcttgtttcgttctgtggctcatggtgagtgcattaggtcagggaaacccatacctaatgagaatcttcagagaaagctcgctgatgatttaagaacattggttgctgatgagtttatcaagagacggacagagactgaatggtttattgagggcaatttcgatacatatgtctctcagattaggaagccacatgtgtggggaggagagccagaat

SEQ ID NO: 3812 - DNA, 549 bp, Hordeum vulgare
tgtcaagcgctggtatctgccaagagataaatgatagcgagtacatttttctctaaaaaaatgatactacgtagtactacaagataaatcattcacataggtgaatggaagaagctcaatgattctgagacagaaaatgtaggagtatttggcaagcacagaaagtataggacaagaacttaactatctggtttctgagctccaaatgttttacagttttgacctgggttcagcgtttcctggtatatgcagcgcttcataatggccacagccatgatagaggactcggattgggtcttccttcccgtactcctggccatactctgcgatcgctatcaaaccgcccgctgcttcttcgcgcatataaacagtgatcggcatctgaagaacatgagaagccatgagcaattctggctctcctccccacacatgtggcttcctaatctgagagacatatgtatcgaaattgccctcaataaaccattcagtctctgtccgtctcttgataaactcatcagcaaccaatgttcttaaatcatcagcgagctt

SEQ ID NO: 3813 - DNA, 464 bp, Hordeum vulgare
cgtgaccggcggcggcgggttcatcgcctcgtggctcgtcaagctgctcctctcccggggctacgccgtccacgccaccgtccgcgaccccagtgaccagaagaacgcgcatctgatgcagctggacggggcggcggagaacctgcgtctgttcaaggccgacgtgctcgacagcgccgcgctggccgccgccgtcgaggggtgcgagggcgtcttccatgtcgcctcccccgtccctgcggataagatcctcgatcctgagtcagaagtcatggtgcctgccgtgaagggaaccttaaatactcttgaagtttgctcatctctgaaggttcagaaggttgtggtggtgtcatccactgctgctgttcgttataaccccaactggcctctgggtaaacccaaagacgagagttgctggtcggacagaaaagtatgcaaggacaatgagatctggtattgtcttg

SEQ ID NO: 3814 - DNA, 552 bp, Hordeum vulgare
cgggtgtacaattggcacccagatatgatatccaaagttttagaatttttttacatttcctggtttttttttatgctatattcatataggggcgtgtggtacctgggaactccaatgcatgttccgcagttacaagcacaatgacataactagaaagcactggccactgccgctcttgactcattcctcggcagcttgaaaacgacggaaaatatcagggaggcggtaggtctgtccctccccatcctgcagaattcctgtcttccggtaataatcgatgctgtccagtagcgtctcctccaatgccctcggcttccagcccagatcattcaattttcctgacgtgatcagcgtggtaggagagttctgatgcacatcagccttgcactttacatagttgtagtcagggtacgtcttctttagcaactccaacatagcgtttgtgctaatataatttggtgcgcagatatatcttccggatgattctggtttctcgtatactagaagcagggcatcggccacatcacggacatcgactatgtgccacagcat

SEQ ID NO: 3815 - DNA, 399 bp, Hordeum vulgare
gggctgcaggaattcggacgaggcgggtgctgcttcgattgtagataagctattggcgttcttgttggttggttggttggtcggtcgtttactttcatccaccaaaattaatgatctccggttcatcatgtggacggctggttcttgatcggccgtcttttgccgtatggccgactgactggccaagatgatcttcttggctggcccatgtagatgtagccttctcctgtcctgttggtgggtgtatgatccagtagcactcagacaattctgaacagattggttgatggtgcaaaagattatttgttctttgacgtgtccgctttgttcgctatgctagtgcttgtacggtactacttcattgtaatgcacaacagccaccgtatgtgtttaggctta

SEQ ID NO: 3816 - DNA, 376 bp, Hordeum vulgare
gtaagcctaaaacatacggtggctgttgtgcattacaatgaagtagtaccgtacaagcactagcatagcgaacaaagcggacacgtcaaagaacaaataatcttttgcaccatcaaccaatctgttcagaattgtctgagtgctactggatcatacacccaccaacaggacaggagaaggctacatctacatgggccagccaagaagatcatcttggccagtcagtcggccatacggcaaaagacggccgatcaagaaccagccgtccacatgatgaaccggagatcattaattttggtggatgaaagtaaacgaccgaccaaccaaccaaccaacaagaacgccaatagcttatctacaatcgaagcagcacccg

SEQ ID NO: 3817 - DNA, 404 bp, Hordeum vulgare
ccgacaggcccccttcaaccccgcccccaaaaaggacgacgagcagcagcccaccggcggccagaagccgtcaggctagcaccatcttcttcttgcataatacatattcttgccacgccattgcctgctctgcgccccgagctgccgattcttcagggtgtgagctgctttggtgccattttgggtagctgatccgaggggtatgtatgtgcttgtgtatgtgaattggggagactgtagcctgggtgtgtaccacggtgtccattttcagttttttgtttcatttttttgtgtcgcacacatatgtctaaagaggaggattcgaactgaacatagcatggcctggctcaactttctgtatatgttccactgaaaaatactcctttcactcttgaaaaaaaaaa

SEQ ID NO: 3818 - DNA, 398 bp, Hordeum vulgare
ggagtatttttgagtggaacatatacagaaagttgagccaggccatgctatgttcagttcgaatcctcctctttagacatatgtgtgcgacacaaaaaaatgaaacaaaaaactgaaaatggacaccgtggtacacacccaggctacagtctccccaattcacatacacaagcacatacatacccctcggatcagctacccaaaatggcaccaaagcagctcacaccctgaagaatcggcagctcggggcgcagagcaggcaatggcgtggcaagaatatgtattatgcaagaagaagatggtgctagcctgacggcttctggccgccggtgggctgctgctcgtcgtccttcttgggggcggggttgaagggggcctgctcggcgcagtcgaggttg

SEQ ID NO: 3819 - DNA, 371 bp, Hordeum vulgare
tctgcttaagtctgacccagaatcccaatctgcatgttccaggaaggtcggcagcttcttgaaagatggtatggaggttctggataccatgtctgaagtatcaccaagagaagaaatagtagaatcatatccgattggatctgaaacaatatctaattctgaagatgagttgaagctaattcatactgaaagtacgtcaactggttattccacagagcgctcttcacagaacttgtctgctcaagatacttcaggtgttcagctgccagttgataactcttacctggtaaattcagtatgctctgtacctggttatcagaatgatctggctgttactaatgtcgatggcatgctcaagtccaatgctgaag

SEQ ID NO: 3820 - DNA, 298 bp, Hordeum vulgare
ccaagcatttcagcaccatcttaacttgagtgattatctacacgaacacgacagtagttcaggcggcatatgtttgcaaggcataagcttatccggtcctcacgcaaatatactaagaaaggtgccacggattcaaacaagatgcgcatggcggtatatagaaagaagatcgtagctgacggagaatgaatggcggcatcagtgcacggagtggcagcagatgaagggcatccacggctgcttcctcactttggacctcttgtcgacgttgttgctgtcgtggggcatcttcgcgggg

SEQ ID NO: 3821 - DNA, 487 bp, Hordeum vulgare
gcacggggcttctctctcctccccttctctctaggatcgcagccagccagccagcgccagccaatcgcccacccacagcgcgcgcgcctcccgactgagccccgagaaagaagaagaagaagaagaggaagaggaacacagagagagaggcagagagcaatcacttcgtctgaaaagaagtgttcttggcagccagtcctctccgcccgccatgtccatggacgaaggctatggccctacctgggacagcgacgacgagtacgacaacttcatacgcaagatgaacccgccaagcatcatcgtcgacaacgattcgtccgcggacgcgacgattgtcaaggttggtagtgcaaacgagtatgggattctgctggaagtgatccaagtcctcatggatctcaatcttgtgataagcaaggcatacataacctcggatgggggctggttcatggatgttttcaatgtgactgataaggaagggatgaaa

SEQ ID NO: 3822 - DNA, 515 bp, Hordeum vulgare
ctcctacggtcatatttacattcttcatctacgctataatgtacaatgcatatttacaggtgatggatgggtctataagcaacacgatgcaatgtatgtaaactaaccctgcgctaccggagccaaatgcaggctccgattctcacggaccgcttcagcagctaaggtttgattgacggagaagttcgacgagagcttttaacgcacgaacattccaaggctagagagagaccttggccggaataagtttgcgaagaggaaccatgtcggggagtctttcttctgaggtgctggtgcctcaggctggcctttcacctgaatgttgtgccctatggcttccctgatggaatcaatggtcttctggtcgactatctcccccgcagaactccggacgtagaatgtgttgacggccgtccttcccctggtgctcacctctgctcttgtgacggtcaggctgttctcccggaagatgctggtgacctccgacaggaggcccaccttgtcatttgaacaca

SEQ ID NO: 3823 - DNA, 286 bp, Hordeum vulgare
acgaagcaaacggtggcagcccatagcgggggtgttacgcataacacacctctcctcgcgcagagccaccacccccgccgccgccgcccgtcccgtcgcgcagccgcctcgccgccgcccccacgacgtcgcgctccgtctcggccatggcgaagacgaagccgatggcagctggcgcggcctcggcggacaagaaaacgaacaagaagaaaggcaagggcactgtgaaggggaggaacggcccggcggccgtggccatgaaggcgcgcggggccgcggcggcgga

SEQ ID NO: 3824 - DNA, 473 bp, Hordeum vulgare
tttttttttttttttgtgtcggttcagatgcatctcaagagtaacagcgcatacaagaaatctggaagaaaataacaacaaaatcgcttcctgcgctaaattagattactactactattgcagcactctagagcaactctactcctgagtgcaataaacataacacctccatccgcatcagtatttggtcgaagatgacgctgtgtgaagtgtttcacgcatttcatatgatcactcttgtattccggtgtgtggccatgaagtggcaaaaaggcggttaaaatggggcatgacgaggtcaccaggggcatgcctgtttctatctccagcgcacaggaagggagtggacgaacgtaactgcggcggcaacatgatcaacttatcacctcctcctttttttgccttttcccagctgcccacatttaaaagcgctttcttgttcttggaggaaagccaatgccttgccatacttt

SEQ ID NO: 3825 - DNA, 518 bp, Hordeum vulgare
ctgtgacagtagttgatctagaggcacatgttacccgggaaggagttactcatgatgataatgcaacagtgctttctcataacacaaggaacaaacggcaaagagttgcacctgtagtaaacatctctccagaaacaggagaaggatccagcttacagtcaaaaagtgcggggaaaactagcaaagagcctgtgaaggtgactccaaaggaacccatcttcacctgcccggtgtgttggaacaagctggacgagcccgccacaacaatgtgcggccacatcttctgcacaaactgcatcaagcaagccattcagttccagaagaaatgccctacctgccggaagcacctgaagatgaacaacttccaccgcatttaccttcctaacaccgctcgttaaggagtcctcccagggagaaccatggtggatcttctgctgaggagcattgttgtaccatcatcacctagatgaatgtatggaaatgggtcggtaggaattcagcgtcctgatgaccggagt

SEQ ID NO: 3826 - DNA, 551 bp, Hordeum vulgare
gtaacagtctgtgatacttaacatttatagctgttgtattgtacaaaactcaaagtgaaattacttcagtgtgtctccgcttgtcagcatgactatgaagtgcccctggggacgagatcatcaacatcctcagccatactacctcatggtagctgactaaaatcttgataaaatgctgggcagtcacttcagaacatagtacaccaccgaacaggtgagtaaagaagcaccaaatattatttcaaccgcagttacatcgagcaactatggagaagggtgcaaccgtgcaaggctaatagcctaatacatcaacatttttatgttgccacaaaaaatatataatggaaggctacatgcaaatttgttaacccatttcaggcagcactctgtttgtcaggttaacccatttcaggcagaaggttatccactccggtcatcaggacgctgaattcctaccgacccatttccatacattcatctaggtgatgatggtacaacaatgctcctcagcagaagatccaccatggttctccctgggaggactccttaac

SEQ ID NO: 3827 - DNA, 456 bp, Hordeum vulgare
gaggcagctcggatccggcctatgctggcgcaggtgctgcggaggctccgcccggcggcggcggcgtccacggaggcggcaagggggtactcctccgcggccaaggagatcaccgtacgtgacgcgttgaactctgcgctagatgaagaaatgtctgctgatccttctgtctttttgatgggtgaagaggttggagaatatcaaggtgcatacaagattacgaagggcttgcttgacaagtatggtcctgatagggttcttgataccccaatcactgaggctggttttacaggaattggtgttggtgcagcctatcaaggtcttcggccagtcatagagttcatgacatttaatttctcaatgcaggcaatcgatcatatcatcaactcagctgccaagtcaaactacatgtcagctggtcagataaatgtcccaattgttttcagaggaccaaac

SEQ ID NO: 3828 - DNA, 554 bp, Hordeum vulgare
cgggaaagaaggaacatgacacatgcacgagaacacctcagttttccatttatgtaaccaccgttattaggccgtgctaatcaatcaacgaaagctgcgtgcgtaataattcacaagacagtggagggaggcaccagcgaatgcggtgagatccaactgcagcagctaaaagaataaacatgccaaggcacacctacaaaaatttaactcgcttcgagtttgggcaattgtggataccattatggaacacacacgtttctggccgggcgggcgacgggaaaaagcatgggcaaagtaaagtgaaatttcgatcacgcagttgccgccatgggcaacgctctgtagcaggctcgcctggccgctcggacgatatcctcaatctgtggaacagccaatctctcaaggttggcagcatagggcatgggtacatcagctccagcaatcctctcaattggagcatcaagatactcaaagctttcttctacaacagacatgcatatctcagcaccaacaccatgctgggggaagccttcttcaagagtcaccaatctatt

SEQ ID NO: 3829 - DNA, 518 bp, Hordeum vulgare
  UNSURE (5),(25): n stands for any base
gcacngggcctggtactcctgtggnggatgttttccctctggtcgaagcagaaacccctgtagaacttgttctggtgatgacggttgagcctggcttcggtggccagaagttcatgccggagatgatggataaggtgcgcacgctgaggaagaagtacccgtccctcgacatagaggtggacggtggcctcggtccttccaccatcgacgtggccgcgtcggccggcgccaactgcatcgtcgccggaagctccgtgtttggagccgccgaccccgggcaggtcatctcggcgctgcggaagagcgtcgaggcgtcacaaatcaagggctgatccgatcatctgtagcctcgcacgctcggctgtattgttttgtttctgctgtaaactagtagaactctgaaccactccgcacgtcggtctcagtttgcatgcagttccgcaatccgcactgcaaactgatgagcgagcgagtctgtgtccctgaataagatgtgctcttggcaacttgtgacaaaa

SEQ ID NO: 3830 - DNA, 494 bp, Hordeum vulgare
  UNSURE (16): n stands for any base
aagagcacatcttatntagggacacagactcgctcgctcatcagtttgcagtgcggattgcggaactgcatgcaaactgagaccgacgtgcggagtggttcagagttctactagtttacagcagaaacaaaacaatacagccgagcgtgcgaggctacagatgatcggatcagcccttgatttgtgacgcctcgacgctcttccgcagcgccgagatgacctgcccggggtcggcggctccaaacacggagcttccggcgacgatgcagttggcgccggccgacgcggccacgtcgatggtggaaggaccgaggccaccgtccacctctatgtcgagggacgggtacttcttcctcagcgtgcgcaccttatccatcatctccggcatgaacttctggccaccgaagccaggctcaaccgtcatcaccagaacaagttctacaggggtttctgcttcgaccagagggaaaacatcctccacaggagtaccaggc

SEQ ID NO: 3831 - DNA, 517 bp, Hordeum vulgare
ctggaacagggttgttggatctgactatctgagccagtgacctctcgccgccagccgcgggcagatgctgccggccggcaggagcaggccgcagcccaggcctgcgccgagatcttggtccttctcagacatggacttctcggacccgaagcgcaagtccaggtacctcagcaagatcatcatggtggcgctcctcacggccatgtgcgtcgtcatgctcacccagccaccctgccacaggaaggctcccagtgtgttctctatccatgaactcggagtaactcatgtgttggtgacgggtggcgccggctacataggatcgcatgcggctctacgactgctcaatgactctttcagagtcaccattgtggataatctctcaagaggaaatattggggcggtcaaggttcttcagaacttgttccctgatcctgggcgattgcagttcatacatgctgatctaggcgatgcaaaagctgttaacagaatattcgcagaaaatgcatttgatgctgtc

SEQ ID NO: 3832 - DNA, 548 bp, Hordeum vulgare
tacgaatgatgaagctccatatataaatataaaatctaggatttgaacaaatgaccatacacgctatataaattatgtgtaactgctatctctgttagtgagtcaaagaatatatcgacccgagtctgcatagccgctccggtgcttcttctgccatgtccacgcgaccctgaggctctcctggagttcggtgtgctgggctgtccagtttagttcgcggttgatccttgcggggttgctgtacacttccgcatagtcaccggggcggcgcgggaagtagtggaccttgatgtcgactccggtcgccttcttgcaagcttccacaaactccttcactgacctacctcttccggtgccaacattgtatatgccaactttgcctctctccgccttgttgagcgctttcacgtgggcatctaccaggtcggtgacatcgatgtaatctctcacgcaagtcccgtcgggagtttcgtagtcggtacctttgaccttcaaacctgggattattcctagtgctgcgtcgaagcatgcgccagatatacggccat

SEQ ID NO: 3833 - DNA, 539 bp, Hordeum vulgare
  UNSURE (16),(27): n stands for any base
gtcccccggctgcagnaattcgcacgnggggaagattagccagaaaatgaaatgattttctaaacttgaggaacagaatattgataggtgaagaggttctgaacatggcgatagaatcagggcaagggatgcaacaggaaaaactactattttgcatgttaactttgatacgatgacccctaagaggtgttcagatagaagactccaaaatagggtcccagaatctgcccctgtatccccgcgcattggatgtcttcggggtttaagcctctttcctgtaagaagatcactggttggctccttcgaggagtcccttttatctggtcgttattcgtgtggaaacgataagcagaatattgatggttttctggctgtcctgaatgtgaccggcggcaacttctgtcccccaactcagaagcttccatttgcagtaaccagcattgatgaggatagctccctgctgtactattcgtcgattgatcttgctgggaggttgcctactaacaacagcaaaagcccaaaacttaaaagaagctcca

SEQ ID NO: 3834 - DNA, 551 bp, Hordeum vulgare
tgagtgaaggacacgagcttacacgtcctaaatgctcttttgttaatatctaccagtatattgtgctaaaggacaacaaaagaaactaagctcggtggttgtgtgccactagaatggcaatttcccgaataaaagaaaacacacaccataacaaagattgtgttgaccatgttctacaccaaacacgaaattggaagaaatgggatattccattgcaattattaattctgtacatggtaataaacacaagagactaactgacaagttagtgatggcatgatatttacacatttcatgttagatgttcaagaatcaattgcttatgtcgaagtacttgggatcagcagggaagtcgtgctcaacccgcagctcgccttcgtctgaatctgagtgcctttgaggaaagacaactctaatatcattgtagagataaaatcgcctctcttcctcggtcgcggtactccgattgagtggttctgatgacatgccaggtttggtccgctgcatcgatcttgatgatttcttggaaaaggggctcagaaaacgcaggt

SEQ ID NO: 3835 - DNA, 551 bp, Hordeum vulgare
gtctccccgggcctgcaggcaattcggcacgaggggagggggtcgacccggcgctggagcggatggtgctgcgcgcgtgcctggaccaggcccccgagcgccgccgcgtgcgcgaggccttcaaggacgtgcagctcagcatcgaccactgcctcttcaaggcacaatacagtgacattggaacaaaagagtcatatgagcggaactccagaggtgtggagatattctcaaaatgttggtttccggaaaaccatcgtatgaaagcaattgtttgtctatgccatggttatggagacacttgtacatttttccttgatgggattgctaggaagattgcttcagccggatatggagtatttgcattggactaccctggttttggtctttccgaaggacttcatggatacattccaagttttgatacgcttgttgacgatgtagccgaacattttgctaagatcaaaggtaatcctgaatacagagaacttccaagctttctgtttggccaatctatgggtggagcagttgcattgaagattcactttaagcaa

SEQ ID NO: 3836 - DNA, 534 bp, Hordeum vulgare
gatgaatggctatacatattacaatcagcaggacataagtatatgtatcaagcgtaaatcccaaaatggaattcccagccatgaactggctccacaaatgacaaaaaaggtatctgtgcagctcacgacgacggtatttcctttgcggaatgctgatccagccaagagattatgtcgtcgagaactttgaagatcccctcgtccggttcaccttccaagatggcatggtatgcgtctttgtaaaggcacagcatcttgtccgatgtcttcgctttttcatagaggtctttgctcacgcctggatcggtgaccaaatcagcatcgccatgcagaatgattatgggcagggaaacttcgtctaggcgactttctatctcttgtgtggtcctcaacatctccaaagctgttcgaagacgtggtttatccttgtaggcaatcacattgtaagagcactgctcttgtttttctttctctttgaatgccaattctgctaagtccttatttggaacaagcttctcttttggaaggagttta

SEQ ID NO: 3837 - DNA, 485 bp, Hordeum vulgare
atgaagatctactctgtgtcaactaggcattattttgcttttggtgccctagtatctgaggaactctcctacaaactcaaagagttgcctaaggtccgttgggttcttcctgattcatacctcgatgtcagaaataaggactatggaggagaaccatttatagatggacaagctgttccttacgaccccaaataccatgaggagtgggtgagaaacaatgcccgtgccaatgagagatcccggcgcaacgacaggcctcgcaactttgacaggtcgaggaactttgaaaggagaagggagaacacacaggcctaccagagcgggcctgctccaccagggcagagccaaatgccaccccatgatgctgctcctccaaggcgtcctccacagggcccgccaccgccttcgggtgccccaccaaattaccagtcccatgccccaaacccacaggcgggctatgttccaggaggtggaccaaactatca

SEQ ID NO: 3838 - DNA, 552 bp, Hordeum vulgare
  UNSURE (22): n stands for any base
aagctctggctcatacgatagntcagcagtgtatttatttcgacaacaagcaaaataaaagccacttacctaagcttgcagtagttctagttctcaaaacaccattatggatagagaatatatgcataaaagtccacgagaacaacatagggcgactcgagcagcgctcgtactaacttcctacatggcaatcttcaagcagtgttctctactggtagttcctccctggcccgtccctgccctcatagggaggaggggcggcgttgttgtagttaccgccaccttcgtagcctgggttacctggctggccctggtagcctggtgcaccaccaccatagctagggccactgccttggtagggaggaggctggttgccacctgcaaaagggggcgacgggttgacacctggccctccaccctggtggtatccagggttgttgctatgatgggctgggcctggtccattctgcatgttaccaccaggattaccttggtagccttggttaccagcttggtacccaggggttggggcaccttggtatccaggggttg

SEQ ID NO: 3839 - DNA, 518 bp, Hordeum vulgare
ggaccccgactcagtggcgaaggcgttcgtcgagcactactaccgcacgttcgacaccaaccgggcggcgctggtcgggctgtaccaggagggctccatgctctccttcgagggcgagaagttcctcggcgccgccgccatcgccaccaagctcacctccctccccttcgaaaagtgcgcccataccgtcgtcaccgtcgactgccagcccgccggccccacgggcggcatgctagtcttcgtctccgggtccctccaggccggcgacggcgagcaccacatcaagttctcgcagatgttccacttgatgccactcggcccagggaacttctatgtgcacaacgacatgttccgcctgaactacggctaagaatcatacaagaggtcgtgcgtccccatggaagacagaatgttctgcgaaacaaacaatctggttgtggtttttgtgtttgatggtgaaaaactttgtggtgatttcttctcaacagcttattatgagattcactggggatgaaaca

SEQ ID NO: 3840 - DNA, 547 bp, Hordeum vulgare
ataataaccccgataaatttagatccgacccatatactgggtgtttcgttatgtttatccccagtgaatctataataagctgttgagaagaaatcaccacaaagtttttcaccatcaaacacaaaaaccacaaccagattgtttgtttcgcagaacattctgtcttccatggggacgcacgacctcttgtatgattcttagccgtagttcaggcggaacatgtcgttgtgcacatagaagttccctgggccgagtggcatcaagtggaacatctgcgagaacttgatgtggtgctcgccgtcgccggcctggagggacccggagacgaagactagcatgccgcccgtggggccggcgggctggcagtcgacggtgacgacggtatgggcgcacttttcgaaggggagggaggtgagcttggtggcgatggcggcggcgccgaggaacttctcgccctcgaaggagagcatggagccctcctggtacagcccgaccagcgccgcccggttggtgttgaacgtgcggtagtagtgctcgacgaacgcct

SEQ ID NO: 3841 - DNA, 280 bp, Hordeum vulgare
attcttggttatggagctttggcaagattaaagaagatgggttattccacttcgacaaaagaagctgcaaaggcaatgtatgctatatcggctttaatcagaaataacgtaaatggtcaggaggcattcgctttggaaaatgggaacgcaatgctgcagcacatcttgggaagcaacagtgttgatgttgggcttcagaagaaggcattgtttttattaacagatctagcggactttgagctaaatggtggaaactcacggctcactttcttaagtgaac

SEQ ID NO: 3842 - DNA, 543 bp, Hordeum vulgare
cgattattgtaggagctcacacagggaagatcatcgtctcttcctccagtaaaaggaaaaccttccaagtaacacaggagatgtcgtaactagtcctgcgaatgggaaaactaaccatatcttatcaagtgtctaacctatctatccatccaatcccacagcactataacccattaaccctcctgcaagagtaagaggggactcaactcggcagacagactctttcggaaaataatctactctttcaaaaacttggcaaccagcactgagtcactggatcgaaaactcggcaggctgcttcccttcccttcatccgtgtgtgctgtctataacgccgccgcggcagcggtacccggcttgagcttctgttggaaatacatcaatacttctctccgaagggcgtcaacctccccggcatactccttctggtcctctgaaggcagctcctccagctgcacccccagtctgtacagaacactgtctagaccgcatgactcgaagtccctagcgtctgtcgagggaagcttcagtaggctcctaatg

SEQ ID NO: 3843 - DNA, 543 bp, Hordeum vulgare
ggtctgcaggcaattcggcacgagggagagcttgggtcttttgattttgtcggatttaaccactacgccgcctcatatgtgaaggctgatcttagcaagctggatcagaagctgagagattacatgggtgatgcagcagtgagatttgaaagcgtgccattttttgacttaaagaaccagtcgtcaccgtgggttctgagggaaatgctggagcatctccaggtcaaatacaagaaccctgtggtcatgatccacgagaacggagctgccagcgtggctgatccctctggtgataaggccctcgacgacgagttcaggtcgcggtacctgcaggattacatcgaggcgaccctccaatccagcaggaacgggtcgaacgtgcagggctacttcgtgtggtcattcgtggacatgttcgaattcctctttggctaccgcatgggcttcggcctctatggcgtcgacttcaactccgaggagaggacgaggtaccggaggcactccgccaagtggtatgccggcttcctccgtggcggcgagctc

SEQ ID NO: 3844 - DNA, 555 bp, Hordeum vulgare
tacatatggcgaaatatatttacatattttcagcacatacatcaggatgaacatttataatgtataaggaacaatcgactccaaagaagcagatgtataaatcctactgcccaagcaaaattgaactcccatccaaaaacaagaaccaatcatcctcccaggcttattcgtcatccatcctcctattcgtgggctacagaagcctgaaaatgcgtgccaagatcactgggaatacgcctggccggggacagccaccggcctgagctcgccgccacggaggaagccggcataccacttggcggagtgcctccggtacctcgtcctctcctcggagttgaagtcgacgccatagaggccgaagcccatgcggtagccaaagaggaattcgaacatgtccacgaatgaccacacgaagtagccctgcacgttcgacccgttcctgctggattggagggtcgcctcgatgtaatcctgcaggtaccgcgacctgaactcgtcgtcgagggccttatcaccagagggatcagccacgctggcagctccgttctcgtggat

SEQ ID NO: 3845 - DNA, 547 bp, Hordeum vulgare
gtcccccggctgcaggaattcgacgaggttaccgcttcaccactgctgccttccctccctcgcaagcctctccccgtccgcctcgccgccgccgccgccgcccgtccgatccgccatggcgtccgaccagaacgaaggttcaaaatcagaggggttggcagctggtgcaggccttcccagtccttttgatttctccaacatgagcagcttgctcaatgatccatctataagggagatggctgagcaaattgccagcgaccctgtattcaaccagatggctgagcagcttcagaaaagtgcgcagggtacaggggaacagggtgttccaagtttggatcctcaagcatacctggaaaccatgacaaaaggtatgcagaatccgcagttcatgtcaatggcggagcgtcttgggaatagtcttatgcaggatcctgcaatgtccagtatgcttgagaacttgactagtccagctcacaaagagcagcttgaagagcgaatgacccgtatcaaggatgacccgtctttgaagccaattcttgatgagata

SEQ ID NO: 3846 - DNA, 546 bp, Hordeum vulgare
  UNSURE (11): n stands for any base
caccttcatantcattttaacaccaagaaatattcacgacaggtgtatagacgcaatcatcacccctgacagctcccacagcaaatagctcccccgtgcatggagatggacaaagaacagggttgcacagcaggatcaaaccaacggagtagatggactcttgttaagtagcaccgcaaggccacacaggtaacaggcgagagctaccaaactaagtaaaccgagggaaagcgaccaacaccatgccacaacatgacaccgctgagagaccagaaacaaggaagtgttttaggatcgacgagcaccgggtctgagggtttgcttcataggaacacgtcctgctccagcagcttgaccacctcgtcctggctgttgagcttggccacctcgatgggggtcttcccgtccagattttggagcgtgacagcagcgccgtgcttcaaaagaagatccacgcattccttcctaccgtatccagcggcatagtgcagcggggtgttcttgttcttatccagtgcgtcaactgcagcgcctgcctccagaagg

SEQ ID NO: 3847 - DNA, 511 bp, Hordeum vulgare
tccatctataagggagatggctgagcaaattgccagcgaccctgtattcaaccagatggctgagcagcttcagaaaagtgcgcagggtacaggggaacagggtgttccaagtttggatcctcaagcatacctggaaaccatgacaaaagttatgcagaatccgcagttcatgtcaatggcggagcgtcttgggaatagtcttatgcaggatcctgcaatgtccagtatgcttgagaacttgactagtccagctcacaaagagcaacttgaagagcgaatgacccgtatcaaggatgacccgtctttgaagccaattcttgatgagatagagcgtggtggtccatctgcaatggtcaagtactggaatgaccctgagattcttcaaaagattggcgaggctatgtcattgaacttcccagtagatgctgctacttccactgtactatctggacctcaagaaactgatgaagaaggcgaggatgatgatgagtccattgtccataacaccgcc

SEQ ID NO: 3848 - DNA, 554 bp, Hordeum vulgare
ggagaagatggacctcttgttaagtagcaccgcaagggcccacaggtaacaggcgagagctaccaaactaagtaaaccgagggaaagcgaccaacaccatgccacgacatggcaccgctgagagaccagaaacaaggaagagttttaggatcgatgagcaccgggtctgagggtttgcttcataggaacacgtcctgctccagcagcttgaccacctcgtcctggctgttgagcttggccacctcgatgggggtcttcccgtccagattttggagcatgacagcagcgccgtgcttcaaaagaagatccacacattccttcctaccgtatccagcggcatagtgcagcggggtgttcttgttcttatccagtgcgtcaactgcagcgcctgcctccagaaggatttctgcacacttcaactcgccgtatccacatgcaaaatgtaaggcccttctgccctccacatcttcttcatccttgtttgctccaccatctaatgctttcttcagtccctctgcatcaccaacactggcggtgttatggacaatggactc

SEQ ID NO: 3849 - DNA, 544 bp, Hordeum vulgare
  UNSURE (3): n stands for any base
ggnctgcagggaattcggcacgaggccaccgcctcgacgatatcgacgcctgctccgccgagtgcgaggtccacatcgcgcaggagtggctcgagaagatgcccgcggcctcctacgaggagcgctacgtcctcacgcgcgcctcccgcaaccgcgagctcaacaagcacgcccgcctcggctgccaggtcgtgctcggcaaggagcaccaggggatggtcgtcgccctccccgagcccaagccctgggacatcccgtaatgcgcccaccctccgcagcgcgacgcgaggcgaaattgcgcggcccttcgacgccgcgagccttccttcttctccccgcctgacgcttccctttcatggtacggatttgatgaaaagaataatgagtttgatgggcaaaacttagagctgtttctggaacttttattttgtttgaaatgtggagtatgtggatgatgtaatgtggaatcccttgccatttacctcagtttgttgtttgttttgctttgtacatttgatgtattcttggttgcagctcagcctat

SEQ ID NO: 3850 - DNA, 529 bp, Hordeum vulgare
ggcaatgaagagaggataggctgagctgcaaccaagaatacatcaaatgtacaaagcaaaacaaacaacaaactgaggtaaatggcaagggattccacattacatcatccacatactccacatttcaaacaaaataaaagttccagaaacagctctaagttttgcccatcaaactcattattcttttcatcaaatccgtaccatgaaagggaagcgtcaggcggggagaagaaggaaggctcgcggcgtcgaagggccgcgcaatttcgcctcgcgtcgcgctgcggagggtgggcgcattacgggatgtcccagggcttgggctcggggagggcgacgaccatcccctggtgctccttgccgagcacgacctggcagccgaggcgggcgtgcttgttgagctcgcggttgcgggaggcgcgcgtgaggacgtagcgctcctcgtaggaggccgcgggcatcttctcgagccactcctgcgcgatgtggacctcgcactcggcggagcaggcgtcgatatcgtcgaggc

SEQ ID NO: 3851 - DNA, 552 bp, Hordeum vulgare
gtacccccgggcctgcagggaattcggcacgaggctttgtcgctccacatgattttgcggcatgctttcactatcaggaagagaatgctattgcgcgtggaattcttccattgctacgccgtgctacattggttcaaacatttggacagaagaatcatgtttgcttgaaagagggatctattacgataccgccatttgcgccaccacagaaaatgcaggctcacttgattcctcctgatactccccgttcaatattcgtttacttcagaggtttgttctatgataatgggaacgaccctgagggtgggtattatgcaagaggtgctcgagcttcattgtgggagaacttcaagaacaatcctctctttgatatctccaccgaacaccctgccacctactatgaagatatgcaacgtgccgtcttctgcttatgcccgttggggtgggcaccatggagtcctaggttggttgaggctgtggtatttggctgcattccagttatcatagctgacgacatcgtgctgccttttgctgatgcaatcccttgggacg

SEQ ID NO: 3852 - DNA, 550 bp, Hordeum vulgare
gcgaaaatgaatttgattctttaggttagaagatgacaagaacactcgtttaatttctttacttctttatacaattacaacgttacaaccggttacgtaagatccacaatttttagtcgagtgacaccagagcttataacacacctcaatattgtataattctatggatctccgaacttctcagagaaaggcaataaaagaaaccgaacttttcacaagatcaacaaaaccaggtcttgtaaggaagcttttatgttaccaaggcttcagatctccaacaggcccagatgtccagttgagatgcttctcacctggctgtaagtatacggtctctgggtgcgggagcttgcgagcaaggccatttagaatctgatggaatgcatctcttggttgcgctggctgcgggaacaacatggccttcttcattgatgggttggcgagcaatctttgcttcctcaggatatcatcaatcgggatagacgtgagaattgaatcaagctttggcacatcctcctcatcaacaaaaacaccaatttcgtcccaagggatt

SEQ ID NO: 3853 - DNA, 518 bp, Hordeum vulgare
aaaactttaatattttctcatacaaaatgaagtattgatgcaaaagaaatccaataggacctgagaatagtaacataatattgacattcttgtgccaacctgccaatcgtaaataactttctaatttgatcaaggaaactttctagccagaataccaatattaatgaccttctgacattaccaggaatgacctggtcttgtagcgaagattattcattctttttgggtttttctatatggccaagtaagcactcctatgaggtgttgtgtttctgtggtcgagctgaatcatctaaggcctactagtgatacaacttccctgcacaaattttcctattcatttgttaaaatgaattggtctctacacccccttttcaaactactttcaagatggcgtcttctatttgtagtcatccatgcaacggtttcaactagtcagtgtcaactctcactaaactagtgtgcatggctgacttattttactggtttatactttgtagtaaaaggggaagaaagaa

SEQ ID NO: 3854 - DNA, 534 bp, Hordeum vulgare
ccaggcagatctccggcatcaagatgggaagaaatatattcagttacagttttcaccaaccaaaccttgcaacatcaatctggcaaggcggggaacactgccacagatggcaggcaatacagaaaatatataagcagcgagctggatcctgcatggatagcaatcctatcacagcacacaaatcacaaccagccatatacagtattacagtacagtacgacgacatctattgcccatctggaaaacaaggtgacatactgcaggttcaaaaatttcctaataatcctgatatgtttgtacaatggttggtgtatgcagagctcggcactgtgtgaagtatagcagatgctgtataacggagaagaacgacaaaaagcatttggtggcattgagctgttgacagaagtatgcaaaaagactactcagttggtagcaagacgaatcgacaagaactgtggaggttggaggctaggaaggtattccctgttgggaatcgactacggcggcagttaagctatgcatcattcttggtgg

SEQ ID NO: 3855 - DNA, 518 bp, Hordeum vulgare
tgctgcatctgcatctccaactaatagtggagcggaggaagaggagaaagggctggggtagcaggcagcaatggcgacggccaagcccatcctgtacggcgcctggatcagctcttgctctcaccgtgtccggatcgctctcaacctcaaaggtgtggactatgagtacaaggcagtcaatcctcggacagatccagactatgagaaaatcaacccgatcaaatacataccagcattggtagatggggactttgttctatctgattctctcgctatcatcttgtatctggaagataagtatcctcagcatcctctcatgcccaaagatatcaaaatgaaagctcttgatcttcagattgcaaacatagtttgttcaagcatccaacctctccaaggctacggtgtaattggtttacatgagggtaggttgagctccgatgagagccttgaggtggtacaacgttatattgacaagggcttcagagcaatcgaaaagcttttggatggatgtgacagca

SEQ ID NO: 3856 - DNA, 554 bp, Hordeum vulgare
tattatttttcttgcccggtgcaacgcccgggcatttgtactagttaataggtaaagaaatgtaccgcaccaatggtgccggagcccaaccggcagctcggcatgcatgttcgcgcacctcggtgagatggaccccaaagtgtagacacactgataagttatacgaggttctttcatttgcagattacattcctcattattgtggaaactacatgcatatttatttatttatttttggaaaaggaggaaactacacacatatagttgtaactggcttgctttcttgattatcaggctgaaggtgcatcttgctgattttggggcagtgcagcttgaaatgccggaatttccatgtatacgtcgtgaagtcgcgacaaaattgggtactttgtcatatcaatctggaagcgattgatggcggcatgaatctgtggggctagaaacacatctcccaaatggacttcatctccaacgcaatatttgctgtcacatccatccaaaagcttttcgattgctctgaagcccttgtcaatataacgttgtaccacctcaag

SEQ ID NO: 3857 - DNA, 517 bp, Hordeum vulgare
tgtttgcgggtcatcaagttcttgtgatggaaactcctggtcatacatcaggtcatgtgagcttttatttccctggatctggagcaatatttacaggtgataccttgtttagtctatcatgtggaaagctttttgaggggactccggaacagatgtactcttcactccaaaaaattgtagctcttccagatgtgacgaaggtgtactgcggacatgaatatactctgagcaattcaaggtttgccttgagcatagaaccaggaaatgaagaacttcaggaatatgctgcaagtacagctgatctgcgcaataagaatacaccaacggtgccaacaacaattgcgagagagaagcagtgcaatcctttcttgaggacctcaagtccagagataaagaaaaggctgtccattccagatcatttcgatgatgcacgtgttcttgaagttatccgacgggcgaaggataatttttgactaaccacaaaggaaattctcataaaacgatgacacaaccatct

SEQ ID NO: 3858 - DNA, 523 bp, Hordeum vulgare
ccaggatagaggattacaggacacattttatttgtagtcgacaaaagaatcaccagctgctatcagattaacaagcactctgtgcaagctacatacaatgcgagacaaattttcgccaaagcattctaggaacatcaagctatacacatttccttccatgcgttccttctgttgtggtcttgcggggttctttgtccacttctgcttttcaaagagatggttgtgtcatcgttttatgagaatttcctttgtggttagtcaaaaattatccttcgcccgtcggataacttcaagaacacgtgcatcatcgaaatgatctggaatggacagccttttctttatctctggacttgaggtcctcaagaaaggattgcactgcttctctctcgcaattgttgttggcaccgttggtgtattcttattgcgcagatcagctgtacttgcagcatattcctgaagttcttcatttcctggttctatgctcaaggcaaaccttgaattgctcagagtatattcatgtccg

SEQ ID NO: 3859 - DNA, 503 bp, Hordeum vulgare
ttacgaggtcgcagtacaacctggagcagctcgatggcgtgcgcaacctcttccactcgtagccaagcgcatccgcatggaggggttcatcgtgatggaccactacggtacctacagaaagttcgaagaggagatggccggctacctcaaggaagggaagatcacttacgtggaggacgtcgccgaggggatcgagagcttcccgtcggccctcattgggctcttctacgggcgcaacgtcggaaagcagctggtggccgtcgcacgggagtgacgtcgcatgccaggagccctcgtggtctcctggatcgacaagtgctgatgtgccttcagagatcagaattcagatatatatatatatataggcatacttagtccggtttgctggatgcagcatcctttgagccagtgtttggagaaaactgaatcctgcttaggtgaaccaggaagctggaatgaactaataatgtttactaatattacaaaaggggagttgatggtac

SEQ ID NO: 3860 - DNA, 497 bp, Hordeum vulgare
gtactcatcaactccccttttgtaatattagtaaacattattagttcattccagcttcctggttcacctaagcaggattcagttttctccaaacactggctcaaaggatgctgcatccagcaaaccggactaagtatgcctatatatatatatatatctgaattctgatctctgaaggcacatcagcacttgtcgatccaggagaccacgagggctcctggcatgcgacgtcactcccgtgcgacggccaccagctgctttccgacgttgcgcccgtagaagagcccaatgagggccgacgggaagctctcgatcccctcggcgacgtcctccacgtaagtgatcttcccttccttgaggtagccggccatctcctcttcgaactttctgtaggtaccgtagtggtccatcacgatgaacccctccatgcggatgcgcttggctacgatgtggaagaggttgcgcacgccatcgagctgctccaggttgtactgcga

SEQ ID NO: 3861 - DNA, 518 bp, Hordeum vulgare
aggatatgatgcttgggagaattgaaggcatgaaggacgtgatcgagcaagtgaacaggcagtttaaagatccagacttgacaacctttgtttgtgtttgtattcctgaatttctttcattgtatgaaacggagagattggtgcaagagttagcgaaattcgagattgatgcacacaatattataatcaatcaagttatttttgacgaggaagctgttgagtcgaaactgctaaaagcgcgggtaaagatgcaacaaaagtatgtcgatcagttccatatgttatacgacgacttcaacatcaccaagttgcccttgctcccagaggaggtatgtggtgttcaagctctacaaaacttctccaagcacttcctggcaccatacacggcgtcgctgaaaaggggcagcgtggaggagctagaagagcgagtggctacactgaaatcaggactgcaagtggccgagtcggaactagatagagttaggaaaggaaagcaggtagcatgagccattttcgcc

SEQ ID NO: 3862 - DNA, 550 bp, Hordeum vulgare
tagcactcctttattgattttcaaacttacttatgtttaacgagatactggtacagcagtgcacaagggattctaggtaatcaattccaatctcagcccacaacagctcctaagcaacctataatcaattccaatcataaccctaacagaagggcaaaaaaaaaagagacctatatatttcgcgtgccttacagtacacttctcttctgatgactataacaacaaatctaaaattttcaactggggaaacaggaaatggaggaaatcgaccggagaatgcaggaacgaggaaaatctctatagccagtgtctgcagagtgcaagagcttctgacaggcgaaaatggctcatgctacctgctttcctttcctaactctatctagttccgactcggccacttgcagtcctgatttcagtgtagccactcgctcttttagctcctccacgctgccccttttcagcgacgccgtgtatggtgccaggaagtgcttggagaagttttgtagagcttgaacaccacatacctcctctgggagcaagggcaacttgg

SEQ ID NO: 3863 - DNA, 424 bp, Hordeum vulgare
aagattccccaccagtgagtcccttgctcctcccctctcgcctccccggctgttagttactagtacctagttttttggccggcgcgtggagggggatgggatttttcgagctctcgggccgcttgctccgctgattcttgagctgcggaggtcccttggctccgccggccaggcgctggttgctgttccgcttcttgcggtgtttttaggtgaacccgtgaaggggtcagtgagaagaggttaagctcaaatcttggcctggtcttcgctctctcaaggcctgatatttctcatcaattcaagtgtgcccgtagaggcggagaggggtctcccagattttgcaagaacaagatcttgcagttctgtcagagcatcaccaaccaggctcaaacaagccaccggattcggagatggagaggcagtc

SEQ ID NO: 3864 - DNA, 387 bp, Hordeum vulgare
ttttttttttttttttcttgtctatgcataactatgatgcacgcatgcatcaaatgaaataataattaaaggtgaatataagtgttaaacacgggccaataaacaaccccatctgattatttacatcttctgtaataaacctagatctttttttccagccaagcccatggacaatggaaattcgcccacatcttcaccaggagtccagggcctcgctttccgagtgatagttttgtcaggcactgctggaacttggaacagatggggacagcaggggtgtcgaccggtgcaaaattccacaataattccacatccgcgcccttcttggcatctgatttggcaccatcaggctggctctcaccggccgacgatccgcccaccatgttc

SEQ ID NO: 3865 - DNA, 315 bp, Hordeum vulgare
ttttttttttttttttttttttttcgttgtaatgccactgagcatttcaaaaaatgttgttacaccactacatcaggaggcatggacagctcctcagggttgttgttccaacagacaacagaatgtacacagggaaaaccagtaaaatctcttgttcctgctaaagttaaaaattgtcgctgttctcaacaaatgccaacaaatgcctaacaactaaccgtctatgatccttgttggtttctttacctgtcgactctatcgcgcctctcattatccgcgagtaaagcctctcgagctgcggcaccccgtagccca

SEQ ID NO: 3866 - DNA, 360 bp, Hordeum vulgare
ccgctgccaaagaatcaacagcaagagatgaaaggtctcctggtgatgtagatctgtcaaagccaacttccccagaggaggctccaaaaggatcacacccaaatggcccttcgaaaaaagctgacaaagcgccagctgaatcacccccaatactacctggttctcctcccgacccaatggagactgacaatggcgaagactctgccatgcctaccagcgatgacacgcttgaacagctggagggcgtgaagcagcgcttcatggagctgaccgtgggctacggggtgccgcagctcgagaggctttactcgcggataatgagaggcgcgatagagtcgacaggtaaagaaaccaaccagg

SEQ ID NO: 3867 - DNA, 518 bp, Hordeum vulgare
ggccgtccgtgcggaggcagacaccgccgccgctgggagtgggataaacccggccatccggaaggaggaggccaaggtggtcgacaccgtcctcgccggggagctctccaagccgctcaccccgtactgccggtgctggagatcgggaacatttccactgtgtgatggaagccatgtgaagcacaacaaagcaacgggtgataatgtgggccccttgcttgttaaaaagtagaatgagttatttttcctcaatttgtgttgagtggaataatatgtatgcgtaattggttttacgtttttttctcaaaagaaatgaagttctatgctgcagcaagccaacaaccccgttgatcaaaagagcagaattaagagagaaaataagtattatttctgctcatattacatgcatagtgtcatatgttattgataaatttttataggatgcattaaaaggagagtatactcagtatatcagtcattttttaaactcgcaagtgcgatgatacaggccagtgaca

SEQ ID NO: 3868 - DNA, 535 bp, Hordeum vulgare
  UNSURE (36): n stands for any base
ttatttgtttgagtgcatttacaaatttgtcactgngcctgtatcatcgcacttgcgagtttaaaaaatgactgatatactgagtatactctccttttaatgcatcctataaaaatttatcaataacatatgacactatgcatgtaatatgagcagaaataatacttattttctctcttaattctgctcttttgatcaacggggttgttggcttgctgcagcatagaacttcatttcttttgagaaaaaaacgtaaaaccaattacgcatacatattattccactcaacacaaattgaggaaaaataactcattctactttttaacaagcaaggggcccacattatcacccgttgctttgttgtgcttcacatggcttccatcacacagtggaaatgttcccgatctccagcaccggcagtacggggtgagcggcttggagagctccccggcgaggacggtgtcgaccaccttggcctcctccttccggatggccgggtttatcccactcccagcggcggcggtgtctgcctccg

SEQ ID NO: 3869 - DNA, 520 bp, Hordeum vulgare
gggctgagggggacgcggaaggaggaggcagccatgtcggcagcggcggggaagccgatcctgtacagcaaatggttcagctcctgctcgcaccgggttcggatcgcccttaacctcaaaggtgtggatttcgagtacggagcgaccaatcccgatgacagatccagattatgagaaaatcaaccctgttaagtatgtcccagcattagtagatggggattttgttgtttccgactcgttcgccatcattttgtatatggaagacaagtatccgcagtgtcctctcttaccccgagatctgaaaaagaaagctcttaatttgcagattgcaagcatagtgtgttcaagcatccagcctcttcagagctatgctgtcatccgttcatttcatggcacaatggacgccaacgagagcttggagatggttgaacattatattgacaaaggcttcagagcgattgagaaacttctggaaggatgtgacagtaaatatgctaccggagatgaagtccaaatggga

SEQ ID NO: 3870 - DNA, 495 bp, Hordeum vulgare
tcacatacaggaagcgcatatgataaactgcatttattcacttttacagcagccgtcaagcaaatccagggcgtcgtcgtttgcttacatgagcatctaactctgaagttacatcatagaatctcaatcgaaggttgagacatcttacaacctgttattgaaatcaccccaagatcagtcatcgaagtcctgattactttactgggacggaggagcatctggttggttcgcaggaagtgcggcttgaaatgcaggatgctcattgtaagcatcttgaagccttgccaaaatagggtactttgacatgtcgatttggaagcgtgtcacaccagcgtggatctggggcgctagaaacacatctcccatttggacttcatctccggtagcatatttactgtcacatccttccagaagtttctcaatcgctctgaagcctttgtcaatataatgttcaaccatctccaagctctcgttggcgtccattgtgccatgaaa

SEQ ID NO: 3871 - DNA, 517 bp, Hordeum vulgare
  UNSURE (23): n stands for any base
cgcagacggagctgctcaccagnacccccgcgcagagccggaccaccatcgtctacaagttcgccaccgacgacatcctccgcgagcagtaccgcgacccctggaacgaggtgcgcatcggcaagctgctcgaggacctcgacgccctcgccggcaccatcgccgtcaagcactgttcagatgacgatagcacaacaagaccccttttgttagttactgcttctgtggataagatggtcttaatgaagccacttcgtctggacactgaagtaaagattgttggggcagttacttacgttggccgctcttcgattgatatacagattgaagtgactcagattgatcgagatggtgatacacagtcagacccaattgcattgacggctaacttcacatttgttgcacgagattcagtgaccggaaaatccgctccagtgaaccgcctttcaccagaaaccgagagagagaagcagttatatgaagagacagaagcactggataaggtgaaaaaaaggaa

SEQ ID NO: 3872 - DNA, 558 bp, Hordeum vulgare
  UNSURE (17),(18): n stands for any base
gtaattgtgccgctggnngcctgccttatgtaggtatatattataatcaatggggatttagccctcacaaaaagcaaattttcgggtctcgaggttgtggggttattgtatcctactgtatgtgctccaaataatttcccaaaagaaacgccaaaagctacacttctgccggtctggttgccagcatacgcggctgatgttcaaatcatggggtacatctcccactagttaatgtggctagtaaaaagttgctaaaactgtggctggaaccagtgactctgccgaaggatcagtcgaacaaaccctccgcatccatgcggtttaatatacggcgtgcctcttcttcggttgagggaacaacattgcggatgttcagtccgttcttcagcgcgtcgctgccgactgagaaggtgaagtggaatgtgttggagatctcgctttttcggagctcaggccttgtcacatgagcgacaacttcgacatttaccaggggctgccatttattctcaagctgggtaaacaagacacatgatttgaatcgaagaaagtctccaacat

SEQ ID NO: 3873 - DNA, 516 bp, Hordeum vulgare
  UNSURE (513): n stands for any base
gagcgatcgagagtcggaggtggaggaggacgatgtccaagtcgtgcaaggggctagccatggagctcgtcaagtgcctcagcgagaccgactgcgtcaaggtgcagaagaggccgtacaaggagtgcgccggggagaaggcgcccaacatcaccagcgagtgcgtcggcctgcgggagacctacttcaactgcaaaaggggccaggttgacatgcgagcccggatacgtgggaacaaggggtattaatgttgtgcatgtgaactccctatccaactgaaacttgcagccgaattgtcactacaagccatcttgtgttttacatatactctagatctccacaggatcataatttagttggtatgtattttttcttcgccataggagacaggaaccaattcagcacacgagtagtttcggtcgatgagagggtgcatctctttattgctgcctaaccattgtcttctggagagaaaaaaaattgtttgatcataatgtatcttgtatgcaattntct

SEQ ID NO: 3874 - DNA, 545 bp, Hordeum vulgare
  UNSURE (506): n stands for any base
gctcagctggttaaagtttcaccccaatcttctttcagaggagttttagaacaaaaaaggtcatgcagctctgttccataacagaaaattgcatacaagatacattatgatcaaacaattttttttctctccagaagacaatggttaggcagcaataaagagatgcaccctctcatcgaccgaaactactcgtgtgctgaattggttcctgtctcctatggcgaagaaaaaatacataccaactaaattatgatcctgtggagatctagagtatatgtaaaacacaagatggcttgtagtgacaattcggctgcaagtttcagttggatagggagttcacatgcacaacattaataccccttgttcccacgtatccgggctcgcatgtcaacctggccccttttgcagttgaagtaggtctcccgcaggccgacgcactcgctggtgatgttgggcgccttctccccggcgcactccttgtacggcctcttctgcaccttgacgcnagtcgtctcgctgaggcacttgacgagctccatggctag

SEQ ID NO: 3875 - DNA, 641 bp, Hordeum vulgare
  UNSURE (7),(22): n stands for any base
tgaatgngttgatacaactaangcaggctggtactcggtccggaattcctcgtgtactgggggcctactgaccgcgcgcgctacaacagagcacgcacgtggcgtatcacgccgctagtccacttctgcttggctagatgttcgattcgacgtgaacatagcaataattacagcatagtgtcgaaacgactggcgttcttgttaatagaagtaagcccgagatctcttgtttgaggagtggagccttcacgtgggtagaggattcaacgtatagatgatatgagaagtgatgtagtaaattttatcatgattcatatagtaatagtaagagataaagatttgtaacaagatctattaacagtattatggtatagcgggactccctaggtgggtcacatagccgaaatacctagcagtattgtatatactatctcatctacttctgtaatgtattgttggtcaggacgtttagcgaactctagtcctcactactgaacctcggagttagataatgatcagacaaaacgtatggttagataattcgtaggtgtgtatgtaataacacctagctgttaacagctgtcggcgcagtaaaatgaaaacatagtaaaactataattaagctaactacctaacacaat

SEQ ID NO: 3876 - DNA, 422 bp, Hordeum vulgare
tgtggcctttttttttttttttttgaactctccagttttctcccgacttttatttcttcctcctctggtgtgcatggcactgcaatcgatagtactacaccgtacatgaaatgacctgaccagctagccgtggtccacatcgaattatacggtacactaatttgtactcgtaggcaccgcataaccgtacgtaggagcgatgagtcggaggctcatcagatcagagcctgccgtcggccgaggtccacctgtcgagcatggcgaggcactccttggggcggtactcgggcgcggtgtggccgccgcccttgacggtggcgaaggtgaggttgtgagcgtactccgtcgtgaacccggcgacctgccggttggcgtaccacggcctccacggcgccaccgccgggtaacccagcgtccggatc

SEQ ID NO: 3877 - DNA, 962 bp, Hordeum vulgare
  UNSURE (949)..(961): n stands for any base
ggaccccccgggctgcaggaattcggcacgaggcatcaaactccatctctggcctgatctcacgggcttcatcagagtgcccaacattcccagactgtggttttcagctggacgatagtggtgtcgtactcacctgcttggattgcttccttggcaatggctccctctactgctttgagtatggagtgccaccagcaattttccttgcaaaatttcgtgggggaacctgcaccattgcccaatccgacccatcagaggctgtggttcggagagctatgcacttgcttcaaaatgggtttggcaactacgacatattcgagaagaattgcgaggactttgcactctactgcaagactggacttgtacctgtggatgaaccaggcattggggtgagcgggcaagcatcttccgccattggcgtgccactggcagctcttctgtccaccccattcaagattttcgctgccggtccgctgggaatggccaccgtcacagccgggatgtactgtgccggtagatacatcaccgacataggagtaagaaaggatgtggccaaaggggaggtggaaaacctgccatcgcacctcggtttccgccgtgcggaagatgcggaatcggtgaacagaagctcagacaaggtgacgaagctggtcccgttgaaagaaagcgtgagaggtgagcttggcggtacagttggggggagtatgaacctccctgcgcttcgcggcgataggttggtgcagacctgtggataatatcgaatctatgcttcagtatattataaagctgaatatatagataatatgtgagctgtggaacgtgctctcatggttgagtgcgcacttcacatgatgaaactgactactctttacccgggttggggtgaatgatatcacaagctgggttcagtaaaaaaaaaaaaaaactcaggggggccggccatcagggnnnnnnnnnnnnna

SEQ ID NO: 3878 - DNA, 534 bp, Hordeum vulgare
  UNSURE (24): n stands for any base
tttcattcacacaaccagttcagnaggtagttcagttcatcatgtgaagtgcgcactcaacatgagagcacgtttcacagctacattattatctatatatatcaagcttataatatactgaagcatagattcgatattatccacaggtctgcaccaactatcgccgacgaagcgcagggaggttcatactcccccaaactgtaccgccaagctcacctctcacgctttctcttcaacgggagcagcttcgtcaccttgtctgagcttctgttcaccgattccgcatcttccgcacggcggaaaccgaggtgcgatggcaggttttccacctccactttggccacatcctttcttactcctatgtcggtgatgtatctaccggcacagtacatcccggctgtgacggtggccattcccagcggaccggcagcgaaaatcttgaatggggtggacagaagagctgccagtggcacgccaatggcggaagatgcttgcccgctcaccccaatgcctggttcatccacaggtacaagt

SEQ ID NO: 3879 - DNA, 349 bp, Hordeum vulgare
cggcgctggccgcggcgtccatggtgttccgcgacggcgacagggagtacgccgagctgctgctcgagagcgccaagaaggcgttcgacttcgccgacacgcacaggggcgcctacagcgacgacatggatctcagagccggcggctgccccttctactgcgacttcaacggataccaggatgagctgctgtggggtgcggcatggctacggagggcctctggcgacgacaccttcagggagtacatccagaataacggcaagaccctaggggcagaggacagcatcaacgagttcgggtgggacaacaagcatgccggcctcaatgtccttatttccaaggagttcat

SEQ ID NO: 3880 - DNA, 551 bp, Hordeum vulgare
  UNSURE (29): n stands for any base
tataaatttgatacaacttaaaaaggttntatcttttaaaaaaataatacaccatatattatgaaatggagtgggtaaagaaatttaaaaatcctaacaaattctacggcgcaacaaagcgcaagctttcttcactcatggctacacctctccagttaaattgcactttgcacacatccacacaaaatctggtgcaaacccaaaacaaaagaaaaatcatgaaaggtaagctctcattattggtagaacccatgctctgcaatccgctcctatgaacatgtagtgcatctaaacacaaacctatttgtttccttcctttgtacctatttatagcttctgtcactcttttctatctacatggcaaagtgcttctgctcaatgtctgatatggccagggtttgggttgccaacgaagtaggcaagaacccctaccaggggagcattgatgtaggtagtcggttcagatttcctgtaatcagcacggtcgtccccataagaatcatcctcccctggcccgccaacaatggcgccgaccaacgggttagggttcg

SEQ ID NO: 3881 - DNA, 551 bp, Hordeum vulgare
gtccctccgggcctgcagggaattcggcacgaggcgatgtgtgcgagagcgcggtggcggtgctcttctgcgcggccgacgaggccgccctctgccgtccctgcgacgagaaggtacatatgtgtaacaagcttgctagtcggcatgtaagggttgggcttgcggaccctaataaattagtacgctgtgatatatgtgaaagttctcctgctttcttctactgtgacatagatggtacatcactttgcctgagttgtgatatggctgttcatgttggtgggaaacgaacccatggaagatatttgctcctaagacaacgagttgaatttccaggagataaaccagggcatatggacgatgtagccatgcagcaggtggagcctgaaaacccaagggaccaaaataatgctcattcagtagcaaaggagcaaatggtgaaccaccatcacaatgcctatgatccggcctcagatggcaattgcaacggccagggtgccattgattcaaaaatgtttgatcttaatatgaggccagctcgtaataatgggcaa

SEQ ID NO: 3882 - DNA, 546 bp, Hordeum vulgare
  UNSURE (95),(96): n stands for any base
gaagaatctattatttctttgtacatgttcctgatagcatacaacagaaatccgcacacagcgtctagcgcatgccatgctgaatccagatacanngtcgttagcttccattctcttattcgaaaacaacacacactctaaggtccgtgcaacgatacatttagcccggccactaaggctaaagctaattcaagctcccggtgcggaagaaacgtttataacagcaaccgaagcaatttacatttccgagattccaatgtttacttgtcgccagctccatcataattgcatgttggcaccactcctgaagagtcatggtggttgttttggctatgatccactccatgagtctgggaacttgaaccttgcccattattacgagctggcctcatattaagatcaaacatttttgaatcaatggcaccctggccgttgcaattgccatctgaggccggatcataggcattgtgatggtggttcaccatttgctcctttgctactgaatgagcattattttggtcccttgggttttcaggctccacctgc

SEQ ID NO: 3883 - DNA, 515 bp, Hordeum vulgare
cctgatcgatcgatttcctcccctgtcgggatccaggttggttaatcgcctctcccgaatctgagatgggcgagccgattggtttctttctgttcaggttatccccctccatccctctcgcaaacagttctcttttttttcctccgtgcgtttgggtgatggatggatctcttttttggtggcatgcgtataaactgcatgagatgcagattggtgcaatgatgagggggcgtgactgcatgcttgtgcatgcagccgcacacacatcgcagcttcttctcattggggatctctccctcctctctttccctctgcaattattagcctgtgatgggggaaaagtagtcatcattactgtatttctttctaggccctttaccttggtttcgatgcatgtctgaacttgtaacgctttcgatgttttcatgccttaattaagattcattacatgtttgcacaccttaatttgttggtcaagtttacatgtttaatttcccaattgatgagaaattagc

SEQ ID NO: 3884 - DNA, 551 bp, Hordeum vulgare
  UNSURE (11): n stands for any base
ggcgtatgtangccactaatatattagtaatgtgctagtacataacaagggaatctttaggagtttgggggcattggaaacaccattatgtgcaacacatatgcagcagctgatcaaggtatgagcatctcgacgcaaacaactaatatagggcgcatagtacacttcccaaccttccagctagagttcaaaggcttgaacagcaaacaaactcagagcaaacaacaaggctgcaccaacatcaatgcatgcgttggtgtgctaaaacaaaagacttgaatacttttaactattccacgcagtaggagtacacttctgggtgagttggtctgacatgcatatgctccaatcaatacaggtttcccaaaaaattcaaccgatggagcggtacctttccggagtagcactgcatttcatgttcaagtggatgaataactgggccagttctgaatcgacattagtatcagcctagctggcagctcatgaaagaacttgtcttttgccggccaggaacatcaaggatatccatcttgtataactgagtgaaataa

SEQ ID NO: 3885 - DNA, 525 bp, Hordeum vulgare
  UNSURE (18): n stands for any base
gcacggggtcatgcaggnagcagctcgcgacattcagtcgcagctcgaagaattcgctcgcaagcataagagtgacatccgtaaaaattcggtatttagacagcagtttcatgaaatgtgtgcaaaagttggagtagatccactggcatctaataaaggagtttgggcagagctcctagggattggtgacttctactatgaattgggtgttcagatcgttgacatatgcatagcgaccagatcgcataatggtggtcttattgacttgctagaactccgcaaacttctctgccagaaaagaaaaactgatcttgggtcattatcgtcagatgactgtttacgtgctataagtaagctcaaggtccttggtagtggttttgaagtattttctgttgggaagaaaaagcttgtgcgatcggttcctactgagttaaataaagaccataatgggatacttgaactagctcaggctaaaggctatgtcaccgtagaacaagttgagaaggagttctcatggtcaactgg

SEQ ID NO: 3886 - DNA, 550 bp, Hordeum vulgare
acaacagaattctgaagcaagaatggcacacaatttacatttgcaggtactccgggtaatgttgtttccctacttcttacacaggaagtactagtgagccaaaaatataactgctccagtagcacaggtggttccagctctcatgaagacaaggggaaaagaaaatacaacagtacaggtacatcatgactttgcttcagaaacggaggcatcggagctgagggtgacacacgggaaccagtatctacgcttgccatccctgtgtccgtcgtcgatcatagcaagtccctcctttagcaaggtttcaagggcatcaattgcacggccagttgaccatgagaactccttctcaacttgttctacggtgacatagcctttagcctgagctagttcaagtatcccattatggtctttatttaactcagtaggaaccgatcgcacaagctttttcttcccaacagaaaatacttcaaaaccactaccaaggaccttgagcttacttatagcacgtaaacagtcatctgacgataatgacccaagatcagttttt

SEQ ID NO: 3887 - DNA, 552 bp, Hordeum vulgare
gtccccccgggcctgcaggcaattcggcacgagggcggctgcggctgcttccggtaacggtgtacaagggggcgaccgtcccgaggacccttcaaagcagaacctggcgcaggtcacggcctcgatccagaggaccctgggcctgctccaccagctcaacctcaacgtctcctccttcagctccgcgtcccagctccccctcctccagcgcctgaacgcgctcgtggcggagcttgacacgatgcagaagctcgcggacgggtgcaacatccaggtgcccatggaggtcgtcaatttgatcgatgacgggaagaaccccgatgagttcaccagggacgtgctcaacagttgcatcgccaagaaccagatcaccaagggaaagaccgatgctttcaagagtctgaggaagcatcttctagaggagcttgaagaggcttttcctgaagacatcgaagcatacaggcagatacgtgctacttctgccgctgaatcaaagcggttggctcagtcgcaaagtgttttgcctaatggagattccaaagtaaaagctga

SEQ ID NO: 3888 - DNA, 553 bp, Hordeum vulgare
  UNSURE (23),(32): n stands for any base
gtaggcccatgatgagcaatganttaccgagnccatacacgatgatgagctcatcagcagattaacgtactactagttgattgcaagtagcgccataacccatttataaagaggtaccctaattaccaatattggctgatgatggctgcatagacagccagaaacacaacaaatctagccgagtaggtggtacatcacgaggcaattgactacaacaactgggaagttgaatatattatataatacagatgtatactattgatcactcctataaaaggccagcgcatacaaggatatgtcgataatatgtagcagttgtttgttcccaaggccttcctcaaactgtaagcataggagagatgcagagcttcttgctcttcacggcttgggtccttatgtcagttagtgctcagcttttactttggaatctccattaggcaaaacactttgcgactgagccaaccgctttgattcagcggcagaagtagcacgtatctgcctgtatgcttcgatgtcttcaggaaaagcctcttcaagctcctctagaagatgc

SEQ ID NO: 3889 - DNA, 485 bp, Hordeum vulgare
gccggatccagcggcgcggcgggcggagggccgtctatcccggcgccgctgaggaaggggaagtcgtgcaagggctgcctgtactactcgtcggtgctcaaatcccggggatacaaccccatctgcgtggggatccctcgctccatcccccaagtcccgggcttcgtggtggaagagcctagggaggaggtcgcggcgcaggggcatgatctgagacagttcaaatacgcctgcgccggttactccatgttcgtcgacagcagaatggttgagagaaaatcacccgctgtagagcatgcttcaacacgtaatccgaaaccgaaggaagctgctgctgctgctgccgccgccacccagcctcaggagcaaggacagcgaccacagctggcgagacaggaattcatggcgaggttcaggaggagcgccgggctggtcgcgtccggagtcgccaagaacctcaacaaaactggctcctacatcaagca

SEQ ID NO: 3890 - DNA, 550 bp, Hordeum vulgare
tcaaaaaggaccttttgagctgaaacaacaccttggacacatattagtattattcagcaaccacccaacgaccggatcacgtttctcctccaacggagaagaaacgccccatcccgtttctcatttacataatcggaccccgatgtttccataaatggcagaaatcaagcaagtatacagcaaaaggaattcattcagtaccacgccccaggaaatcgcccccatgcatttttcccttgacgcctatggcagggttcttcagcttcccggctcggaaatggacagccgaccccgctcaccgctgctactgcttgggtggccgtcggtccggcgaaaatatgtcctccacgttttgcttgatgtaggagccagttttgttgaggttcttggcgactccggacgcgaccagcccggcgctcctcctgaacctcgccatgaattcctgtctcgccagctgtggtcgctgtccttgctcctgaggctgggtggcggcggcagcagcagcagcagcttccttcggtttcggattacgtgttgaagcatgctctac

SEQ ID NO: 3891 - DNA, 441 bp, Hordeum vulgare
aaaaagccacccccggatttcaactccactccactctgaaccacgaccctccgccagcatggctcgcctcggcctcctgcgctttcttccgtcgcagccgatgctcctcctcgtcctcttcgtcgcggcggacgccgccgggaagggcgacggcgggctgcggttccggcgggaggacggcacgtttaaggtgctgcaggtggcggacatgcactacgcagacgggctgagcacaccgtgcaaggacgtgctccccgcgcagcgccccggctgctccgacctcaacaccaccgccttcctctaccgcgtcatccgcgccgagaaccccgacctcgtcgtcttcaccggtgataacatttttgcttcggattcaaccgatgcggccaaatcgatggatgcggcgatcgctccggccattgccatgaaacttccctgggctgc

SEQ ID NO: 3892 - DNA, 353 bp, Hordeum vulgare
tttttttttttttttttttttacgcagttacgaattctttgagataagctgagcatcaacaacagataggcagtacagaggttaattatcctcgtgaactcagcttccatcattgttcttcttacgcctccctgtctaccggcatgtcttacataagttgtaggttctgaaaatatatgcttgttactgaagctagaaatagcagcgccatgctcttgcatagttgagtacctccactattagaacttatgttccataggttctcagagtcaattgtggtgagatgttgatcatcaagcctcttccatgtgttgatagacttcacgccttgccattcgccgctcgctgccttc

SEQ ID NO: 3893 - DNA, 527 bp, Hordeum vulgare
tcacgaggcaactgcaggcctgtatcctcttttggtaacgctggtgatgcccagccatgcagcacctcagcaacacatgtagatccagcaaacaagaatggaaattgggcggctccttctcaagacaagacacacacaacttgccatcctatcagagttgtaccacttcccgctcctgttggaggcctcactttttatgggcagccattctggagcggtgcacctgtggcaccccttctttatccacagtcaggtcctcctatttggaatagcagaactccagtgtcgcaaaaggcggacacacaggcaacttcatcgcagcagaagtgtcaacagaatgatccaacagagatggactgccagcagactgaaagcacacagctgcaagaagttctacctccacctattgcaaatgaaaagcacctgcacgttgaaatcccctcagacagcaacactcagcaggtttcacctatgaccggtgaaagcggaagcagtactgtgctgaacaactctggcaacagcaatgc

SEQ ID NO: 3894 - DNA, 548 bp, Hordeum vulgare
  UNSURE (16): n stands for any base
ttttgatgtaatcctntatagtacggaaggacgacatcattttgctgaggcagtgaactaaactgcagcaacgatgtttcagttcgagaaagcacacaaaagtatgtcttaggacatccttgactgacacctttgcaaccacacaagagtgcaacaacgtatacggcaaacatgtaccgagtcaggtagtatgttctctagccgcctactgacaaactctactatgtacgagctaatctacgacaagttagcgtatacaataacaacagacttaagcatacaagaaagaaaggtcgataattctgatgtagttatctccactctttcaaaggacacaccaaatcggcgcagcaaggcgaacggttgttgcctgcaggtgacatctagctgcttccttgaacgctctgatcttgccgaacaaactgacccttcacccggggacgctgctctgcaagtagtttcctgctctggtaccgcaccttcttctcgaagcaccgttctttccgtttgagccgaaacttgttcagggcaatctcacgttggctcag

SEQ ID NO: 3895 - DNA, 518 bp, Hordeum vulgare
cggtggtggtcctcgtcttcctcttcgtcgtcgcgccgtcgatcttcttcgtcgcgcgcagcggcggccacgtccacgtcgcgtccgatcccaggggtgctgatggcaaccaggaaacagattggcaagagcaactggcgacagacaatctgaaatctgttttgtctaaggaggtaattgatgctatagctgctagtcaacaagaaacaggcactctgaaccttgacttctttagggatcatccatctccttcctggaaaactgatgatctagttgatcacaagatgaatgctaatttggttgttgacgacaaggcaaaagctcaaaacagttccgcagaccatgttatacctctaacacataaagcacccaaggatggttcagatggacatcaagttgatacagcagcaaaaatggctcgaaggaaactacgggaggcgaggcgggaaaagagggcaattgatttggtacggaaagatgacgaagcacttgttaagctggagaatgcagctattgag

SEQ ID NO: 3896 - DNA, 556 bp, Hordeum vulgare
  UNSURE (16),(25)..(27): n stands for any base
ttaactactaccgatnacatcagcnnnagataatgtacattcttacaattaccatcactccagaaattctactattagtagccctaagcaacacgttaacacaccaaccacaggcacacattcaacaggtttaccatgattttgttggccaaacaaatttagctgcacatcaattgaacaaaggaactgttacggcgtcattcatgagagcgtccatcagaaattttcagggcgcaggcgattgatagctccagctgatactacttccctcaatctacataccttaaggagaaaggggacacttctgtttcagacgggtgaccttctccggcccgcttcatatctcatctactcactcaggttgcatccacggatgtaagggtggtcatactttatataccttgtccagtatggtcggtacttggtcattgccagctccagccatggcttcatgttcccattgtaatgagcgacagcagcattgtctatctctgagcggtcgatgcttgggttgtatcctagtccaaggacatgccacgatttatcaagggggtgc

SEQ ID NO: 3897 - DNA, 518 bp, Hordeum vulgare
cggatattgcgccgttgatggtgaaagaggggcccaaagactattggtctacgagtatatgcccaataagagcttggaagatcacctgttcagccgaattaatcctcctctctcgtggaatagaaggcttcagattatcttgggtgccgctgaaggattggcttacctgcatgaagggcttgaacttcaggtgatctaccgggacttcaaagcgtcgaacgtgctgctggacaaggacttccaagcaaagctatcagacttcgggctcgcgagggaggggccaacagaagggaacactcacgtctcaactgcggctgtgggaacgcacgggtacgcggcgccggaatacatcgagagggggcacctgacggcgaagagcgacgtgtggagcttcggggtggtgctgtacgagatcctgacggggcggcggtccctggacaggaaccggccgcagggggagcagaagctcattgagtgggtgccccagttcccgccggacagccgcaacttccgcatga

SEQ ID NO: 3898 - DNA, 537 bp, Hordeum vulgare
ggtaaagtttgctactcctattcaagttgggctggttaatttgcatgcccagtaactgattcttcactcaaatgagcctccaaagaagagggaaaacactatcaacaatccgacaactcaaatcatcatctaaactcacgttcgcatagcttctatacgccaacctcccctaaaaggagttaaggagggagaaggagttctccatggcaacatatatcagtcacctcctcgacggcggtgccacgttcactcgtttcccgttgccggcgctgggtgccttgtccacagaggctacctcggtctgcacggctcgcctgagaacctcgacgatctcgctcatggcgggccgttccttggggttcttgaggaggcagctctgggcgagcttggcgatctcccgggccgccttggaggagtactcaccacggagcttggggtccatgatcatgcggaagttgcggctgtccggcgggaactggggcacccactcaatgagcttctgctccccctgcggccggttcctgtccagggaccgcc

SEQ ID NO: 3899 - DNA, 1029 bp, Hordeum vulgare
  UNSURE (1),(25),(39),(45),(56),(65),(77)..(84),(113)..(144),(150)..(155),(168),(181)..(228),(230),(235),(246)..(256),(258),(259),(261),(263),(296)..(303),(305),(307),(308),(355),(356),(359),(361),(366),(368),(369),(371),(372),(377),(378),(384),(387),(425),(433),(434),(440),(450),(456)..(458),(460),(461),(466),(471),(472),(479),(491),(492),(496),(497),(546),(547),(554),(562),(578),(579),(602),(605),(615),(620),(644),(655),(656),(658),(659),(665),(718),(728)..(730),(738),(750),(751),(759),(760),(783),(787),(795),(797),(806),(807),(810),(811),(820),(825)..(827),(831),(833),(836),(844),(860),(869),(875),(877),(883),(885)..(887),(894),(898),(902)..(904),(906),(908),(909),(911),(912),(914),(919),(920),(929),(931)..(933),(965),(966),(970),(971),(987),(994),(997),(999)..(1002),(1006),(1007),(1014): n stands for any base
nttggcagcctggctctggagttcnagtgctgggggcanaaatanggctctgaganaaactcggnagccccccaaannnnnnnnttggggtttgggggggccccccaaacccnnnnnnnnnnnnnnnnnnnnnnnnnnnnnnnntttttnnnnnnggggggggccccnccccaaaaaaaannnnnnnnnnnnnnnnnnnnnnnnnnnnnnnnnnnnnnnnnnnnnnnnanaaaanttttttttaannnnnnnnnnnannananaaaaataaaaaaaaatttttttttttttaaaannnnnnnnanannaaaaaaaaaaaaaaagggggggggggggaaaaaaacccccccccccnnggngnggggngnngnnggggnngggggnggnggggggggggggggggaaaaaaaaaaaaaaaaaaaagngggggggnngggggngggggggggngggggnnngnnggggnggggnnggggggngggggggggggnngggnnggggggggggggggggggggggggggggggggggggggggggggggggnnggggggngggggggngggggggggggggggnnggggggggggggggggggggggnggngggggggggnggggngggggggggggggggggggggggnggggggggggnngnngggggnggggggggggggggggggggggggggggggggggggggggggggggggggggngggggggggnnngggggggngggggggggggnngggggggnnggggggggggggggggggggggngggngggggggngnggggggggnnggnnggggggggnggggnnngggngnggnggggaggngggggggggggggggnggggggggngggggngngggggngnnnggggggngggngggnnngngnngnngngggannggggggggngnnngggggggggggccggggggggggggggggggnngggnngggggggggggggggngggggtnggngnnnnaggnnagggggnaagaggaggggggag

SEQ ID NO: 3900 - DNA, 550 bp, Hordeum vulgare
  UNSURE (82): n stands for any base
cgcaggaaagcctatcttatatcttagcttcgttccgaatccgacaggtccatgcacataaaattaggcgggggatatacantggcccggtcaagtgctcacaacaactctccgacaaatctaatttcaaaagttatgtgacgagaaaaggaaggaagaaagagcgagagagcgagagaaacgaagaaatggctgcgactcggctcctatggtgtgcacaggttcttcaggtcttcctccttggcgtacgagttcgggatgagcctcgcagcgtaggggtacaggtccttgtacgaattcctgatggtgccttctgccactccggtggccaaggagatatctttaagcggctttttgtcctctgaaagctgggttatcatataaatgacagcagccgcaattgaaatagggctcctccttatatcaagctcctctgagcgctgaactgcctcctgagctgctttaacagcagtattgttcataccaagagttgagcagaaacgcctcaggaaatctccagcatggatggttcccatctccatagattggc

SEQ ID NO: 3901 - DNA, 518 bp, Hordeum vulgare
cggacgcgagcctttctcctcttccttcttctggcgattagggttgcccccagcgccgccggccagctgctggtcgtccctgccggcgcagcgccggccgcctccatccccccatacacctccgtcgccagagcctgtccgctccgctgccacccctcatcccgaggacttcctgctagccgccgccggcaagaaagcccgaggaccaccacctgttcgcgaccaggccactgtcgcctcctcgtcccctgtttcgctgctgctaccgcctctctgtcatctgcttcagcagctgcagatccaccccggcatcatgtcttcagaggagctcacaacaaggatgctagatttggcggtggcttcgcaggccccgatggccagccaaatcagttcttcaggtgatctgtcttctgaaggcggggcgcaggtcacctgtttcagtgaggacctgcacgacgtcacgctccatttccagatcataaggatgtctaaacagatctatgcatggataggatgca

SEQ ID NO: 3902 - DNA, 542 bp, Hordeum vulgare
aaaagacacgcaagatcatttatttctgtgagcacaatacctcaatgtagggttccacaagcgaggcactgaaatagtcaatcgctcaaagatcctgtgaacatacacaaacgtataaaacatgccagaagtgatacttgccacatgtttgataattctgtgaacatgaagcagttccaagtcgttcacaaaaatttcagatcatcatgccctacactcagtaagcccccgctgagctttcataaccattagaaatgtttcgaatacataagagtggtgactttctctacgagtgacttgacagttcacaagtatccatcagcatgttgtggaagcgttagcctctactggtttggatctgatatagcctaaacttctcagcttctctacaagtttcctctctgcagcagcctcaagcatggggctgtctttcggaatgttacaagctaaaattatatttagacctgtcttcagcactaagcggcgggccatgcttgatccagtgttatcagatgttcctccaagtacagatgtgacactca

SEQ ID NO: 3903 - DNA, 517 bp, Hordeum vulgare
gccacaaccagcagggaacagcctccgtcaatccgccgcgcgcctccgtctcgctgtagccgtgtcaactgccggccggccgacagcgctgctcccgaccagctgcccagcggaaacatgatcgtctgcgtcgccgtcgtcggccaccagaacaacccgctgtacctccagagcttcacggaggcggacgacgccctcaagctccaccacgtcgtccactgctccctcgacgtcatcgacgagcgagtgaacaatcctaaaaggagcgcacctacactgaacgagacatttttgggtcttctatatcctaccgagaactacaaagtgtatggctatttgacaaacacaaaggtcaaatttttaatggttacaactgatcttgatgtgaaagatgcggatgcccgaaattttttcaggaagttccatgctgcatacgtggatgccgtctcgaaccctttccacgtccctgggaagaagatcgcgtcgagaagcttcggcgcgagagtgagcaccatag

SEQ ID NO: 3904 - DNA, 545 bp, Hordeum vulgare
  UNSURE (16),(48): n stands for any base
taacaggcacttatanttcttccttgagccatcaaactatttcttgtntaacatacaactgagatacatactggaggtatagataggttgccggttatggggaaaagcacaggacggttggttttaaccgacagtccctgagccaaaggatttcactatggtgctcactctcgcgccgaagcttctcgacgcgatcttcttcccagggacgtggaaagggttcgagacggcatccacgtatgcagcatggaacttcctgaaaaaatttcgggcatccgcatctttcacatcaagatcagttgtaaccattaaaaatttgacctttgtgtttgtcaaatagccatacactttgtagttctcggtaggatatagaagacccaaaaatgtctcgttcagtgtaggtgcgctccttttaggattgttcactcgctcgtcgatgacgtcgagggagcagtggacgacgtggtggagcttgagggcgtcgtccgcctccgtgaagctctggaggtacagcgggttgttctggtggccgacgacggcgacgc

SEQ ID NO: 3905 - DNA, 427 bp, Hordeum vulgare
atccctcctgctgccgctgccgctgtgttgtcccgttgccgcccccccgccgcctccaccgccgcctccaccgcccaccgcgccggcctctccccctgtcccgtctcccccatggcctccgccgcggcgtccgccgtctccttcgccaggcccgtcaaggcaatctgtgtcaactcggtctccttctctgctctaaggaaagacaatgtatccttccgtttgcagccagttccccagagattttctgtttgctgtgcagccaaaaaggagacagtagagaaggtttgtgatattgtgaagagccagcttgcgctgtctgatgacactgaagtttctggctcctccacatttgctgatcttggtgccgattctttggatacggttgagattgttatgggcctcgaggaggcttttggaatcagcgtgg

SEQ ID NO: 3906 - DNA, 311 bp, Hordeum vulgare
ttttttttttttttttccaccttcaacaaaaaataattccttgaacaataacttaaatgtcatgaataatatcgcaagacaggcaaaaacactgatacatatgtcaccaactctccacggtaaaatctagcacgtcaaaagggatccatccagcagcaaccattgcagtggtcaagcagcagccgtttaagctcctgccgcattattgccatgaattgagtttactttccaacaaggctgtcgatcaggttggcggcgtcttccaccgttgcgatggtctgagcgctcgattcctccacgctgattccaaa

SEQ ID NO: 3907 - DNA, 313 bp, Hordeum vulgare
accaccaacgaccaccagcgcctcctactgtcactgccagcctcagctcactcgaagcaaggctagctagctagcacgcagcgagcgatggcggccgcggcgaccatggcgctctcctccccggcgatggccggcaccccggtgaaggcctccagggcggcgtccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccg

SEQ ID NO: 3908 - DNA, 338 bp, Hordeum vulgare
tttttttttttttttttcagagagcttctgtatttgacattcagaggttgagagaaacaagtaattaagcggaagaagaaagatgccttgattaatctgaaaaataaccagatattacacaaacaccatctttttagtgtacacacaccaactcatcatctcgactcgccctcacatgcaaaatctatcagtccggaaagacatgcagcacagcagcatccatcagcaatgaagttgtcggccaagcgcgcgcgcgcgcgctagaggttgagctgactgagctcacttgccgggaacgaagttggtggcgaaagcccaggcgttgttgttgacggggt

SEQ ID NO: 3909 - DNA, 486 bp, Hordeum vulgare
  UNSURE (486): n stands for any base
gctcggcgcgctcggctgcgtcttccccgagctcaggtgaaggagatcaagaacggccggctcgccatgttctccatgtttggcttcttcgtccaggccatcgtcaccggcaagggccccctcgagaacctcgccgaccacctcgccgaccccgtcaacaacaacgcctgggccttcgccaccaacttcgtccccggcaagtgagctcaacctctagcgcgcgcgcgcgcgcgcgcgcttggccgacaacttcattgctgatggatgctgctgtgctgcatgtctttccggactgatagatgttgcatgtgagggcgagtcgagatgatgagttggtgtgtgtacactaaaaagatggtgtttgtgtaatatctggttatttttcagattaaccaaggcatctttcttcttccgcttaactacatggtttctccgaacctctgaatgtcaaatacataacttctctgaaaaaaaaaaaaaaaaaan

SEQ ID NO: 3910 - DNA, 465 bp, Hordeum vulgare
  UNSURE (73): n stands for any base
gggtagtttgtatttgacattcagaggttcggagaaacctgtagttaagcggaagaagaaagatgccttggtntaatctgaaaaataaccagatattacacaaacaccatctttttagtgtacacacaccaactcatcatctcgactcgccctcacatgcaacatctatcagtccggaaagacatgcagcacagcagcatccatcagcaatgaagttgtcggccaagcgcgcgcgcgcgcgcgcgcgctagaggttgagctcacttgccggggacgaagttggtggcgaaggcccaggcgttgttgttgacggggtcggcgaggtggtcggcgaggttctcgagggggcccttgccggtgacgatggcctggacgaagaagccaaacatggagaacatggcgagccggccgttcttgatctccttcaccttgagctcggggaagacgcagccgagcgcgccgagc

SEQ ID NO: 3911 - DNA, 439 bp, Hordeum vulgare
ggcctgcagggaattcggcacgagggctctgaataagagcagcaaaaatggacaggaagagggtgggaatcgttggtgctggtgtgagcggcctagcagcctgcaagcacgcgttagacaaggggttcagcccggtggtattcgaggccgatgacaccatcggaggagtgtgggcgcataccttggagtcaacgaggcttcaggcgccaacgacatcgttccggttctcggacctggcgtggccggcgggcgtgaccgcgacgtacccaggccaccgtcaagtcatggagtacctcaggttgtatgcacgtgagtttgacctcttaaagtgtatcaagttcaatagccaggtgcttggagttgaatactttggtgcaaacgaggaagagattatggggtgggagcattggtctggtgatgacgggaaggcgttcagagt

SEQ ID NO: 3912 - DNA, 519 bp, Hordeum vulgare
gttaggtagcagctcttttgtcttattcttttgctatgagtacacaagtgacagatatgctactgtcttcaggaaaggcctgcataatcagcaggtccatatggctggaaccattcagcgaggaatcctttctttcttctaggattgcatccgatatcttggcacaacaaatcattaaaccaaatattcacagtgcttaaacaagatcgtctaaaatactttccattgtaaagattcttgtactttgcccactctgctacactcccttccatgcgtcttatgcttggcaactggaagccaccagccaggaaatggattacccaattagctatcctctctgagacatatatgtcggtaaggctctcggaatatccgactattgccaactgtatagtggaaccgatgtatctgatgatcctgccactatatttctgcaccagtttgctgtgaagatgtccctgagcttctggtctcctttgaatcctgttgctagaattacgatatcactctttatgcttt

SEQ ID NO: 3913 - DNA, 443 bp, Hordeum vulgare
gagaagagtcgggccgcggcaagggaggcaaggggctcggcaagggcggcgccaagcgccaccggaaggtgctccgggacaacatccagggcatcaccaagccggccatccgtcgtctcgcgcgcaggggcggcgtgaagcgcatctcggggctcatctacgaggagacccggggcgtgctcaagatcttcctcgagaacgtcatccgcgacgcagtcacctacaccgagcacgcccgccgcaagaccgtcaccgccatggacgtcgtctacacactcaagcgccagggacgcaccctctacggcttcggaggctaggccgtcaaccagatttagattgttctagggtcgactggtcgttgatgtaaccgcagcatctcgctgttgtttgctgtcttttgtggaatcgaatggactgcaatggaaatttaactagttcgttgt

SEQ ID NO: 3914 - DNA, 485 bp, Hordeum vulgare
tcgttaaatttcacttgcagtccattcgattcccaaaagacagcaaacaacagcgagatgctgcggttacatcaacgaccagtcgaccctagaacaatctaaatctggttgacggcctagcctccgaagccgtagagggtgcgtccctggcgcttgagtgtgtagacgacgtccatggcggtgacggtcttgcggcgggcgtgctcggtgtaggtgactgcgtcgcggatgacgttctcgaggaagatcttgagcacgccccgggtctcctcgtagatgagccccgagatgcgcttcacgccgcccctgcgcgcgagacgacggatggccggcttggtgatgccctggatgttgtcccggagcaccttccggtggcgcttggcgccgcccttgccgagccccttgcctcccttgccgcggcccgacatcttctcgcttctctctccggtgaggttgactttgtctttgtgaggtggttgctgcgg

SEQ ID NO: 3915 - DNA, 523 bp, Hordeum vulgare
gaagaatgcagaggttgcacttgacgctctttaatatgccttaacatcaacggttgggagatgatgatttctattgggtttttgtctgcaataggagtacgcgttgcaaatgagctcggagctggaagtgcaagaagggccaagttcgccatcataaatgtcgtcgccacttctttctcaataggccttgtgttcttcatgtttttcctattcttccgcggaaagctttcctacatatttaccaccagtgaagaggtagctgccgcagttgctagcctgtcgcctcttctagccttctccatcttgttgaacagtgttcaaccagtgctatcaggtgttgctatcggtgcgggttggcaaagtatagtggcctatgtcaacatcacaacttattacttgattggtatccctgttggagcaatccttggttatgtttttggatatcatgtgaagggcgtttgggttggcatgctactcggaacactgatccaaacaattgtacttgtgttcataacaattagga

SEQ ID NO: 3916 - DNA, 551 bp, Hordeum vulgare
gttgcaacaaaattcttgttcacccggcacacagattcaaggctattttacatgctggggcagtggtagatcaattgtcccttgagtaacatgttttcctttctctaatggagcctgcatcactgttatcatttgctcgatcttcaggaacaaccttcgacgcacctacgcctactaatgttccatccattcattcttgacatattgaaagaattgtagttatcctctgaaacgccactaactctgatcaagtaggacatacaagtttcttctatcttgatggcgattcattactcgtgccagattcttagtctcaaggacttccctttgaatccggtttccctttgttcccatccgtgatgtaccatctcttcaatttctcctgagtaacctctacctgtttatcccagtcagtcctaattgttatgaacacaagtacaattgtttggatcagtgttccgagtagcatgccaacccaaacgcccttcacatgatatccaaaaacataaccaaggattgctccaacagggataccaatcaagtaataagtt

SEQ ID NO: 3917 - DNA, 487 bp, Hordeum vulgare
  UNSURE (10): n stands for any base
gctctaccanatggcgaagagatagcggtgaagagattatccaagagctcgacgcagggggtggaggagctcaagaacgagctcgccctcgtcgcaaagctcaagcacaagaatctcgtcaggcttgtcggtgtgtgcctggagcagcaggagcgactgctcgtctacgagttcgtccccaaccggagcctcgaccagatcctattcgacactgagaaaggggagcagcttgactggggaattaggcacaggatcatacgcgggatcgctcgaggcctgcagtacctccacgaagactcccagctcaaggtcgtccatcgtgatctcaaagccagcaacgtccttcttgacgccgacatgaaccccaagatctcggactttggcctcgcgaggctcttcgggagaggccagacgcagggcgtcaccaaccgtgtcattggcacatacggatacatggcgccggagtacttgatgcgcgggaactact

SEQ ID NO: 3918 - DNA, 351 bp, Hordeum vulgare
gtgtaaaatgtagacgttggctttgacggtgcaccgagagacaccgtgtcgcttccaagcatcatgcccaccgcagacatcatcggcctatccaccgggttctcctggacgcacaacagccctatctggacgcacctcctcgcgtcgctctctaagaatttttttttcatacacgggtccatcatctccaacaccgttcggtgcgaccaatgctcccacaccatggtcaagagatcttgagattgcaaagtgtcactgttcttccttcctgtaacgatatacagaaccattactccgaagctgaacacatccgatttcacggagtagtttccgcgcatcaagtactccggc

SEQ ID NO: 3919 - DNA, 441 bp, Hordeum vulgare
  UNSURE (399): n stands for any base
accgcgcctccagccctccccactcacctcgtcgccgccggtcctcccccttcgcctcgtcgccgccggcgaccccccctcgcctcgttgcctccggcgccccccccctcgcctcgtcgccgcccgcggccagccatggacgttgcccccggcgaagaccccccagcagacccctccggtatgtattaccgcagaaaaaggaatcgtcccgaccccatcaataatctttcaattactggaaatagggttcacagttggggatgtggcagtgttaccaaggagtgggacagggtgtatgctcagaaggtccaattattaactttcctttctactctgcccgagtctgctctgagttatgggccgagtgctgaaactaatatggccaattctatcgagcanagagaacagaaagagagtggcataatagttcttgattcggat

SEQ ID NO: 3920 - DNA, 339 bp, Hordeum vulgare
ttttttttttttttttttttttaagacagcagcaatctgtaatctctcagcacgacaccgagttccaatttatgacttgcagggggtatttcagttttcctcccctcataacagagagtacctgcattttctgtgcacagaaaacactcatcaccctaccgacaacggtgggtggtgcagtgcaatgcagcccaatgtttggcatccaaaacaacaacattatttcgttacgataacgcgtatctgcttaatcctgggagtcctgatcaagagatgcgacgaggatcggctccctggctaattgctgtcccaagtcggcacatactacaaaacaggtag

SEQ ID NO: 3921 - DNA, 10 bp, Hordeum vulgare
  UNSURE (1)..(10): n stands for any base
nnnnnnnnnn

SEQ ID NO: 3922 - DNA, 917 bp, Hordeum vulgare
  UNSURE (749),(767),(802),(844),(845),(847),(855),(886): n stands for any base
ttaaaataaaacaagtcgtgggcttcttttctttactcttaggaacaaggtaaacatatcaccatacaggtaacatggatgttacagttatgtcatacaaatcgatcttcagaatatgaaacatcacaggctcttccagcatgcatactgcccaggcaacataaagtgtaccgcagcatcatttcatgtacctatgcagaaacttgcggtggaaatcacttctgatggtgtcgttgatgaaccgtttcggtgtcttagtctctccactagcttggttcttgaatacaacatcatcatcccaccttctcttcacattgaaggagccagagttattcatattaatcaatgggtttcctcgcatcagctcagcctccttcatcttggcctcttcttctgcttgctgacgctcctttctaagcctgtcctcagctctttcttttttaattctttcgagctctgccattagtgcctcggtgtcatcgtcgtcatcatcatcgtcgctttcatcatcacttttgagctccacgtcagagtcgtctgcatcaatttcacgtggaactatcttatcctcatcccgttttgaaccttctaagagcaagctcgaactttttcgccggtccctctcatcaacataggacttatccttggatgagaagtgcttgcgttcacgctcctcaagttcgtccctgagattcctcttttgtacctcttcttgagtttgttggccctcttttctgggcttgaggaangtgtgggcggcgaagtcncaggaggagtacttcccccgaggccccgagatgcnggtgcccccctgctcgttcccgcctttggccgcgcccacgtnngncgcgccgncgtcgtcattcttcaaccgggattcctactnctctgctttgctttggtggagagacgggagg

SEQ ID NO: 3923 - DNA, 438 bp, Hordeum vulgare
caccggggccagcatattatgggacttggaggaagaaagtgcggtagttcgtccaaagtgtccacttttgatggaccctgatcttgattatgaaattgacagtgatgatgaatgggaggaggtggatcctggtgagagcctttctgactgtgagaaggacactgatgaggttatggatgaagattccaagattatagatgaagaagaggaagatagctttgtcgtccctgatggttacctctcggatagtgagggtattcaggtagaaagtctattggatgaaaatgctgacgatgccagtagttcgccaaccagccagtgtccagaagttgaggaattcagaattttactacgccagcaaaaagtgcttaacactttgactgaacaggctcttcgcaagagtcaacctctagtaatatccaacctagctcatgaaaa

SEQ ID NO: 3924 - DNA, 524 bp, Hordeum vulgare
catggagcattgccgtgacacgacagaatactgaatgtgcttacctgttataaaccgaagctgagcgattgccaaaatactcacagctcggagcaagatgcaatgccatattgcacctgagtggcctttgtattacacgattattacccaagaggtttctgcttgttttaaaccgccaatgcatggacccaattcaagaaagcctgcttcaggatcagcttgtcaggaccatcacttctgcgaggggaacagatcaacctgaggagcaccagcaacaccattgctaccttgaacagttctcggtttcaagcgaagctcaggtgaagatgcaagggcgttgactgcctcttctgggggtaaacaccgctttgagaagtacatgcctattcctttcgtcttcgagggacgatcggctactacttttgccttctggggacgatccacaggtggtgaggaagttaaaccaagcttgtcaagaatctctttcttaacctgccagcgattatcaacaaagtcagatatct

SEQ ID NO: 3925 - DNA, 518 bp, Hordeum vulgare
gatcggcacaacatttcatttatatagaaaatagtattttcttggttcttcgtatgagtggccatcctatgtgaattcaggtgctgataatctgataccaatggaattggccctcaaaattgcaaccaagattagagctggcgaacgctttgcagtttatgtagtcataccaatgtggcctgaaggagtccctacctcggcctctgtgcaagaaattcttttctttcaggctcagacaatggagatgatgtatggagtaatcgcacgagagctcaaggccatgaacattgagaatgcacaccttcaggattacttgaacttttactgtcttggcaatcgggaagaaccgacaacagatggtagccccgagtcagataaatctacagataaaagtgcagcggccctggcaagaaaacatcggcggttcatgatctatgttcatgcaaaagggatgattgtagacgatgaatacgtcattttggggtcagcaaacataaatcagagatccttggctggtt

SEQ ID NO: 3926 - DNA, 543 bp, Hordeum vulgare
  UNSURE (3): n stands for any base
acncctgtacctgtcttatgtacagactgtagaaaaaaaaatcttacaaaggcgcacaactctacaacacaccgtgaacagcccgtgctttccctatacgccacacaatgtgtgatccacagattacggtgcaggttatcatcatccgttggcaagacaagacattcagagaggttttacaggagagcaaaataaccagcttggactctgaagagaagtcagtaccgtgacgtcacatcgtcagcgaatcaggaagcgaggtcggggcgccgcagatcttgccaccgacgtcggggaagcattcttggtcgggcagcgggacgatcttaccatcaggctctaccttcactgggtatatgaggaggtgcccttgcaacattttcatctcttctgatgcgaatctttcccagttatcttcagctatttggttcactaatcgtacacactccagactagaaggttccttgaagcgctcatcaaccataccaaggtgttcagcccagagggagttcctatacccatatacctggccgtgaggatgac

SEQ ID NO: 3927 - DNA, 503 bp, Hordeum vulgare
ggattcgacgagggcagaccacctccaagacatattcaccggagagaagaagagagaagcgagaagatgtcgggccgcggcaagggaggcaaggggctcggcaagggcggcgccaagcgccaccggaaggtgctccgggacaacatccagggcatcaccaagccggccatccgtcgtctcgcgcgcaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgcactcaagcgccagggacgcaccctctacggcttcggaggctaggccgtcaaccagatttagattgttctagggtcgactgctcgttgatgtaatcgcagcatctcgctgttgtttgctgtcttctatagaatctaatggaatcgaatggaaattggtgtggattatgc

SEQ ID NO: 3928 - DNA, 491 bp, Hordeum vulgare
ggcataatcacaccatttccattcattccttagattctatagaagacagcaaacaacagcgagatgctgcgattacatcaacgagcagtcgaccctagaacaatctaaatctggttgacggcctagcctccgaagccgtagagggtgcgtccctggcgcttgagtgcgtagacgacgtccatggcggtgacggtcttgcggcgggcgtgctcggtgtaggtgacggcgtcgcggatgacgttctcgaggaagatcttgagcacgccgcgggtctcctcgtagatgagccccgagatgcgcttcacgccgcccctgcgcgcgagacgacggatggccggcttggtgatgccctggatgttgtcccggagcaccttccggtggcgcttggcgccgcccttgccgagccccttgcctcccttgccgcggcccgacatcttctcgcttctctcttcttctctccggtgaatatgtctttggaggtgggttgctgc

SEQ ID NO: 3929 - DNA, 319 bp, Hordeum vulgare
tggagaagcgctccgtggtcccggaggtcgccgcggagaggaaggggggaggggatgttgaagaggaggaggaggagggggtgacggcggtggccgggccgctggagctgcggtggccgccctgggaggggctgccggagcgctacaggctcatcggcgccacttctctcgccttcgtcatctgcaacatggacaaggttaacttgagtgttgcgaggggtccaatgtcacatcagtacggttggagctcatcgactgctggcctggttcaatcatcattcttttggggctacgctttgagtcaactacctgggggctg

SEQ ID NO: 3930 - DNA, 544 bp, Hordeum vulgare
  UNSURE (12): n stands for any base
gcattgccattnctaacagaactgaagaagagacattttgtcaacctttatgccttcaaactattggacaacacacctcctagcaatggaaaacagtgacaggcacttcatcacttcattccaaaattgtgccaggaaaggcctatacaatatagagagttatctaccgtatctggatgcccattctaatagaactaaacatacatgcactgcagaaaaggcctatacaatatagagttatctaccgtatctggatgcccatgcggcatgtacaacacactgtctacttgttcctaccagtctatccagtgcccaggagctccataaatttgctgggctggctgagctaaactcccaacggatttcctttctgaatggccctttgactactgattgccctctgttaacgactctgacgccaacttgttgaaatcctggggctcgctgctggcgaatgtcaaccagacggcggtgcccgttaagtagaagaagatcgaaggagcaaagagtgacatactccaagaatgagtcgtgtcaacaagat

SEQ ID NO: 3931 - DNA, 540 bp, Hordeum vulgare
gggctgcaggacttcggcacgaggcaatgatatacactcacttttgtggaagctggggccactatacttgcttgtcttggcttccaacattctttagtgaggagctaaacttgaacttgacagacgctgcatgggtgtcaattcttcctcctttgggctcaatggttattacatctattgcagcaccttttgcagacaacttgatatcaagtggagttgacaccacaaaggtgcggaaaatatgtcaagcaattgcgtttctgtcacctgcagcttttatgatgctttcctctgttgatcttggactgcctccctgggtagttgttgctttccttacaggtggtatatcactctccaacttcgcattatcaggtctttattgcacccatcaagatatatctcgtgaatatgcaagcattctcctgggaatcacaaacaccgtaggggccgtgccaggaatcgtcggcgtcgctctagttggctatcttgttgacacgactcattcttggagtatgtcgctctttgctccttcgatcttct

SEQ ID NO: 3932 - DNA, 555 bp, Hordeum vulgare
gtgacaggcaccttcatcacttcattcaaaattgtgccaggaaaggcctatacaatatagagagttatctaccgtatctggatgcccattctaatagaactaaacatacatgcactgcagaaaaggcctatacaatatagagttatctaccgtatctggatgcccatgcggcatgtacaacacactgtctacttgttcctaccagtctatccagtgcccaggagctccataaatttgctgggctgggtgagctaaactcccaacggatttcctttctgaatggtcctttgactactgattgccctctgttaatgactccgacgccaacttgttgaaatcctggggctcgctgctggcgaatgtcaaccagacggcggtgcccgttaagtagaagaagatcgaaggagcaaagagcgacatactccaagaatgagtcgtgtcaacaagatagccaactagagcgacgccgacgattcctggcacggcccctacggtgtttgtgattcccaggagaatgcttgcatattcacgagatatatcttgatgggtgcaata

SEQ ID NO: 3933 - DNA, 463 bp, Hordeum vulgare
  UNSURE (18): n stands for any base
gggcagtggtgtatgggngaaccaacatatggaaaaggcaagatccagtcggtgtttgcactgtccgatggctcagggttggccgtgactgtggcgcgctacgaaacccctgcgcatactgacatagataaagtcggcgtgactccggaccgtccattgccggcatcgttcccgaccgacgaagatggcttctgcagctgcctcaaggacccagcttcttgcaaccttaatgccgcccggctgtttgtgagatcatgatatggtcccaagtatgttgcggcgagcgaccgcctcttcacattttggtgttttttggccagttgggtgggcttctgttgatatggtagtttctcttacctggggtgctttgctgatcctattcattttgttaacatctggttatcttaaggagaaatctgttcatatctgtacaaagttccaatttcaccaaaaaaaaaaaaaa

SEQ ID NO: 3934 - DNA, 447 bp, Hordeum vulgare
gtgaaattggaactttgtacagatatgaacagatttctccttaagataaccagatgttaacaaaatgaataggatcagcaaagcaccccaggtaagagaaactaccatatcaacagaagcccacccaactggccaaaaaacaccaaaatgtgaagaggcggtcgctcgccgcaacatacttgggaccatatcatgatctcacaaacagccgggcggcattaaggttgcaagaagctgggtccttgaggcagctgcagaagccatcttcgtcggtcgggaacgatgccggcaatggacggtccggagtcacgccgactttatctatgtcagtatgcgcaggggtttcgtagcgcgccacagtcacggccaaccctgagccatcggacagtgcaaacaccgactggatcttgccttttccatatgttggttccccatacaccactgccc

SEQ ID NO: 3935 - DNA, 519 bp, Hordeum vulgare
gtggtgatggccactgacgtcattgaggcctgggtcgccgagaaccgtaagggggctggtgacgacactgccgaggcagagggggccatccagccagccgacgtgctgtccaggcagatgcttgagtgcacagctactgatttggcgcttgaggacaccatctacgcgctcgacaaggctgtccaggaaggatcggtgcccttcgacggctacctcaggagcgtgcgtgcactcgcacgggagcagttcttccagcgtgtcctctgcaccaaggtcaacaatgcacagcagcaggcgcaggttgctaggatggcctcacgggcaccacagtacgcctcctagccaagacgatggataggtcagtatacatgctttatgaccgattgattcatccattgtaagaaagagtggctcagtgtaaagttggttcccattgtcgtcgatgtgtgcgcttactgaataagaactctattagctggggtggtgcaagttcatggtgatatttgtgtaacgttgttg

SEQ ID NO: 3936 - DNA, 513 bp, Hordeum vulgare
cgttacacaaatattcccatgaacttgcaccaccccagctaatagagttcttattcagtaagcgcacacatcgacgacaatgggaaccaactttacactgagccactctttcttacaatggatgaatcaatcggtcataaagcatgtatactgacctatccatcgtcttggctaggaggcgtactgtggtgcccgtgaggccatcctagcaacctgcgcctgctgctgtgcattgttgaccttggtgcagaggacacgctggaagaactgctcccgtgcgagtgcacgcacgctcctgaggtagccgtcgaagggcaccgatccttcctggacagccttgtcgagcgcgtagatggtgtcctcaagcgccaaatcagtagctgtgcactcaagcatctgcctggacagcacgtcggctggctggatggccccctctgcctcggcagtgtcgtcaccagcccccttacggttctcggcgacccaggcctcaatgacgtcagtggccatcaccac

SEQ ID NO: 3937 - DNA, 471 bp, Hordeum vulgare
cgcagaggctgctgcttctcctcgctctcgcgatggaagctgtaaacaatggagcggatatcttcaatgatggccagcaagaaattatcaagcaatttggcagaatcaaatctgagactgttccggagaacaaggatgcagggtctgatgacgacgacgatgacgaagatgaggatgatgaaactggtgatgctgatgacgatgatgctgatgctggggaggacttctctggtgaagaaggcgaggatgatgatgaggacgatgaccctgaggcaaatggcgatgatgcaggcgcagggagtgatgatggtgatgacgatgatgacgatgatgatggtgatgatggcgaggatgatgatgatgatgacgaggatgaggatgaagaggaggaggaagacgaggaccagccgccggccaagaagaagaaatgatcttgtgccttccagctgttgtgtttcagtccgttagttt

SEQ ID NO: 3938 - DNA, 323 bp, Hordeum vulgare
cataacagcgaaatgttagactcttgcacaacgcaggaaacaacatcagaagttaatgttcactctatgagacaccaaaccccacgacacagaagctacataggtcggtgtgtaccagacccgctcaatcatgatctagacagcagataaactaacggactgaaacacaacagctggaaggcacaagatcatttcttcttcttggccggcggctggtcctcgtcttcctcctcctcttcatcctcatcctcgtcatcatcatcatcatcctcgccatcatcaccatcatcatcgtcatcatcgtcatcaccatcatcactccc

SEQ ID NO: 3939 - DNA, 514 bp, Hordeum vulgare
gcaagatccagacccccaccgatgaggtcgtggtgccctacgacaccctcgcgccccctcccgaagatctcgacgccatgaaggccctgctcgacaagctcgtggtgctcaagctcaacggaggcctcggcaccaccatgggctgcaccggccccaagtctgtcattgaagttcgcaatgggtttacatttcttgaccttattgtgattcagattgagtccctgaacaagaagtatggatgcagtgttcctttgcttctaatgaactctttcaacactcatgacgacacacagaagattgttgagaagtactccaactccaacattgaaattcacactttcaaccagagccaatatcctcgcattgttactgaggacttcttgccgcttccaagcaaagggcagacagggaaggatggctggtaccccccaggccacggtgatgtgttcccctctttgaacaacagtggaaaacttgataccttactgtcacagggaaaggagtatgtcttcgt

SEQ ID NO: 3940 - DNA, 552 bp, Hordeum vulgare
gtttgtgaaactatggcatcattcatatcatataaccaaagaaattttacgtccctggcactcccaggaagaacggaagtgtcaatggaccgcacggaggggattacagttattatgtaacagggctcccgcaggacaacaccccagcagaatgcacacgaaaaattacaggacggttaacccagcaaaggaggaccggaaggtttctggggatgcgagaaggtgggcgggcaggcgggtgaacgtcactcaaatatcctctgggccgttgatgtccttgttctcaagcaccgctccgtctgggatctccaacttgactccagccttggcggcgatggtcacgttgcccttgagtacgactccagagccaaacgagacatcaccagagaccttcaagctgtcaagctcgacgatgctggggatcgacttgaaacgggcaaggaagttggcaacctttttgaactcaggaccaagctcaattgaagggttcgatggcttcactctggccgggttgcggatgacatagccatcaaccaaggtatagagatcaga

SEQ ID NO: 3941 - DNA, 554 bp, Hordeum vulgare
gtccccccgggcctgcaggaaattcggcacgagggcttcatcctcacctcgatctggctgaccagttctactacatcttcggcttcctcttcctggtgtttgtgatcctcatcatcacctgcgctgagatcaccatcgtgctctgctacttccagctgtgcagcgaggactacaactggtggtggaggtcgtacctgacctcagggtcgtcggcgctgtacctcttcctgtacgcagggttctacttctggaccaagctgcagatcagcaagctggtgtcaggcatcctctactttgggtacatgctgctcgcctccttctccttcttcgtgctcaccggaaccatcggcttctgcgcctgcttctggttcacgaggatgatctactcatccgtgaagatcgattagagtctacgccggaggcacagcaggcaagaagagacagagacagagcatagcatatgttttgagctttccgcggtcgaggtgatgataattgtatgattaaggtgaaagaaagtggggatcagcccctgttgttactgttttcagttt

SEQ ID NO: 3942 - DNA, 560 bp, Hordeum vulgare
ttacacctggaattttatattgctgattactacaattctgcacaaacagacaactcaatcacagtgtattgtattctaccctcgatactcccaagatttatcactaacatgtatcatgcacttgccaccacaacaataaacataaatcatcggttcgtcataaactaattccaaaatgtaacttctcctgaaaaaactgaaaacagtaacaacaggggctgatccccactttctttcaccttaatcatacaattatcatcacctcgaccgcggaaagctcaaaacatatgctatgctctgtctctgtctcttcttgcctgctgtgcctccggcgtagactctaatcgatcttcacggatgagtagatcatcctcgtgaaccagaagcaggcgcagaagccgatggttccggtgagcacgaagaaggagaaggaggcgagcagcatgtacccaaagtagaggatgcctgacaccagcttgctgatctgcagcttggtccagaagtagaaccctgcgtacaggaagaggtacagcgccgacgaccctgaggtcaggtacgac

SEQ ID NO: 3943 - DNA, 536 bp, Hordeum vulgare
gtacccccgggtctgcagggaattcggcacgaggccgatccgatccgagatctcccgatggcgtcccggagctgcaccttcctcgagatcctgttcgccatcatcctgccgccgctcggcgtcttcctccgcttcggctgctgcagcatggagttctgcatctgcctgctgctcaccatcctcggctacatccccggcatcatctacgcggtctacgtgctcgtcgcgctcggctcggaggaccgcgatagggactacgacacccttgcttaaacatcctgcaacagctcgtatcctgtgtgtgatgagcccctcgcctggcagttgcgaatcgacgctgtgtgtttccatatggactgtgtggcgtgccttctttctgtgagtctgtaaatgcttaaaccgtctggtttccccgtcatgtaattctgatacaaccgaataaatttcagctctgaagatttatgccagtggcttgcgtgaattggtgagcagggctatttaacaggtgttacgatccgaaaaaaaaaaaaaaaaaa

SEQ ID NO: 3944 - DNA, 484 bp, Hordeum vulgare
ggatcgtaacacctggttaaatagccctgctcaccaattcacgcaagccactggcataaatcttcagagctgaaatttattcggttgtatcagaattacatgacggggaaaccagacggtttaagcatttacagactcacagaaagaaggcacgccacacagtccatatggaaacacacagcgtcgattcgcaactgccaggcgaggggctcatcacacacaggatacgagctgttgcaggatgtttaagcaagggtgtcgtagtccctatcgcggtcctccgagccgagcgcgacgagcacgtagaccgcgtagatgatgccggggatgtagccgaggatggtgagcagcaggcagatgcagaactccatgctgcagcagccgaagcggaggaagacgccgagcggcggcaggatgatggcgaacaggatctcgaggaaggtgcagctccgggacgccatcgggagatctcggatcggatcgg

SEQ ID NO: 3945 - DNA, 511 bp, Hordeum vulgare
gttcaattaatcgattcatcaggcatgtgatgtatgaccatggatttaatagtttggaaatgatgtgaaataacataaagctacttctgtaagccatttccactttgactcctacttttctcctttcatcttttagacatacctgcaatctgttagcaaaaggctcgaagagtggaggttgaggcagcgggacatggaggagtggatgagacatcaccggctcccacccgaccttcaagaacgtgtccagcggtttgttcaagttaaatggcttgcaacgcgcggagtagaagaagaatccatcttgcaagctttgcctgctgatatacgtcgggatgtacagcgccatctttgtttggaccttgttcgacgtgtcccgttctttgccgagatggatgaccaactcctggacgccatctgtgagcggctggtgtcgttcctgtgcccggagggcacatacatttcccgcgagggcgatcctgtgagcgagatgcttttcatcatccgtggc

SEQ ID NO: 3946 - DNA, 529 bp, Hordeum vulgare
aaggggtaagagttcaaggcttcaggatccagtgcgtaactcaagttcataatgttacagtggttggtagtggtacacaaacgggcatgtattcatacattagtaggggtatgcatgatctatggcactgacaacaactatatttcttcttatatgtactatagatttacaacaaaaacaggtatacggaacaatgtgttgcggcatcggagagagagagatggcttcagtcgaaatggtcggcggagaaatcgggctcgtcgggcttctgcagcctgcggatcatggtgtcgtcggcgcggaacctcctggacgccgaggcaaacttgttcatctcggcggcggtcctcgaggtgccctcctgcttaggcttatcggcagctgggtgctcctctgaccaccacgagtacgactcccaccggctcaggttctccgacagcttcctccgctgatgctgccgccacgccgcctggatgaagcaggcgccccatgtcctccagtggtgggagtagaaccggaacgtgtgctg

SEQ ID NO: 3947 - DNA, 518 bp, Hordeum vulgare
  UNSURE (502): n stands for any base
cctcgtgccgaattcggcacgaggcccagacccaacccccggaccagagcaagggagagatctcccccgatccgatccgagatctcccgatggcgtcccggagctgcaccttcctcgagatcctgttcgccatcatcctgccgccgctcggcgtcttcctccgcttcggctgctgcagcatggagttctgcatctgcctgctgctcaccatcctcggctacatccccggcatcatctacgcggtctacgtgctcgtcgcgctcggctcggaggaccgcgatagggactacgacacccttgcttaaacatcctgcaacagctcgtatcctgtgcgtgatgagcccctcgcctggcagttgcgaatcgacgctgtgtgtttccatatggactctgtggcgtgccttctttctgtgagtctgtaaatgcttaaaccgtctggtttccccgtcatgtaattctgatacaaccgaataaatttcagctctgaagatttatgccaaanaaaaaaaaaaaaaaaa

SEQ ID NO: 3948 - DNA, 476 bp, Hordeum vulgare
  UNSURE (472): n stands for any base
ctgaaattattcggttgtatcagaatacatgacggggaaaccgacggtttaagctttacagactacagaaagaaggcacgcccagagtccatatggaaacacacagcgtcgattcgcaactgccaggcgaggggctcatcacgcacaggatacgagctgttgcaggatgtttaagcaagggtgtcgtagtccctatcgcggtcctccgagccgagcgcgacgagcacgtagaccgcgtagatgatgccggggatgtagccgaggatggtgagcagcaggcagatgcagaactccatgctgcagcagccgaagcggaggaagacgccgagcggcggcaggatgatggcgaacaggatctcgaggaaggtgcagctccgggacgccatcgggagatctcggatcggatcgggggagatctctcccttgctctggtccgggggttgggtctgggcctcgtgccgaattcggacgnaagg

SEQ ID NO: 3949 - DNA, 518 bp, Hordeum vulgare
cccgagcggcggcgacttccggcagaaggtgtggagcatgacgggcgggccctactgccggcccgtccactggcgccgcaacaccgccatcgccatggtcggcatcttcctcgtctgcatccccatcgccatgaaatccgccgagctcgagcaacgcccgcaccacccagtccggccaatcccatcccagctttggtgcaagaactttggcaagaaggaatactgaaggacgtgtcaagactttcacaaagaaaatcctgtttttacctttgtgccttcttttgtcataaccggtcctcagcgaccgacgctggaagaagtatgctaccatagcgttatgtaactcttgtgactttttattatcacatacaaggagtgcctgtttgtttgcgattcaaataaactcgttatgcatatgctgctacggatatattttagggtaaaatccgatgaatataggcatcgtctattccccttttggtatcccgtagcgtgtggatgttagtacttgttttctt

SEQ ID NO: 3950 - DNA, 551 bp, Hordeum vulgare
gaggaatagttcaggctgatgtacattaatgaggtcattttatcttccaaagaacacagtgagcggataccccgagatgaaccaaacgcattgtaatttcatgaatacaagaaaacaagtactaacatccacacgctacgggataccaaaaggggaatagacgatgcctatattcatcggattttaccctaaaatatatccgtagcagcatatgcataacgagtttatttgaatcgcaaacaaacaggcactccttgtatgtgataataaaaagtcacaagagttacataacgctatggtagcatacttcttccagcgtcggtcgctgaggaccggttatgacaaaagaaggcacaaaggtaaaaacaggattttctttgtgaaagtcttgacacgtccttcagtattccttcttgccaaagttcttgcaccaaagctgggatgggattggccggactgggtggtgcgggcgttgctcgagctcggcggatttcatggcgatggggatgcagacgaggaagatgccgaccatggcgatggcggtgttgcgg

SEQ ID NO: 3951 - DNA, 423 bp, Hordeum vulgare
acacacacgcactaagcaatacacacacgcattaacctccatataattgactttcccggcatacacagcacgtgacgagcgcatggcaggctcatcggcggcggagctgaagttcacagtgcgcaggcagccggcggtgctggtttctccggcggggccgacgcctcgggagctgaagcggctctcggacatcgacgaccaggacgggctgcgctcccacgtccctgtcatcttcttcttccggcgtcaggacggcccgcagcacgaccctgcggcagtgctccgggacgccatcgccgcggcgctggtgcactactacccgttgtccggacggttgagggagctggagggccgcaagctcgccgttgactgcaccggcgagggcgtgctgttcgtcgaggcggatgccgacgtccgcctgga

SEQ ID NO: 3952 - DNA, 415 bp, Hordeum vulgare
tttttttttttttttttatctccactcaacaatttcggtcatacgcccaaatggacatgagtttggcctcaatatttgaaacgtgtatacaacatcacctcccaacaaactatttttatattgaaattttaaaaatgtgatttctcatagctttcgccgcttattttttttttctccacacacaaacgagtgccggttcagttcagtcttcagagcgcggctttgatcatggaaaacatgttgccggcaagttgctctgtcgtggccatgacgatgttatcggccggcatgagaagcttccccatctcctccacgaacttgtccatggcggcgtggggcaggcatacagggaccacgatgccgtcctcgcccttggcgttcctgaacgcgatgaagaagcttgcaatcccgggga

SEQ ID NO: 3953 - DNA, 531 bp, Hordeum vulgare
agcccaggtgtacgtcggcaacctgccctacgacgtcgacagcgagcgcctcgcgcagctcttcgagcaggccggcgtcgtcgaggtctccgaggtcatttacaaccgagaaaccgaccagagccgtggattcgggtttgtcaccatgagtaccattgaggaggctgagaaggctgtagagatgttccatcgctacgatgtgaatgggaggctgttgactgtaaacaaggcagctcctagaggcgcccgggtggaaaggcctccccgtgattccgggtcttcattcaggatctatgtgggcaacctgccatggcaagtggacgactctaggttggtggagctgttcagcgagcatggcaaagtggtcgatgccagggtcgtctacgacagagacactgggcgctcacgaggcttcggtttcgtgacaatggcgtcgcaggaggaactggatgacgccatcgctgccctcgatggacagagcttggaggggcgtgccctaagggtcaacgtcgcggaggagcggccaccgcg

SEQ ID NO: 3954 - DNA, 550 bp, Hordeum vulgare
gttaaacttttgaattgcatcgacagattgtgaactggaagcacaggcagatagcaaaagagaaaacaaggagagagaggagacatgcatggcacaaggatggatgggaggatgatgatgggatctaagccggtatcgggcgtgctatcgtgtctcttacgcagcaatcttgtcgtagtgcaccgccaaatatactttcattagaacctccgcggtggccgctcctccgcgacgttgacccttagggcacgcccctccaagctctgtccatcgagggcagcgatggcgtcatccagttcctcctgcgacgccattgtcacgaaaccgaagcctcgtgagcgcccagtgtctctgtcgtagacgaccctggcatcgaccactttgccatgctcgctgaacagctccaccaacctagagtcgtccacttgccatggcaggttgcccacatagatcctgaatgaagacccggaatcacggggaggcctttccacccgggcgcctctaggagctgccttgtttacagtcaacagcctcccattcacatcgtagc

SEQ ID NO: 3955 - DNA, 517 bp, Hordeum vulgare
gagattgcaagtttcaatcatgttgccggcctggtggagccctttgttgggggcgacagcggcgccgaggagacaggagggccaaaggagagcctggtggtgaccgaggtgaagaagcagctgtacctcgccgggcctctcatcgccggatgcctgctgcagaacgtcgtgcagatgatctcggtcatgtacgtcggccatctcggcgagctcgccctctccagcgcctccatcgccacatccttcgcgaatgtcaccggcttcagcttgatgtctggcatggcgagcagcttggacacgctgtgtgggcaagccttcggggcaaaacggccccatctgctcggcatctacaagcagagggcgatccttgtgctcactctggtgagcgtcgtggttgcggtgctctgggcgttcaccgggcagatcctcctgctcttgggccaggacccggagatcgccatgggggcagggagctacatccggtggatgatcccgtcgctcttcgcttacgcgctgc

SEQ ID NO: 3956 - DNA, 549 bp, Hordeum vulgare
cccataagtatcttgtaataacagaatacagtctgctctactaataacaaattctcaaaaggaaaaagttgcatccatgctgtggatttgattttctagtaaacaccaaatttcttacttcattgatttattcccttgtaccgtatcaactgaaacatccgatctatctttcacgtcttcgacaaaaaatcacgaaaacagatcatttcgttgggtgacgtttcctttagaggaagcgccatgccggtgacatggggaccaattaattcctcacgagttcctcatctcctctgcccagccagagcaattgtgcatcttgttccatgttcatgtcgtcatgtctacaggtagggacgaactagaaaccctgtccttcgccttgagagcctctttatcccagctggtgcgcatggtaatggccagcagcaacagcatctgcacgactagcccgcagattattccgaaccacagccccattccgtcaaggtggaagacgaaggcaaagcatagcgccgctggaatgccgacaaggtagtatgcgctgagatt

SEQ ID NO: 3957 - DNA, 235 bp, Hordeum vulgare
aaaccctcgcatccaagccgcctccacctccccgcggatctcccatccatccatggccgccgccgccccggcccgcaggctcctcctgcgcctgcgcctccccctctgcaacccgccgccgctccccgtccccgtcccgctcctcccccacctgacgccgcacctccacccgcagccacagcccccggcgcctcctttcccgggctccccggccccggacccgaagctccgggac

SEQ ID NO: 3958 - DNA, 345 bp, Hordeum vulgare
ttttttttttttttttttttctggcacgagtatactgaggttataccattgatctggggaaagaacagtacaaatgagttagaccagcatttgaagctttatttgccagaaattccgacatgaaacagcccattcctggctccttgtcattacagtgtttgaaggtacgtgcccagtcacagcaattgctttgttggtaccagaactgctactcctataaccaaaccaaaataacaggaggaaaccatcagcttgaaaccagtgtggcagcagcactggaggccctccttgcaatcacaatcctcgagccgggatccaggcgcggcggcggctcaggtctggcgg

SEQ ID NO: 3959 - DNA, 517 bp, Hordeum vulgare
cgtgaacatgaacatgaatttccttccagcccagatgagaaagaaggaaatggttttgataccaaaagtgatccaacaaaagcacctcctcccattgagatacctgaattgtcacttgatgaactgaaagaaaagaccgacaactttgggtcaaaagctttgatcggtgaaggatcatacgggagagtatattatgctattctagacagcggaaaacatcttgctgttaaaaagcttgatacctcagcagaccctgagcctgataatgaatttctgacacagctctcgattgtgtcgagattaaagcatgaaaattttgtggaaatgcttggctactgtgtggaaggaaatcaacgtctggtagcctatgaatttgctacgatgggttctctacatgatattttgcatggaagaaaaggtgtccctggcgcacagcctggcccagcacttgactggatgcagcgagtcaaaattgctatagatgctgctaaagggctggcatatcttcatgagaagg

SEQ ID NO: 3960 - DNA, 551 bp, Hordeum vulgare
caaaagagcaacgggcccgtataaaactgaacatataccaacaagtaaataacaattacagagtagtaggagtaatactcatcatgggtgcatggaaagaaaaactttttaaaaggaacggaatgcatagaatacagaaagatgcatgcatcactatcgagctagccggatagaatgacattgttacgacaccacttattctagaagcagcacgactgtggctccggcaatgatctcctccttactatcccatcaattgtaagctgttggcggcttgtgcttcggtggtggctctggcttcggctctggcttaggcataggttgcggcttaggctctggcttaggcatgggtttgggctctggcttcggttcgggtttgggcatgggtttgggcttgggctctggcttcggttcgggtttgggcatgggtttgggcttgggctcaggttttggcttcggcttcggcattggtttgggcataggtttgggatccaattttgggtgcggcttaggttctggtttcggcataggtttgggcatttgctctggtt

SEQ ID NO: 3961 - DNA, 516 bp, Hordeum vulgare
ggcggacagcgtcaagaagaagcggaaacgcaagatgaacaagcacaagctgcgcaagctccggaagcgcctccgccgccagacctgagccgccgccgcgcctggatcccggctcgaggattgtgattgcaaggagggcctccagtgctgctgccacactggtttcaagctgatggtttcctcctgttattttggtttggttataggagtagcagttctggtaccaacaaagcaattgctgtgactgggcacgtaccttcaaacactgtaatgacaaggagccaggaatgggctgtttcatgtcggaatttctggcaaataaagcttcaaatgctggtctaactcatttgtactgttctttccccagatcaatggtataacctcagtatactcgtgccagaagaactttgtcttaaatagttcatgagttgcactgaatttgtgtatgatatattcccaattttgcttccttggctggttcacgaatagttaccagctttcaaatttagcatttct

SEQ ID NO: 3962 - DNA, 549 bp, Hordeum vulgare
tagcaatcccatgcaagtgtaataaaaataaacttcaggcatgatatcagaaatgctaaatttgaaagctggtaactattcgtgaaccagccaaggaagcaaaattgggaatatatcatacacaaattcagtgcaactcatgaactatttaagacaaagttcttctggcacgagtatactgaggttataccattgatctggggaaagaacagtacaaatgagttagaccagcatttgaagctttatttgccagaaattccgacatgaaacagcccattcctggctccttgtcattacagtgtttgaaggtacgtgcccagtcacagcaattgctttgttggtaccagaactgctactcctataaccaaaccaaaataacaggaggaaaccatcagcttgaaaccagtgtggcagcagcactggaggccctccttgcaatcacaatcctcgagccgggatccaggcgcggcggcggctcaggtctggcggcggaggcgcttccggagcttgcgcagcttgtgcttgttcatcttgcgtttccgcttcttc

SEQ ID NO: 3963 - DNA, 176 bp, Hordeum vulgare
aaaatctgcccgcttatgtttctgtccgccccagaaagagagttcgcgcccaagattcagcaggtggtgtgactgtttttgggcaacgttggtgcgcctgaccccaaaaaacattgagccttcacttcgagctgatactgcagctggcagttctttgagagaagacaaggcggaac

SEQ ID NO: 3964 - DNA, 532 bp, Hordeum vulgare
  UNSURE (5),(21): n stands for any base
ctggntaaacactaacccagnacacttacatgatcaacaaactaatgacaaattaccagttgatagcaccacatggacgcgatcgctgtttgggacgcatagccctagaaggctagaagccccccacattccagaaacataaaagcatattaaggaaatgacatgtgtttggtccaaacgcaaaatggcacatccggatcttctgttgcagacactcaaatccgtcgctcaagttattgagtctgtgatgttctagccgaaaggatgtcgaacttaactcaggcttgctgattgctcgctcgatgctttgtaagttcaattgtttcaccgtgcctcattgtacactggaatagaatggtaataatatcataattttgatttgcagtcccacatgtcattctttagtcagcgcatttggcactttgatgtatggatcatcataacttggaagggcctctactatggcatctctgttagcaaatggttccgccttgtcttctctcaaagaactgccagctgcagtatcagctcg

SEQ ID NO: 3965 - DNA, 486 bp, Hordeum vulgare
cccaacctccagctctcgatcttggcccggcggagccaccagcaccggcggcgcgcccgagatgcgccccaacatcgtcacggaggctgggatttcaactaggttgaaccagtggtggagcagcaccccgttcattacttccggcgttaccataatatgtgcggcgatatatctggtgtgcttgttgattggatatgactcctatgccgagatatgcttcttgccttctgcagtggcctcgcattttcaagtgtacagattctacacatctgttctgtttcatggctctttgcttcatgtgctattcaacatgctgacctttgtacccttggggactgagttggagagaattatgggatcagtccgtctcttgttcctgatgttccttcttgcaacgactaatgcaattttccatctcatcgttgccttcttggtggattacaatcctttataccatgtctcatatcttgtggatgaatgttcgat

SEQ ID NO: 3966 - DNA, 541 bp, Hordeum vulgare
tcatttgagtatgagacattttagagattcaatatgaacacatacggagcaaaatgagtgaatctactctaaaatacatctatacatccgtatttggtctataccgaaatatctaaaaaggcttatatttaaaaatggaaggagtactttcaagtcgtatacacatgcggtgatgaaatcagtcaactgatgcatggaactggagcccttgacacttccatgttcagtactagtactacataagattggacaaatgcaagcaggcactagtcagtagcttctgcacctatacaagttgcacaatcaatggcacatttctcgaaaaccactctgtcaccaagatctcctctacaaagtccactatccatccacaatctgaacctaacctccagataagcaagagatatgctgctcgatagctgcactcactttgatatagaattgtggctaatcactaatcctgctggctcatgagaatctcaatggcaacattgggatctccgtccgcggcagcaagagcaacttcagcctgagtcctttc

SEQ ID NO: 3967 - DNA, 542 bp, Hordeum vulgare
ggtctgcaggcgggtgcaaggaggagttcgtgggttgggagaagtgcgtggagcaggcggaggcggaaggcagcgacgtcgtcgagcgctgctacgacgccacctccgcgctgcgcaggtgcatggacaagttccccgactactacgagcccatcctccgcgccgagcgcgccatggccgaggatatcgaggccttcaaggccagcgaagcctccggggcctcccctgcctcgccgccgcccccggcggccgaggaggaacagggcgacagtaagaagcaggcagatgcggcgacggcggtggcgaaggagaaggaggatcttgcggtctgatcccctaggcgctggatcttgcgattttttggtgagatttgaggcatccttgatgtggattattttgttttaccttgggcgtgatctgcacgactggagagggtggcctctccaagaaaaaaatcgattcttttggtgggaattatacaattgttcacgagttctaactcgtgaattaatatggagaagtgatcttgtgctgtaataatc

SEQ ID NO: 3968 - DNA, 538 bp, Hordeum vulgare
  UNSURE (25): n stands for any base
acgttcctgcattggattttcagcnaagatacttctcatattaattcacgagttagaactcgtgaacaattgtataattcccaccaaaagaatcgatttttttcttggagaggccaccctctccagtcgtgcagatcacgcccaaggtaaaacaaaataatccacatcaaggatgcctcaaatctcaccaaaaaatcgcaagatccagcgcctaggggatcagaccgcaagatcctccttctccttcgccaccgccgtcgccgcatctgcctgcttcttactgtcgccctgttcctcctcggccgccgggggcggcggcgaggcaggggaggccccggaggcttcgctggccttgaaggcctcgatatcctcggccatggcgcgctcggcgcggaggatgggctcgtagtagtcggggaacttgtccatgcacctgcgcagcgcggaggtggcgtcgtagcagcgctcgacgacgtcgctgccttccgcctccgcctgctccacgcacttctcccaacccacgaactcctccttgcac

SEQ ID NO: 3969 - DNA, 524 bp, Hordeum vulgare
aaactcttgacgcatacagatttttaagtttatgatggcgtcgttgaagatgttgcttggcatttgaggcatgaatacttattcggctcagtcggtgatgatcatcatctcctgatttgggatttgcgcactcctgcacctaccaagcctgtacagtctgtggtggcacaccagggtgaggtgaattgcctggctttcaatcctttcaatgaatgggttgttgcaactggttcaaccgacaagactgtgaaattatttgatcttcggaagattgatacttcgctgcacacttttgactgtcataaagaggaagtatttcaagttggatggagcccgaagaatgaaactatacttgcatcttgttgcctgggaaggaggctgatggtttgggatctaagcagaattgaccaggagcaaacaccagaggatgcggaggacggccctcctgagctcttattcattcatggaggccacacgagcaaaatctccgacttctcctggaacccgtgcgaggactgggtgct

SEQ ID NO: 3970 - DNA, 543 bp, Hordeum vulgare
ggtatgtatactgctgaaaatgccagtacaacgcacataccaaagccaccaagacaacatgttcaatcacataaggttacctaaaatggacaaagctaggtattatcttgtctccattctggtgtcctaccattaagggtttcacgaagcctttgccggctcatcgctgggaagatcatcctcatcatggtagatgttctctgccatctgccatatctgaaggatgttgtcttcagcaacgctggcaagcacccagtcctcgcacgggttccaggagaagtcggagattttgctcgtgtggcctccatgaatgaataagagctcaggagggccgtcctccgcatcctctggtgtttgctcctggtcaattctgcttagatcccaaaccatcagcctccttcccaggcaacaagatgcaagtatagtttcattcttcgggctccatccaacttgaaatacttcctctttatgacagtcaaaagtgtgcagcgaagtatcaatcttccgaagatcaaataatttcacagtcttgtcggttgaacc

SEQ ID NO: 3971 - DNA, 510 bp, Hordeum vulgare
gagggctgcaccggttgctcatctatgtgctcaagtctttgcatcgcaatatagtggaggagttccgaaatttctgcgacgaaataaaaattgctactgcccttgacaagatagatcagtttgtcgaagaacaaactctggacgtattatcttcagacaagactagcattgaagacatcaaagaaagtacatcaaaaaagaagagggatgaaattgaacttttaaaaggtttactagagaagactcaagaaagtaacaatgccatgaaggcccgaattgaacacatgaagcaagaggaggatctcaatgacacaagaaaatcaagcaagaggaggatctcaatgatacaagagattttctcacgaagctgaagcaatggaaatctgcgccccagagcttcaatgacaattgagcttctcttgtactcgatggagacatctgccgtgtagttttgtgtggttgtagattggtggtcgagtcaggagtcaagctcccccatgaaccaatggt

SEQ ID NO: 3972 - DNA, 548 bp, Hordeum vulgare
gcacaggcacgtcttgcactcggaaacaaatacgctcaattggttgcaccattggttatgggggagcttgactcctgactcgaccaccaatctacaaccacacaaaactacacggcagatgtctccatcgagtacaagagaagctcaattgtcattgaagctctggggcgcagatttccattgcttcagcttcgtgagaaaatctcttgtatcattgagatcctcctcttgcttgattttcttgtgtcattgagatcctcctcttgcttcatgtgttcaattcgggccttcatggcattgttactttcttgagtcttctctagtaaaccttttaaaagttcaatttcatccctcttcttttttgatgtactttctttgatgtcttcaatgctagtcttgtctgaagataatacgtccagagtttgttcttcgacaaactgatctatcttgtcaagggcagtagcaatttttatttcgtcgcagaaatttcggaactcctccactatattgcgatgcaaagacttgagcacatagatgaacaaccggtg

SEQ ID NO: 3973 - DNA, 549 bp, Hordeum vulgare
ccgggctgaggaattcggacgagggttcggttggagagaagaaagaggctgacactgttggtcaggaagagaagaaagaggctgacactgttgctcaggaagagaataaagaggccggcactgttgttcaagaagagaagaaagaggccgacactgttgttcaagaagacaagaaagaggccgacactgttgttcaagaagacaagaaagaggccggcactgttgttcaagaagagaagaaagaggccgacactgttgttcaagaagacaagaaagaggccgacactgttgttcaagaagacaagaaagaggccgacactgttgttcaagaagacaagaaagaggctgacactgttgcccaagaagagaagaaagatgcccctattgctgatgccccagagaaaactgatgaagatgaaggcaaggcggctgaatctgatgtagctcccgaggaggttgagatgcctgaccctgtatcagagaacaaggaaaacgagaagccagctgaatttgaagaagtccccgtggagtttgagatgtctgaccttg

SEQ ID NO: 3974 - DNA, 562 bp, Hordeum vulgare
  UNSURE (38),(39): n stands for any base
ggcgcaagagtaaggcctacaacttaccgggccgcctnngtcgggttaaacaccgccttacagtcctcaaagcaaatgcgggatcccatcctaagcacacagagaccaagtttgttccccgtttcgcctcgcctcgcctgtcgtccaggcaacctaccctcaggtgcatttcacggtggaagcacccggatggatctgtccgttgttgtcggcgttcgcggtggattgttcttcggcgttaccctggtcatccttgtgagcagcgttgtctgctggattctcggtggcttttgttgcctctgccgctggagcatctgacttcacctccgctggaggaggggtcgctggattgatggtgctatctgcctcttctttcttctcctctgaagatgctggaggtggcactatggattcgactgccaggccgttttcacttttctcgccctccacagcagttacttcatattcagctggcttttcatcttccacatgctctaatacagggtcagacatctcaaactccacagggacttcttcggattcagctggcttctcgttttcc

SEQ ID NO: 3975 - DNA, 496 bp, Hordeum vulgare
ggtggcagcagcaggggcagaaggcaaaggaggggagaggatgttgtccatccacttaaagcttctctagaagatctttacaatggtacctcaaagaagctctctctttcccgtagtgtcctctgctccaagtgcaagggcaagggctccaagtctggtgcttccatgaggtgcccaggttgccagggttcaggcatgaaggtgactattcgtcagctggggccttccatgatacagcaggtgcagcatgcctgcaatgattgcaagggcaccggggagagtattaacgacaaagatcgctgcccaggctgcaagggtgagaaggttcttcaggagaagaaagttttggaggttcatgttgagaaggggatgcaacacaaccagaagatcaccttccctggggaagctgatgaggcgcctgacactgttactggagacattgtatttgtcgtccagcagaaggaacacccgaagttcaagcgaaagggtgatgatc

SEQ ID NO: 3976 - DNA, 552 bp, Hordeum vulgare
gacagattgcttttatactggagtatacactacatcagaagtagccagatagcatttttcgaaaacacatggttggatacagtcccagcgccataggggcaaaaatcaccttcatcgataacaccaccaacaaaaccccagaagcgggcaggcatcttcatcttggatcccaaaaaagcttgccgcccaaacctagcaatcatgcccttggcttactgttgcgcgcactgcactctctgggcaccgcctcccggcatctcgtcatcgtcctcgtcgtacgcctcctgagcagcagcatgggctttccgacgcatctcctcctccatgttgacatcatgcatcgtcgtctcctcgcattcgtcaagctccatgtcagtcagcttggatgcaggctttggtggaagaacggcctcaagagccttgcactgatccggtgccagagagtcggggaactccactgtgaaatggatgtagagcttgcccttcatgaaaggcctctggtacatcggcattccctcgtcactgattgccttgaatgaatcaggcttgaca

SEQ ID NO: 3977 - DNA, 518 bp, Hordeum vulgare
cgctatggtcttgacgttggactcaccaactatgctgcagcctactgcactggtctgcttttggctcgtcgtgtgctcaagtcccgtgatctggatgaggagtatgaaggcaatgttgaggccactggtgaggacttctctgttgagcctgctgatgagaggaggcctttccgtgcgctcttggatgttggtcttatcaggactacgactggaaaccgtgtgtttggtgcacttaagggagctttggacggtggtctggacattccccacagtgacaagagatttgctggtttcaagaaggacgagaagtctctggatgctgagattcaccgcaagtacatctatggagggcatgttgctgactacatgaggtcgctagcagatgaggaacccgagaagtaccaaactcacttcagtgagtacatcaagaagggaatctcagctgatgacatggaagcagtttacaagaaggttcacgctgccatccgcgctgatcctagcatggccaaatcaaccaa

SEQ ID NO: 3978 - DNA, 555 bp, Hordeum vulgare
gatatagatccaaatggcacgcacggcacataatccagataacaatctataactccggcaagatacccaagacagaaaggaacaggtccgttgtgcatagtgccagactttaacaaaaacgcacgttgcaagactacactggggagatggacacgaacgctcttcactcgtcatcctcgtcatcgtcggcggcaccagcagagttgttgagggcgttgagcctctcgacgaggctggccttcctctcctcgtaggtgagcttcttggggttgtacctcttgtgagtcttgggagctggcttggttgatttggccatgctaggatcagcgcggatggcagcgtgaaccttcttgtaaactgcttccatgtcatcagctgagattcccttcttgatgtactcactgaagtgagtttggtacttctcgggttcctcatctgctagcgacctcatgtagtcagcaacatgccctccatagatgtacttgcggtgaatctcagcatccagagacttctcgtccttcttgaaaccagcaaatctcttgtcactgtggggaa

SEQ ID NO: 3979 - DNA, 521 bp, Hordeum vulgare
gggggaaagcaagccatgggaatctatgttaccaattatcagttaagaatggacacgctggcctatgttctgtattacccacaaaagcctcttgtcactactcgtgctatggagcatttgcacttcaggcagctaccagctggcattaatgcaattgttgctattgcatgttactctggatataaccaagaagattcggttattatgaaccaatcttcaatagatcgtgggttcttcagatcactatttttccgctcttacagagatgaggaaaagaagatgggaactcttgtcaaagaggaatttggtcgtccaaatagggagaacactatgggaatgcgccatgggtcttacgataaattagatgatgacggacttgcaccaccgggaacaagggtctctggggaagatgtcattattgggaagacatctccaattccacaagacgatgctcaagggcaagctaccagatactcgaagcgtgatcatagtacttctctgcgtcacagtgaaagtgggat

SEQ ID NO: 3980 - DNA, 533 bp, Hordeum vulgare
aatggactttttccttacatttgaaacacaaggcgattctaaaaaagaaacatgaatctgttaggtacattcaaactcgatctctcttgacatcgagatggcctagtaagttcacaattcgacaatcggtttctactacatatgatccaacacggaaggccactcatatgctgtcttcatataagcactgttcgagttgagctcttaaaagcaagactgttaaaagattgatgttgccaccaatcagtaatagagaaaacgtacagcttattaatcctgttagtaaatgaatactaatgtagagaacctaagtaacttcatggctggcgtctgacatatccagaacacgatctgaaggattgatagctcgtcgaaatgcctgaatacaacactcaaaagctcaacgatgtttatcccttgcacccttgacctcatgggtgagcatcctgggagcaatcgccatcgccatgagctcctggaagaggagcttacatgcgtatggtatgtggacctggacaatgtcagttttgttc

SEQ ID NO: 3981 - DNA, 436 bp, Hordeum vulgare
gtcaaaaattgtgttctaggcacaacattctgatgattgatgatgagatccaaacaggcatagctcgaactggtaaaatgttggcatgtgattgggaagatgtacgacctgatatggtgattctaggcaaggcactaggtgctggagtagttccggtcagtgcagttcttgctgataaggatatcatgctgtgtatcaagccaggagaacatggaagtacatttggtggaaacccattggcaagtgctgtggcaatcgcatcactgaaagtggtcaaagatgaaggtcttgttgaaagagccgcggagttaggtcaggagttcagggaccagttacaagaggttcagcagaaatttcctcatattatcagggaaatacgcgggagaggtttgcttaatgctgtagacctaagcagcaaagctctataccctgcttc

SEQ ID NO: 3982 - DNA, 535 bp, Hordeum vulgare
  UNSURE (53): n stands for any base
atttatttacagtgaatgtagcaacggcacattttctgaacagagagtgcgancatggagcggtataccacactgaaaaatccatgttctgttattccagagtaccccatctctggtcggatgaacggtcgccctttataaatcccgaccacacctatcgcaggcgggtgtttttgcctccgattctggtttcttgatctgcttctgcaactgcggcaagtcatgctcaagcacatcgctaagtgcctttgatgcctctgcgagctcctcgggactgatcgaaatgggaggggctaatcggattatggtgtcatgcgtgggctttgctagaatgcccctctcctttagcttgatgcaaatatcatatgcagaagcagggtatagagctttgctgcttaggtctacagcattaagcaaacctctcccgcgtatttccctgataatatgaggaaatttctgctgaacctcttgtaactggtccctgaactcctgacctaactccgcggctctttcaacaagaccttcatctttgacc

SEQ ID NO: 3983 - DNA, 390 bp, Hordeum vulgare
agaggagaaaggttccatgtgaacggcacttgcacatgggtaagccgatcctaagggacggggtaaccccggcagatagcgcgatcacgcgcatcccccgaaagggaatcgggttaagatttcccgagccgggatgtggcggttgacggcgacgttaggaagtccggagacgccggcgggggcctcgggaagagttatcttttctgcttaacggcctgccaaccctggaaacggttcagccggaggtagggtccagtggccggaagagcaccgcacgtcgcgcggtgtccggtgcgcccccggcggcccatgaaaatccggaggaccgagtaccgttcacgcccggtcgtactcataaccgcatcaggtctccaaggtgaacagcctctg

SEQ ID NO: 3984 - DNA, 361 bp, Hordeum vulgare
ttttttttttttttttttggcaccaaacagaaaattcaggttctattaagtcaagtctcacatgtactaagcttgtttcctggttacaatattaacctaacagaatttggaaacaaggcaccagtaaacagatttacatatatataaggcactatataaactttcttgcagcagcagcagctcagatgcggcggagagatgccaatctcctttccagatcatcgacttcagcggcattaggttcaggcgccacgtttttcgctggagccgcattccgtgcttggttgttctcagctttcttggtactggctccaatacggcctttaggtgcagaagacagctgagaagccacatcaacacc

SEQ ID NO: 3985 - DNA, 414 bp, Hordeum vulgare
aagtgagctatggacaactggtctcttgtatttggtgctcgtgcttgtgccatgggtagctacacagttgtatgtttatatgcaccagaggttcgtatccttttctcatggcatgtagtaaatgtgtttcttggtgacctggccatcacagtatagcgagtttaatgtgttgaaagtactgcctggtaggcctataagttgcaatttcaacattatatccatcaatttcgctaggtacttaaatggtattttgcttcctgaatatttgattttttttatgtctgcagtacatttcataatgaagatatatgtaaataaactggtgggagtaagacctaaacgaataaaacatactccgtactactgcatccttattattaatgttattgcagtaatgctttcttgtcacagaag

SEQ ID NO: 3986 - DNA, 558 bp, Hordeum vulgare
  UNSURE (10),(11),(38),(39): n stands for any base
tttagcaacnnctgcaaattcataaacacaacacaagnnccaactttcttacaccatgaccagtaacttcaactaaggacccaatcgacatgagaattcagcaaaagttactggtagaaatgcctgttgcagacacttaatcacgttcgaagaatttatacatacataccatacccctacttacagtcttaaggagcgaggactttacaaaatgatgtccaataacatccgaaaccccgaaatgaattttggggaatcttcatcgtcatgtccactaaaaatactacacatatactagttttgtatataaaacgttcacgtagcagcatgacgaattttatggtcccaagtgtttttactttcttacaccatgaccatcatcaggtcattgcgcggcccttcgtctcaaaagggaagagcatgcaggcaattgcagcaaggaataacaccacctcaaacacaaggatggcttccatctgatggcagcttctcagcatcccaacggctacaagggggcaaacaattccaccgactctgcccatggcagtcgcgattcca

SEQ ID NO: 3987 - DNA, 516 bp, Hordeum vulgare
ccaatctaaacactgcggcatgcttcattacacctctggcggccagttcaagataccacttgtgatccgaggtcctggtggtgttggtcgtcagcttggtgcagagcattcacagcgtctagagtcatacttccagtcaattcctggtctccagatggttgcttgctctactccttacaatgccaagggtttaatgaaggctgcgataaggagcgagaaccctgtcgtgctatttgagcatgtacttctgtacaacctgaaggagaaaattcctgatgaggagtatacgctatgcctggaggaggctgagatggtacggcctggtgagcatgtgactatcctcacatactcgcgaatgaggtaccatgtgatgcaggctgcaaagacgctggtgaacaaagggtacgatccagaggtgattgacataaggtcgttaaagccattcgatctgcacacaataggtaactccatcaagaagacccaccgcgtgctgattgtggaggagtgcatgcgcac

SEQ ID NO: 3988 - DNA, 527 bp, Hordeum vulgare
tcttccataaacccgagttcagacccctagtagcattcagcatgatacagtacagttatgtagctgaagtgttaactcaagcaggaataaaaaatggatacaaagcctataccacaatgaacacctcgctacaaggcaaaaatgacaaattaaaggttcttccaagccagggcagatacaaattaacgatgctgaaacagatgatgccctattggcatatttgctcgacagcagcaacaatctgggcaggctgcacgactgtcgcatcctccaaagttgcggcgtacggggtcggcacatcctgagatgacaggcacatgatgggggcgtcgaggtagtcccagaagttgtcgatgatggccgacctcagactggcgccgatcccgccagtgcgcatgcactcctccacaatcagcacgcggtgggtcttcttgatggagttacctattgtgtgcagatcgaatggctttaacgaccttatgtcaatcacctctggatcgtaccctttgttcaccagcgtctttgca

SEQ ID NO: 3989 - DNA, 519 bp, Hordeum vulgare
cacgggctcactgctctactctgacctcagctccaatctgaccctagtccatagtaggagccgtcgccgtgccgtagctgatagcatcaccggccgacgcctccccacgcccgctcctcgcgcgcgccgcccccgccgtatccactccgtccgcagtcgacgggttttgaggtggacatgcattttgcaaatgtcaggctctaatcagatggcttcagatggtaaatttggaaatggtcctcgggagctcactggggctgttgacttaattagccgctacaggctgctgagccatcacagtctcttttgtaagaaaccattgccactggctatctcagatacacattatcttcagaatgttgtgggtgacactgaaatccgtaaaggagaagggatggagatagatcaactcattcagaacccagccctgagggagaagaagactgcttatattcaaccctttgacatggaaacactaggacatgcatttcagttgcgagaaacagcgccagtagatct

SEQ ID NO: 3990 - DNA, 552 bp, Hordeum vulgare
tgctaatttttctgctctacgcgtctcctgttgtacatggctccatcatgtgtgctttgacagtaagcccttttcttctgtctgaattacaggacagggcatataggagggtaacgctaaagaattgctaatgggcgcaaaactaaagaagttcaaatgacaagttcaagtttccccagaattgatttatggcgtatcattatctaattggccacgacccttgtaaccggagcatcttgataaaggaaattccatctgtcgtaactccatcggaagtggtattgacaagaaaaccatcagagccgccattaacagcataaaacatggagtcatattacgagaactaacacagaaacgaatttgtcacatcttacgccaaacaaagtccttgcccatttcattgaattttgcgcttttgtgtttttttgtggttacgtacagccgccaaattttccattccttcatgtttcctcttcttctcatgatgttttttggaattatcacctcccaaatcatggtgtacactcttctcttttttcttttctttgtctt

SEQ ID NO: 3991 - DNA, 519 bp, Hordeum vulgare
  UNSURE (13): n stands for any base
gtctcgtaaccanagagttgacgacttgagagccgaggcgaagttcttggttggacagttgtcagaacttcaagattctcggaggtcactgcagagtgagattataaagctgattcaacaaaattctttgctggcaaatgaattgcatgactccagggagaaagagatgatctttgaagatgatttcagggttctcatgagcgaagccgttagcaaagatatccttcttgtgatatttagaagccttcatgaagacaggtccctggagttgaagtctttgcatgatgattttgtgtctctccaagctgtaggaagtgagctttgtaaggacatcaggatgatgaacaagaagcttgataattttgaattcctggataaccacctcggcaaagatacaaccatgagcatttgtgaccggtctagtggagaaaataatcacacagaagttgacgacgctggccttcaggaatcaaatgaaatgctactggaggagatactcaagttacatggaaatgtgga

SEQ ID NO: 3992 - DNA, 543 bp, Hordeum vulgare
aattgacaaatgatagatattgatgaatgtacaaaataccacacaaaaatgctctccgggtacttatttctatgccctctcttgtttacaaacaatttccactgtaatgttcacccgggacgatgcagggccggcgcaaagctacacgcagcaaatgttagcagtgattttacaagcccggcagtaagtttatagcagatgcttacagtcaatgactaccatttacaacccttacattaccacttcttttttctgtatttacctagaaaaacatgaactaataatgagtcgcgccatctgaaactgaaaactccagccttccctactccgccttcaaaaaaggagcggcgcgaacgaaggccgaattagtcatcgatggttttcgctctcatgcaaccgcagggtgagcatcgcggcttccgattctcccgccttcgcccgtagagatagtccaccagctgcaccttggaccgatgatgcacggttttcgacgtcgcgctgcttgtctgctcctcctcatacttcaccagggcctgctggacc

SEQ ID NO: 3993 - DNA, 551 bp, Hordeum vulgare
  UNSURE (20): n stands for any base
gtacccccgggcctgcaggnaattcggcacgagggtgccgtagctgatagcatcaccggccgacgcctcccccgcccgctcctcgcgcgcgccgcccccgccgtatccactccgtccgcagtcgacgggttttgaggtggacatgcattttgcaaatgtcaggctctaatcagatggcttcagatggtaaatttggaaatggtcctcgggagctcactggggctgttgacttaattagccgctacaggctgctgaaccatcacagtttcttttgtaagaaaccattgccactggctatctcagatacacattatcttcagaatgttgtgggtgacactgaaatccgtaaaggagaagggatggagatagatcaactcattcagaacccagccctgagggagaagaagactgcttatattcaaccctttgacatggaaacactaggacatgcatttcagttgcgagaaacagcgccagtagatctgccttcggctgaaaaaggtactccaactatatcgggaaattcaaaggttaagtccagggacaaagtc

SEQ ID NO: 3994 - DNA, 551 bp, Hordeum vulgare
tctttgtcttttgtctttctcctctctttttctttctctttctctttctctttctctttgtctttgtctttgtctttactccgatccttatgacgatgtttgtgcttcttctgttccttgtccttgtctttcgccctatgctttttatgcttcttgactttgtccctggacttaacctttgaatttcccgatatagttggagtacctttttcagccgaaggcagatctactggcgctgtttctcgcaactgaaatgcatgtcctagtgtttccatgtcaaagggttgaatataagcagtcttcttctccctcagggctgggttctgaatgagttgatctatctccatcccttctcctttacggatttcagtgtcacccacaacattctgaagataatgtgtatctgagatagccagtggcaatggtttcttacaaaagaaactgtgatggttcagcagcctgtagcggctaattaagtcaacagccccagtgagctcccgaggaccatttccaaatttaccatctgaagccatctgattagagcctgacat

SEQ ID NO: 3995 - DNA, 517 bp, Hordeum vulgare
  UNSURE (517): n stands for any base
gggcttcttgggtcgctcgcttcccggggttccaggcgtccaacctcggcgacgccatcgacgtcgtcaatcagatgatagattggaggttgtcgcatgagaagccgagcgaggactgtgatgaagctgaacttgacccgaaatacagagaatctgtcaagtgcaagatatttcttggtttcacgtcaaaccttgtttcttccggtatacgggatgtaatacggtttctagttcaacatcgcatggtggatgttattgttacgactgctgggggtatagaggaagacctcataaaatgccttgcaccaacgtaccgaggtgaattttctttacccggggcactgctgcggtcaaaaggacttaaccggataggaaatctgttggtgcccaatgacaactactgcaagtttgaaaactggatcatgccactctttgaccagatgttacaagaacaatctactgaggtgattgctcgtcttggcaagaaataaatgacgaaacctcctacctttattgn

SEQ ID NO: 3996 - DNA, 544 bp, Hordeum vulgare
tttttgcattccgtacataatttattatacaaagcatacaattagtattacaacctcaggtgtacatcaaacaaaaggaatcagtaactgtggtcggcatctgacaaaaaaccttccatgttatcctccaaagagtccagactgacgatttgggatcactaaaaatcaatttgaggtctttagtttgctgctataaattcagttggttgaacttgcactacgagacctgcgtgcaaatgtcgcagctacaagtaacgggaaagcgatagtcgcatcgcagtggacctttacaggttttgctgaacctttgatctttccccatgaaactgcttcatcaggccgtgctcctgagtcacttccatcaaactcttgagccgtgttgatataaactgcataatctgcaccattgcgaaacatatttgcattgcatatatgatgctttggaaggcccccaccaagaattatgacccctgtcttccttgggcttgcatgaattgcttcaccatttatcagccttatatcttgtacaatgtcaataataaga

SEQ ID NO: 3997 - DNA, 477 bp, Hordeum vulgare
atacagcagcgacggccggcgcatttgaccccgggccgacgccgacaaactccgaagggaaccggagatgcagcagggcgatggcacggaggcgcaggtgacgtgggatgaccagcagaacatcaaccggttcggccgcctcaacaaccgcctccacgagctcgccgatgagatcaggctcgccaaggaagcaaatgaaaaccttgaggatgcggggaatgaactcatcttgtctgatgaagatgtggtgcgtttccaaattggggaagtgtttgcccacatgccagtggacgatgtggaaactaggctagagcagatgaaagaggatgcggctaagaagttagagaagctggaggaagagaaggaatccatccttgcccagatggccgaactgaagaagatcctctacgggaaatttggagaggccatcaacctgtaggaagattgatgtcgagaaccggagctgcctttttaggt

SEQ ID NO: 3998 - DNA, 555 bp, Hordeum vulgare
gaaatacatgtaaaggcctaatggacttatgtaatacaaatatgcaggttcaaaccatactcactagcttaaaacattgtaaacatcccctcattggtttctcaagtgcccatttaagtctactctccccaggcttctgctggacaaccagccccaatctatagtccaaccgagatcaaccatgccaatgcataatggggaacaatcatcacgagaaacaatgtagcgagaagaacaaagcacctgaacaagaacaggtgtcatacgacccgacacctaaaaaggcagctccggttctcgacatcaatcttcctccaggttgatggcctctccaaatttcccgtagaggatcttcttcagttcggccatctgggcaaggatggattccttctcttcctccagcttctctaacttcttagccgcatcctctttcatctgctctagcctagtttccacatcgtccactggcatgtgggcaaacacttccccaatttggaaacgcaccacatcttcatcagacaagatgagttcattccccgcatcctcaaggttttc

SEQ ID NO: 3999 - DNA, 446 bp, Hordeum vulgare
gctatagggaacttcacttacttgatgctgccacagtttgagcctcttgttcctgggcactgtgtcattcttccattgcagcacgagtcttcaacaagaacagttgataaaaatgtctgggaggagatccgcaacttcaagaagtgcctcctgaagatgttcgcgcagcaggataaggatgtggttttcatggaaactgtcataagcctggtcaaacagcagaggcattgcatgattgaatgcatccctgtcccatgcgaagtttcaaataaagcgcccatgtacttcaagaaggcaatcgacgaagctgaggaggaatggtcgcagcatgagatgaagaagctcattccaacgagcggtaacctgcggcaatgcatcccggagaacttcgcctacttccacgtggagtttggtctggaccgcgggttcgtccacgtgatagacga

SEQ ID NO: 4000 - DNA, 549 bp, Hordeum vulgare
tcctttttttatttagtttgatacgtgatggcattctgggctgcctctaatgtcgtcgcttcaagatacacttgaactgaagttcatagccatatcctgtcagatgttaaattcaaccaaagaagcatttaaaacacagatatataacaacatcagtacaatttcttccctacaaaactgtctggtgcaaattgcgtgagtcttcccaagtgctcttaagatcgtatttacatctactcgagctgcttagtccagtcgaagggctcccagtccttcatgaagccagcaacggcttgcttctggttatccatggactcgtgcctccggcgacggtgcatgtcctcccctggcaaccggagcacccctcggagtacattcagcccgaaaccagcaccgaacttgctctcatcgtctatcacgtggacgaacccgcggtccagaccaaactccacgtggaagtaggcgaagttctccgggatgcattgccgcaggttaccgatcgttggaatgagcttcttcatctcatgctgcgaccattcctcctcagct

SEQ ID NO: 4001 - DNA, 517 bp, Hordeum vulgare
cctaatcacaggcatcttgcatacacagagagagagaaagagaagccaagaagagatcagcagctgctcaactagctagcgtggaggcgtccaaggtgggagacccaagcacaggctagctagccgaccagctgctccaccggagccgatggctggcgccgatgtcgacgtcgggacggagctcaggctcgggctgccgggaggcggcgccgaggcggccaaggccgggaagaggggctatgaggacaccattgacttgaagctgacgctgcccaccggcggcatgcaggaagactccgccggcaagccggagccggcagccgacaaggccaagaggccggcagaggccgcggccgctgaccccgagaagccacctgctcccaaggcacaggctgtgggttggccaccagtccggtcgtaccgcaggaacgccatgaccgtccaatcggtgaagatcaagaaggaggaggagaccgagaagcagcagcctgctgctaccgctgctgctggcgccaac

SEQ ID NO: 4002 - DNA, 549 bp, Hordeum vulgare
ttacaatacacatacttaattgacacagtagaataaaatcaccaagtagattctgggacacatggtagggaacatcacataacaccaatccagctacacacagatagattattgcttctggtccaccaacaaattaaacatggcaactctcccttcttttaatccagctaataattgaaaacattatatatctaagaaaccacagcacactgcaagaacaccatccttatggcatcatagtcttcctcttactgccccatgtttagctcttgttcttgtacttgtccttggcccttggtgcaagaccgatggcttcggaacccttcatgatcctcaagcgtttgcatgaagcaacaaacatctcccatgggacgtctccaacaagcatccagtcgccatccttgtcttcgtaagtagtaacaacatctgaaccgttcactgcctcaaccatcttcccctcattcccagttgcggtgaaggtgctgaacatcttgtgcagagcaatggagaggtccttgtaggtgttgtacatcttgagatccaccttgc

SEQ ID NO: 4003 - DNA, 516 bp, Hordeum vulgare
  UNSURE (11): n stands for any base
gatccacccanaccgagagcgccttcgccgacgacatggcgctgctgatggagcccgggtcggagcccctgacggagggcgagaaggccgacctggacgccatcgccgccatcaaggagtcggcggcgcgcgagtacagggaggagggcaaccagttcttctgctctacccggaggtcatgtcgagcgactttatcgaggattttccggagactgatctgttctcggaccaccttgatctcatgttctcagaaagttccccgcctttgccatgggatgagaaccatgcttacacaagggaggctattgagatgtattgtcaggccggtgatggcacaccattctccaaaagtgaattgttaaaatatcttctggaaggcactgtcgactcagggtcgctcccagaaagccttgatggggaagatggagaacgtagtactgtcaagggcagcacagctatatcatcaacaggccagggctcctctggtaagtggatcaaagtaagagaagggaaaac

SEQ ID NO: 4004 - DNA, 550 bp, Hordeum vulgare
gttcatctgcccacagctaaattacatgaaaagttgcatattcggttgtttctccctctagaaacacacctcctgagccatcaaccaaacaatggttggaacttggaagacacacaagtgctaactaagcacaactcatcttctctgaagcagtataaccttctaggaccatacgacgattaacaattcccagcttctctttcctcatcatatccatagcaccacactgatatggtgaactgaactaccacactgcagctctacggtaaagaccacttcccatccttgaacttcgaatagaaggccgacttcctcgaaacgacaaagaacacaggtacagcggggatgatatagtctttatgctgcagcgcttcctgaagagttttcccttctcttactttgatccacttaccagaggagccctggcctgttgatgatatagctgtgctgcccttgacagtactacgttctccatcttccccatcaaggctttctgggagcgaccctgagtcgacagtgccttccagaagatattttaacaattcacttt

SEQ ID NO: 4005 - DNA, 519 bp, Hordeum vulgare
gccgacgccaacgacgccgcggtcaccgtcagcctcggctccgccggcgccctcgcctactcctcggccacaagaacccgctcgtccccaggatgtttggttctgtgaatgacatattttgcctgttccaaggacatgttgagaacattggcaacctgaagcaacactacggtctgagcaagacagcaaatgaggttaccatcctgattgaggcctacagaaccctccgggacaggggccctctcccagccagccaggtcgtgagagatctcagtggacggtttgctttcatcctgtacgacacggtgtcgaaatccaccttcgtcgctgctgatgctgatggcagtatccccttcttctggggcgtcgactccgaagaccaccttgtgttctctgacgacaatgagcttctcaaggcagggtgcggaaactcattcgcgccattccccaaaggctgcttctacaccacatctggagggctgcagagcttcgagcatccgctgaacgaactgaaggccg

SEQ ID NO: 4006 - DNA, 555 bp, Hordeum vulgare
gcataatgaacttatggcagtatcattacccatcagacagtacatttattgaaacagcattgtgtagagcgtcgtaaactgctcaaaaatagaacgcaggtgcggtgtctcagtgattcattgtcaagattggcagtttacaacaagggtcatcgagctagtagtggttagaccaatcagcggcactaccgacgcgagggatccccgagtccttcttggcctcgctgtcgaccttgaaggtggagccacacatctggccttggctgtccacgcgtggcacggccttcagttcgttcagcggatgctcgaagctctgcagccctccagatgtggtgtagaagcagcctttggggaatggcgcgaatgagtttccgcaccctgccttgagaagctcattgtcgtcagagaacacaaggtggtcttcggagtcgacgccccagaagaaggggatactgccatcagcatcagcagcgacgaaggtggatttcgacaccgtgtcgtacaggatgaaagcaaaccgtccactgagatctctcacgacctggctggctggga

SEQ ID NO: 4007 - DNA, 555 bp, Hordeum vulgare
gtaatacttacatatactgccactgcaaatcgcagatgcatctgaatgaggtgattttggatggcagtgatatctccaaagcaataattgattatgctactggtcatgccatcacagatatcgtagttggagcatcctctaggaacacattcatcaggtgcctactcatccatacttgatggtcatgcaccattacatacctttgatatatacctatactgaacacaggcatggactttacaccatgcagaagatttagaaatcctgatgtgccaacatgcttgatgaagatggcgcctgattattgcacagtgcatgttatacacaaagggaaggtcgtccaagtgaaggcagccaaagctccagcaccctttagtactctccctccaaagcaaaactcccaaccaaacatcgaacccgatgcattcgcaaggtaagtttgtgaagaacacagatagcactccaataaatacattgcatgttcctgaaccttctgagcctggaaaaggaggcagtgctgcatttgctctgctatatcctgattgagatgatatg

SEQ ID NO: 4008 - DNA, 553 bp, Hordeum vulgare
  UNSURE (10),(11): n stands for any base
catacattgnnttttttttattgggaaccaacatacatgttatatgcaacacccgctgcagtttacataaaatgccctataattacgaagacaagctattgagaagaacacccacatgacaatcctttttaccaaactcttcaaaatctaatagcccatgactggaatgcagttccttggtagtcaatcgtcgcatgcttttgtcacatgtaccttgtcgctgcaaacaacctctcatagttccagatatttgtaaccttgtaaccatctagtttgatcttgttggctataactgtttttatctgaagcggtaccgcaatctcctctgctgagctgaaggtgcagcagcatctgcacttctccagcacacattgtattattatcttgtccataactgcaaagcctactgatctccttgtttcacacgtgttttttcttgctcacgagcaatagtattgttgctgcagtatatctacaaatgatgtgatacatctacaggtttgggttgcggatgcactgcgccccttgccacgtggctcccggcggcagcacc

SEQ ID NO: 4009 - DNA, 527 bp, Hordeum vulgare
cggcacgagggggaaaaaaaaaatctctctccgctcttccgctccgagtcgcgtcgcgtgaggagaacgggaggggagccaaaaaggggttctcgccgacgcggaaggggaggagatggccgggaagggaggcaagggcctgctcgcggccaagacgacggccgccaagaccgccgagaaggacaaggggaagaaggcccccatctcccgctcgtcccgcgccgggctccagttccctgttggccgtatccatcgtcagctgaagcaaaggacccaggcgaatggccgcgttggtgctactgcggcggtctactctgctgctatcctcgagtacctgacggccgaggttctggagctggctgggaacgctagcaaggatctgaaggtgaagcgtatcacccctcgtcacctgcagctggccatccgtggagacgaggagcttgacaccctcatcaagggcaccattgctggtggaggtgtgatcccacacatccacaagtccctgatcaacaagtcctccaaagagt

SEQ ID NO: 4010 - DNA, 552 bp, Hordeum vulgare
ggtttttgcattgagagtctatacagagttaacgaacaaacataaacaccacgtccaaatgactcaatcggtaccaggggaaacattacacagacggacaacaactttgatctggaaggagcacagctaaacgctaaacgacacgataaacttatctcacagacgactgagaaaatgtccagtttaagctagagatgctccttttctatttttttattttcactctttggaggacttgttgatcagggacttgtggatgtgtgggatcacacctccaccagcaatggtgcccttgatgagggtgtcaagctcctcgtctccacggatggccagctgcaggtgacgaggggtgatacgcttcaccttcagatccttgctagcgttcccagccagctccagaacctcggccgtcaggtactcgaggatagcagcagagtagaccgccgcagtagcaccaacgcggccattcgcctgggtcctttgcttcagctgacgatggatacggccaacagggaactggagcccggcgcgggacgagcgggagatgggggc

SEQ ID NO: 4011 - DNA, 551 bp, Hordeum vulgare
gtctccccgggcctgcaggcaattcggcacgagggtaagatcctcgtcgctggaagccacgctgacgacttgggcaaccagtgcggaggatggaccatcacatggcaaggacagaccggcaacgacaaaactgccgggacgacgatcctttcggcgatcaagtccaccgtcgaccccagcacggaggtggtcttctcagagaaccctgacagcgccgccgttgacagcggcaagtacgactacgccatcgtggtggtcggcgagccaccgtacgctgagacgttcggcgacaacctgaacctgacgatccctgcgcccggcccctcggtgatccagaacgtgtgcaagagcgtcaggtgcgtggtggtgctcatctccggcaggccgctggtggtggagccgtacatcagcgccatggacgcgttcgtcgccgcgtggctgcccggctcggagggccagggcgtggccgacgtgctgttcggcgactacgggttctccgggaagctggcgcggacgtggttcaagtcggcggaccagctgccgatgaacgt

SEQ ID NO: 4012 - DNA, 547 bp, Hordeum vulgare
  UNSURE (4),(9): n stands for any base
catncgctncttttcattgctatacaaataaccccaaaacgcaatgtatgtatgtatcccatctttcacagtcacagcccaaccgatcgagacacatcccatctcacccgactcacttcttggcctcggtggtgaggccgaacccgaaggggaagagcgggtcgtagtgcttgtcgccgacgttcatcggcagctggtccgccgacttgaaccacgtccgcgccagcttcccggagaacccgtagtcgccgaacagcacgtcggccacgccctggccctccgagccgggcagccacgcggcgacgaacgcgtccatggcgctgatgtacggctccaccaccagcggcctgccggagatgagcaccaccacgcacctgacgctcttgcacacgttctggatcaccgaggggccgggcgcagggatcgtcaggttcaggttgtcgccgaacgtctcagcgtacggtggctcgccgaccaccacgatggcgtagtcgtacttgccgctgtcaacggcggcgctgtcagggttctctgagaagaccacctc

SEQ ID NO: 4013 - DNA, 545 bp, Hordeum vulgare
  UNSURE (30),(39): n stands for any base
gtcccccggctgcaggattcggcaccgggnatatttggnttctgtctattacctccactggtaaaggatcttactggtcaatcacaaaagcatatgcaatttatcaaagtatgcaatctgagcaaaaggatgaagctgcgagcgagaatttatcaaaaaaatctccgggcagccctggcaaaatacatgcttcgacggttagttctttaccagaggagatcctgagcaaattaaaaagagtagttgttaacaagcgaaagaccaaaattgagcttcagaagtcaaaaaagaggaagcatggtttgctaaagaactctaaaaatttaaagggaaggccaaaggaaaagaaaaagatttcaaaggaaaggaaaaagcgaggtggttgtgctctacttgctcgtggatcaaatcaggaggctggaagcagcaatggatttgctccatatgaatggaaacgcacagttttctcctggttgattgatctggatgttctatccgtcaacgctagactgaaatgcatggatgaaagccgctcaaaagttctg

SEQ ID NO: 4014 - DNA, 557 bp, Hordeum vulgare
gattacgatttactcgcagcagcatggcaaggctttccccccatataattagtatcttacagacatgaggttccttcttctggttgcaaaagtgcaaagctattgacagggtaataacaactaaaatccactatgattcacggcgccgttggccttcgacctttaagttaaaaactccccaaaatacacagaataaaaactatcatccccgttctacctgctgaggacaccacacagagttagatatggtcggggtcaataacttctaatactgcacactgcacaggctggtcaccaagccctgtccgaatcgaattctggccaaaacagcgctggtctccaaaaacgcatcctttcaggttttttttctggaagcagatgcacggcaggccgagttaaaacaaagtaattaaatggtttcatcatccacgtttgtcccttgcaaagcaggctgcgtcgtcttgtcagaggctaaaaagatctggaggcgaggctcgtcaatctttgcaagtgtcagcatcttctttgctgctgttcaagtgatccatgacctccga

SEQ ID NO: 4015 - DNA, 547 bp, Hordeum vulgare
gactaggtcctgattatttattttaagaatacaatatacacaacgctcatattcgataggttaattcacagaaacaacacccaggagcaacgggtatcatcgaaagttgaaaattcgtcactcatgctacatataaattacatggtagattactcgtacagccatctcagcccaggtggaaaggaaactgaggtggacgaagtgaaatatacacattcctgcagcttgctactttactctgatttcttttcctctcccctccatggggttagcatgttcgcaaccgcatgatacaccaggctggccggtgcaacttgttactcgtactgaatagtacgcttacatgggctggaagcccttcagccgttgatgtggctcaccatccacagtggaagcgccgtccggagtgggacctgaggctgcactgccacatcctctgccctctcgcctgccgccgctgggtgattgctggtatctgcgacagggggagcatccctcatcatgaaggaagaagaagaagagctggtttgaggctgagtttgatctt

SEQ ID NO: 4016 - DNA, 726 bp, Hordeum vulgare
  UNSURE (30),(710): n stands for any base
taaggtcctgatttatttattttaagaatncaatatacacaacgctcatattcgataggttaattcacagaaacaacacccaggagcaacgggtatcatcgaaagttgaaaattcgtcactcatgctacatataaattacatggtagattactcgtacagccatctcagcccaggtggaaaggaaactgaggtggacgaagtgaaatatacacattcctgcagcttgctactttactctgatttcttttcctctcccctccatggggttagcatgttcgcaaccgcatgatacaccaggctggccggtgcaacttgttactcgtactgaatagtacgcttacatgggctggaagcccttcagccgttgatgtggctcaccatccacagtggaagcgccgtccggagtgggacctgaggctgcactgccacatcctctgccctctcgcctgccgccgctgggtgattgctggtatctgcgacagggggagcatccctcatcatgaaggaagaagaagaagagctggtttgaggctgagtttgatcttgctgcgccgcctgggccttctgcttctccacaagttccttctggagaactttattctcctcctgcagtgacctctccttcttctgaagctcagaaatggattcgtgcataagttggttcttcctggctctgatatgttttcagtgagctttccagctgctgctncagttgctgcaactcc

SEQ ID NO: 4017 - DNA, 519 bp, Hordeum vulgare
gctcttcgggcatggctattcaattctgctagtgagagagtcgttgctcgacttagacaggacttgttcagtcatctcataaaccaggaaatagcattttttgacgtgactagaacaggagagctcttaagcaggctttctgaagatacccaaattataaagaatgctgcaacaacaaacctttcagaagcactgcgtaatctgactaccacagctattggtcttggcttcatgttttcaacttcatggaagctgacattgttggcacttgtaattgttccagtgatatcagttgctgtgcgtaaatttgggcgttttcttcgtgagctttcacatcagacacaagctgcggctgctgtagcttcatccatagctgaggaatcttttggtgccattcgcacagtaagagcctttgctcaggagcctcatgagatttcacgatatggcggaaaagtaaacgagacactgaagcttggtctcaagcaagctaaagttgttggactattttctggagggctt

SEQ ID NO: 4018 - DNA, 554 bp, Hordeum vulgare
tccctagaaagacttatatttagaaacggagggagtcaatagtatcatatgcatgatactactatacgatactctccactatgaccagccttacagtgcattcagatacagcggcacatgtgaatcaaggtgtaggagagctacagcgtgtgacattccatctgttggcgttatccagagtggaatacgtatatatcagaatgtgggttacatatgatggatcccaacgaaatggtgtctgcctaaccgaggaggagagagatcaccaggcaaggaaacactattgtcaccaggcaaggaaacactattggccattactgctgggttctacttcggctgtcccgttggtggccccttcaaacttgggcaactgcagctgcctcttcaccagggccgtgtagataccgtcgcgctcgaggagctcgtcgtgcgtgccgctctccacgatctgcccctcggagatgacggcaaccgtgtcggcgctcttcacggtggagagccgatgagctatcacaagaaccgtcctccctttcatcaacgagtccattgcatcc

SEQ ID NO: 4019 - DNA, 516 bp, Hordeum vulgare
caccccccgaactccaaaccctagtagctgcgccgccgccgccaggtaagaggcgagatggtgtccggctccggcgtgtgcgccaagcgcgtggtggtggacgcccgccaccacatgctcggccgcctggcgtcgatcgtcgccaaggagctgctcaacgggcagcgcgtggtggtggtccgctgcgaggagatctgcatgtccggcggcctcgtccgccagaagatgaagtacctccgcttcctccgtaagaggatgaacaccaagccatcccacggccccatccacttccgcgccccggccaagatcctctggcgcaccatccgcggtatgattccgcacaagaccgcgaggggcgaggccgcgcttgccaggctcaaggcgtacgagggtgtgccgccgccgtacgacaggaccaagcgcatggtcattcccgacgcgctcaaggttctgaggctgcagcctgggcacaggtactgcctcctgggccagctctccaaggaggtcggatggaac

SEQ ID NO: 4020 - DNA, 556 bp, Hordeum vulgare
  UNSURE (11),(14),(37): n stands for any base
tgttacttatnagncaccggctgattataacactttntattagtactttgtttattacagaagttgaggggaatcccaaagtacagttgtacactaagatttttaatgtagctcaggaaatcgctaaaacacccacaacaggccataacaaggggctgccaaggctgtagtgaagagaaacggctacagcaccatataatcacctgatagacattcacaagaatcttcaaatgcacacatttgataaacgaaacagttgaccaagtagaaaatttcaaatgagggtagcagaactgcatgcataacaaaggtttaccaaccaggttgtactaacacagagttaccaaactacttaaagacaagaggaggacagaggtttcccaaaactgatggcgcacaaaagctctgatctctcttagtatttgatcggggccaggatctccagctgagttcccaacttctcctcggctgccttctcggccttgacgcggagcttcgccagctgctttctcctgtcgtacgagaccttggccttctccttcctcttttcctccag

SEQ ID NO: 4021 - DNA, 517 bp, Hordeum vulgare
gaaccccccagcccaggggcggccgccggcgatggtgagggagctgcgcatcaacaccgcgccccgcggcaaccgcgtcccgctcctcaacaacggggagacgtccaggatcctctccgacctcgaggagggcagcaacgtccaggttcgccgccccacccactcactcacccactcccctgttctagcgccacaacggtttgctttgctttctccatggaccggagcttcagctacaaccatgaccgactattaaatccatctcccctttttctccccgtctaatcggaatcctctcaggcggccaacgtcggcttctgccgggtcatcaagttggcaaaacatgacgccgggaagctcgtcttcgccaccatcgcgctgctcgtcgcctctctcagtaacctcctcgttcccaaatatggcggcaagataattgatattgtgtcaagagatgttcagcggccagaggataaggctcaagcactggcggatgtgaacggcacgatattgtacatcg

SEQ ID NO: 4022 - DNA, 477 bp, Hordeum vulgare
taccatcgtgttcgcgttatacagagtggaatacgtatatatatcagaatgtgcgttacatatggtggatcccaacgaaatggtgtctacctaaccgaggaggagagagatcaccaggcaaggaaacactattggccattactgctgggttctacttcggctgtcccgttggcggtcccttcaaacttgggcaactgcagctgcctcttcaccagggccgtgtagatgccgtcgcgctcgaggagctcgtcgtgcgtgccgctctccacgatctggccctcggagatgacggcaaccgtgtcggcgctcttcacggtggagagccgatgagctatcacaagaaccgtcctccctttcatcaacgagtccattgcatcctgaacaaggtattcgctttcggcatccagggcactggtagcttcatctaagagaagcactcgtgggttcataagcaaagctcttgcaatggcgaccctc

SEQ ID NO: 4023 - DNA, 519 bp, Hordeum vulgare
taaaggatcaagctactataaccaaacttagcatactgatgaacacagtgatctctggtcaagaacccgagaagcttgcttttggtttcttcagcacagatggcaagtacatggaatcactgctgacagcaaacaagaggacagatgctgagggtaagatcaccggcgctctttgctttttgcatgtgcccagcccggagcttcagcatgctcttcaggtgcagaaaatgtctgaacaagctgctgcacgcagctttaaggaattgacatatattcgtcaagaattgaagaacccactcaatggcatgcaatttacccgtaagttgttggaaccgtctgacttgacagaggagcagaggcaactttttgcatcaaatgttctctgtcaagaacagttgaaaaagattttacatgacaatgatctagaaggcatcgaacagtgctacatggagatgaacactgtggaattcaaccttgaagaaactttgaatacggtcctaatgcaaggcatgtctctga

SEQ ID NO: 4024 - DNA, 540 bp, Hordeum vulgare
aagcgcacattttaatcttattcatcgctcactcactcgaagagttgcgtattaaaattacactaaaaacctaacagctcagctagctaagctcctcctcaaccatcaacatgggaacaatccatgttcccagctacacatatgatacatacatcagctaagctcttctagcaacccaaccaatgaccctggttggattcagaagttgctcttgctcgtcgaaggcttcgacctcttgctgttgagctgtgccaccgggaactccaccagaacgatgaacgaggagctctctgcttcccggaggtactgtaccgtgccgctcatcgtcttcacgagcttctggcttatgtgcaggccgaggccttctcgggatacccctgggccgtggcggaacatctcctgtatcagcgcctccgggacgcctggcgctgggtggacaactctgaattctagatgagcaatctgcatgccagaaccaatgtgttccttcttgggaatgacctggagtacaataggcccttcagctggccgagtaaattg

SEQ ID NO: 4025 - DNA, 521 bp, Hordeum vulgare
gagaaccatcaaggcgttctaacaggagaagggaagtgactgtttttgtggatattggtgctcctttgacatatgagaccgttgtacgcgctgctggcagttttaatgcaagcaattgcattggaagtggtggctttggagcaacatacaaagctgagattgcaccaggcattctggtggcaataaagaggctcgctattggaaggttccaaggtattcagcagttccaagcagaggtgaaaactcttggaaggtgtcggcatgacaatcttgtaacactcatagggtaccacctcagtgattcagagatgttcctaatatacaattttctgcctggtggtaacttggaaaggttcatacaagaaaggacaaagagaccgattgattggagaatgcttcacaaaattgctctagatgttgcacgtgcacttgcatatcttcatgataattgtgtcccacgcattctgcaccgggatgtgaagccaagcaacatcttgctcgacaatgagtacactgcatac

SEQ ID NO: 4026 - DNA, 550 bp, Hordeum vulgare
tgacactgctctgccaaaaaattacgcatcttctagtgtcggttgctacaagtgtaggaaacgatacgcacccttttttactagctatagtataataaaaaggcccatggccctgctttttttaatagaaagcagcaaggaaactatatactgttacaaaggccaagtcagccaatcaagcgatttttgataataatcgctgctccgggccgccgcctgaagaacggcgaggtttcccttcacttcagtgatcagccattctgccgcctcatccgtggagaggaaggcagcacgggacacagacaggacagggctttcctctgtgtttcatggatcgcgacagaactccaacaaaggccgctgaaccacgacgagcgatagttttcatctcgtctgcgatgcttcatcaagtcatgctaggtgcagcagaacttccctccgagtcccttggagcgacggtcgtttcagcggtaccagtatgccgtgcagtaacccaatcctgcacttggtactggtcaattatcgaatgtcccgaggatatgacatggat

SEQ ID NO: 4027 - DNA, 321 bp, Hordeum vulgare
gtctctccttggttcttcagatcgtctttcagaagaaaggaaaggaaaaaagaaaaaggaggggaggggggagagaagagatgaaggaggcgacggcgtcggggggcggcgcggccgcgggggcgaacgacccgaggcagccgacgacggcgaggccctacgcgccgcccaagctgtcgtcgcaggacctacccgtcgactacgcgggcttcctcgccgtcgtcttcggcgtcgtcggcgtcatgctccactacaaggcgtgctcgtggatcgccatcatcttctgcgcgcagtcgctggcgaacatgaagaacttcgaga

SEQ ID NO: 4028 - DNA, 347 bp, Hordeum vulgare
tttttttttttttttgatcaatgtgctcaggtaggcaaaggcccttcgactatctttataaaataactggaagaacaagaccgtgcaaataaattatactgagcatcatgatacatgtcttggtccctaactgatgaggtggtacatttgacgcgtgcccgactcaaggattcagaaatgcgatcaccaccatggcaatagcttccgaggcaccgaaattttaacaggaaacttcatacggcacatagtctgcagattagcgctttgtaccacctggacgaggcccaaaatagtttgtcaccaaacccatgacagcaaacatgaaagccatggagagctgcttgagg

SEQ ID NO: 4029 - DNA, 519 bp, Hordeum vulgare
atttcttgctccgaatgaagcggctgcatctcaagagcatctcctcctgggaacaatcactgggttggacaccagtggagaggaaggatcttgctgtgtctatgatagccatggaataaagacccatgtaattgttaagcacaggacactgatggttaaacacatgcactggtatcaatttggagatgaagtttcaccctgtgagtgtcgatgtagcagggctcgcttgccacccagcaggttttggctttttgagccacggtgttacatgcatgacactggtggttggtacatcgagacatttgggagagacaagaaagggaggacaattccatcaccgagacagtggcatggtgtcaatgagcattctgaaaagagattgcatccagcactgtatctggtggctctggcatacagatctttagatcttgaggatgctcaaagaagaaaatggagctttaggactttcttagagctgcagttatctcatattcgtcagtttggcaaaaaaatctttag

SEQ ID NO: 4030 - DNA, 549 bp, Hordeum vulgare
gtaattttatttttgactggtctatgttgtctttcattgtaaagtctacttcgttcttgataactatcagatacaagatcctcttttgatgtcttttctaaaaaagagagcctgatcacacttacaagcttgcaactgtagcctgcatatatatatcagaacggataaatcaaacaagaccaaaagcttccaatgtaaattagcgccgaagtactaccgcttgccagaagacaatggttgggtactctccccagtgaagccagacagatttaaaagaagttttgtaaacatatatccatatgcatcagacaaactaaggaaaactgtctctgtagtcttcggacaatggttaaactgaaaatttgtaaatcaactatgctgggacctttctgttaaaaaaacctatgctccgatccattactgtacccaaaagcagaaggcgaagatactttaagtggaccggcataaaagaaaagacagtttttcatcaggtggagctcaattaattgactcaaacattaacaatctatcaagcatgtgtaggtctgt

SEQ ID NO: 4031 - DNA, 201 bp, Hordeum vulgare
aaattcatccagcgagcgagggcgccctctccggtctcccccccgagcgcacctcccgatccgcttccgcccgtggccggcggtttcctccccccgcttcactcgctgggcagcgaccggcgcgggggtggagatccctccgagattgggccgatttcagttgctggttgtttcggatttgcttgctgcctgcgcggcgcg

SEQ ID NO: 4032 - DNA, 309 bp, Hordeum vulgare
ttttttttttttttttagccaaatgattacttttccagagccttttataacctctcccaaaaaaattcaatatacaccatcctccatccatccctactcgaacgagaacaggccatcatgtccggagcatggacacgacgaaatctaggctcgtttcccctcaccggcaaggcaatggccggcccgatggagctcgtcaccagagctgagccctctccctgatcatgttggaaatggggtgccagcccgtgagccacggcttcttggccgccggcgacgcgaagttgagctcgaacatctccttgctga

SEQ ID NO: 4033 - DNA, 382 bp, Hordeum vulgare
gtgcccaaaactgagcaaaacctcaaagcgaagacgagagaaggtcgctacctagggcaatggcggcgccgccggacagcaagtctgataaatccccagaggagctcctgtgcgcggcggcggaggccggtaacgacgatgctatcgccgagcttatttcctctggcgctgacgccacctactttgacgcctccggcatgacaccactcatgcgcgcggccaccggtggccacgtcgctgccgcgcgactcctgctcgatgccggcgcgccctggaacgcgctctctcccgaaggtctctctgcgggtgaccttacctccgaccccgccacatacgacctgctcctcgaccacgccctgcgctccgagctcatcctcggcac

SEQ ID NO: 4034 - DNA, 359 bp, Hordeum vulgare
ttttttttttttttttccaggggagttgtttcatcggaaccacaatccatacacaatcaggcaggcaggcgtgacctgatcctgaacaaacgcacaacagcgaacagctaatacaatcttgaccactattaagtaggagcactactggtagtaacacagatcgagtaccccagtagtgagtggctggtaacacagatgctactccgattcaaaatctgcctggcagacggggaggtggtaggtgtcgagctgccagtacttctgcttcaccccctcccacacctcctccttgaggcagtccttgacggggagggggatgaactgcgtcgagtacccgaggctcgccagctccagcgcca

SEQ ID NO: 4035 - DNA, 519 bp, Hordeum vulgare
  UNSURE (7): n stands for any base
tccgagnatgtcaagccccataatgttatgattgatcatgatcttcgaaaacttcgcttgatagactggggcctggcggagttttaccatccaggcaaggaatacaatgtccgtgttgcttcaaggtatttcaagggacctgaacttctagttgatttgcaagattacgattattctctggacatgtggagccttgggtgcatgtttgctgggatgatcttccgcaaggagccattcttctatggccatgataaccatgaccaacttgtgaaaattgcgaaggtacttggaacagacagcctgaatgcttacttaaagaagtaccaccttgagcttgaccctcagcttgaacatcttgttggaaggcacagtagaaaaccctggtcaaagttcattaatgctgataaccagcatctagtatctcccgaggccatagattttctcgataagcttcttcgctatgatcaccaagataggctcactgctcgtgaagctatggcgcatccatacttccttcaa

SEQ ID NO: 4036 - DNA, 554 bp, Hordeum vulgare
tttcacccgatgtttggcatttccaaatacacacattaataatgttacacatttgtgtttcaaaaacagtacaaaataatcgcaataaaaaatgaccatacatttgactattgtaactcttaacaacacaagtaaactgttgggtcttaggactgcccaatgcaggcaatttacttaccctgttacacaaatggtggcatgcatgccaccacattcatcgaccactatcactggagtaaacagagtgctctgaagtttacaaatagtacaatgttacaagctcttacagcatagcgactcaaaccgccatctcagtgcataggacggatagttggatcaagttgccatcgtgacagttccatcatgtgatgatcagtaacaattagcaactgctccactttgcacggtgcacactcaatgtcattgcggtcgtgccctgctgttctccgctgctctcacttgaaggaagtatggatgcgccatagcttcacgagcagtgagcctatcttggtgatcatagcgaagaagcttatcgagaaaatctatggcctcgg

SEQ ID NO: 4037 - DNA, 544 bp, Hordeum vulgare
gtctcccgggctgcaggaattctgacaggtccaaacaaacaaatggagtgacccccagcgttggatccgattttgtaatcctgaattaagtacaatcatttcaaaatggataggctctgatgactggatcctgaacactgataaacttgcaggactgaagaagtttgctgatgatgaggatctacaatcagaatggcgtactgctaaaaggaataacaagatgaaggtagtttcgctgataagagacaagactggatatattgtcagcccagatgcgatgtttgatgtgcaggtgaaaagaatacatgagtataagcggcagctgctaaatatccttggtatcgtttaccgctacaagaagatgaaagaaatgagtgcaaaagatagaagaaagagctttgttccaagggtatgcatatttggtgggaaagcttttgccacttacgtgcaggcaaagaggattgtgaagtttatcacagatgttgcagctactgtaaattatgatcctgatattggagatttactgaaggttgtatttgtccca

SEQ ID NO: 4038 - DNA, 554 bp, Hordeum vulgare
tcatttgcactttatttattattacagatacaccaaagtttgtttgtttgatgattctgctccaacattattcggcgaaattcgcacactataagcccgggtgacactggctaaccggcatgcaagtttgttaaagatgaactatcctgcatgctctcagctctcaggttcatgtcagagcttgcatatgcctatacaaaactgggcccaacaagaccctctcactgaggagtgaggcaaatctgtgacgcctcacagactcgaggttcctggaaactgcttgaattactcagggcatgatgacggggctgatatcccatatgtccttggcgtactcgtggatcgtccggtcactgctgaacttgggggaacccgctgtgttgaggatagacattcttgtccatagcttctgatctcggtatgcttcatcaactttttcctggcattcaatgtaactgggaaaatccttgccaacaagaaaataatctgcacgtccataaccttcatttccttccaaagaacccattaattcatcatagttgctagtcccaaag

SEQ ID NO: 4039 - DNA, 355 bp, Hordeum vulgare
  UNSURE (185): n stands for any base
ctaagtccgcctgggctgagcatcgtaaggatatcaatttgttgcgtctttgcgctgcttccaccaacccagactttaaagcgcccggccattaaggcacataactgggtgtgagccaatggcgttggaacaggtgaaactattgctcggtgagaacataatctttgttcactttgggtgagcancaggtaatggtgtgttctaaactttttggttaatggaccgcgcgtgtgagataagcgctgaggtcggggtggtggacggacacggggagattacatggttgccattctggtgagtatttctacacgtagtgcatgactacaatatacagtacggaagagacacgtgattc

SEQ ID NO: 4040 - DNA, 549 bp, Hordeum vulgare
  UNSURE (24): n stands for any base
gtgccaatcacttgcctttaaatntatcgtgtcctgtttacaggggttcactcgacctgctcgcctatgaggtcgaggcctactaacaagaaggagatgccctggaacagcaggaagtagaagtgtataccctgtttcgtcagcaggctgcgagcggcggccgtcagcaggagcagcgacagcgccagctccttcttgtatatccggttgtgcttcttctgcttcttcccttccttcttcgggctcggctgctcctttgacaccaccaacgcgtccaggttcggcgccgacccggtcttctggtggtgccgcagctccttgggcggcaccgccaccgccgccagggagatgaggtcgccctccgacgaccggcccgacttcttggtcaccacccactcgtaggcgctcccgagctggaacaggcccgagatcatggcgttgaacttggtcaccgacatggtgttctcgaagagcaggtatgggatgatgaatgggaacgactttggtgacggcaggatgttgagcagggacatgagggcaggtatgtag

SEQ ID NO: 4041 - DNA, 518 bp, Hordeum vulgare
ctgctgtgactgtacctctgctccacaaatcctatctagctgagccgcggtccatcccttcgaaatcaatgtatccaacatttgatgttggtgaccggattctcgccgagagggtttcatatattttccgggagcctcaagttttggacattgtgatcttccgtgcacctctagtccttcaggcattgggctacagctcaagtgatgtgttcatcaagagaattgtggccaagggaggggacatcgttgaagtgactgatggtcaattattagttaacggagtagtccaagatgaggactttgtgcttgagccacccgattatgaaatggatccagtgagtgtgcctgaaggctatgtgtttgtgctgggggacaacagaaacaacagcttcgattcccataactggggaccgctttccgtgaagaacattcttgggagatctgtgcttcgatactggccaccatcgaaaataacagatacgatctatgaccatgatgtggttcatgacatggcaatt

SEQ ID NO: 4042 - DNA, 485 bp, Hordeum vulgare
aacagatcaacagactctccttttgccaaacataacaaaatttccatgcgctgccatggatgctcatttgacagacgagccagacctttggttacagtacaagaattgttgcctctaaacaagcatctgctgttacggcagggaaaaactgagagtcagccaggcattacgtgcaaggcgacatcaatcaaataaatagctagaggagaagaaaaaatgcagcagagaacatcagtgatgctctgccaataaaaaatggggcggtttgaaattgccgcaccaactgcgtgtctcaggagatgcctgcaattgccatgtcatgaaccacatcatggtcatagatcgtatctgttattttcgatggtggccagtatcgaagcacagatctcccaagaatgttcttcacggaaagcggtccccagttatgggaatcgaagctgttgtttctgttgtcccccagcacaaacacatagccttcaggcaca

SEQ ID NO: 4043 - DNA, 552 bp, Hordeum vulgare
gtctccccgggcctgcagggaattcggcacgaggtaaaaaagagtttgtttgtggggtctcccgcgcgcgctcggcgatggcgaactcgttcctctcgatgaagacgggcccggcggccggcgcgtcggaggcgtcgcaggcgctgctcgagtcggacctgcgggagctgaccatggcggcgcggaagctcgccaaccacgccatcgtcctcggcggcggcctcggcttcatcggcacctttctccagtggctcgccttcgccgccgccgtatatctcttggtgctggacaagacgaactggaagaccaacatgctgacgggtctcttggtcccatacattttcttcaccatgccttctctgctcttctcctttataaggggggagattggtagctggatcgcgttcgttgttgtggtcctgcggctattctttccgcgccacttccctgattggctagagctgcctggctctctgatcctcctgacggcggtcgcccccagcatcttcgcggacaccttcaggggctcgtggctcatcatcggcgtcgccg

SEQ ID NO: 4044 - DNA, 541 bp, Hordeum vulgare
aatagatataacacatcggttgtacgcaaccatcatacgaacatgcatgagaagaacttgccggcagctcatcacttcaatccacccagcgatcaacagagcagacgtttttattgatgttatgtacgcacagatcaaggaaacaaattaagcagtggcaccaaatggaaacatcgccgagacagttcatcaaacattcaacaggtacaagctcgcatgggttcatcgacgccaaatcactttatcaatcgtcgcacgatgagcgctgaaacagcgaccgaggaactgcaggcacaagcctacaggaaccacatcacgatggcccagaccgggtagatgaagagcaggaggatgccgatggtgttggaccatccattggccttctggaaggcctccttgaggcctcctgacgccttgatgtgctcgtggagcaggtagcacccgatgaccaggcatacggcgacgccgatgatgagccacgagcccctgaaggtgtccgcgaagatgctgggggcgaccgccgtcaggaggatcagagagc

SEQ ID NO: 4045 - DNA, 542 bp, Hordeum vulgare
gggactgcaggcaattcgtcacgagggttgactgtggtttccaaatgcttaagatttagattctagatattgagcatagttgaatgatgtaacgcctttcctcatttgcgcaaggaccaatatattatcatgatacgtacacaagttcagtcaccaaatttcacagggaaaaaatatttttctctttggcgtacattaggtgcagctatttggaagaatgatccaaattacgctgctaacttcattaaggttgatctgtagaaatagatggtttcagctgtatatacactaaatgagtaaattttggtgcagcttttcttcttctgtacctgatgggatacatgcaaatcataaacatttgataaatatttagtcgtctgtctgaacttctatactcgaaatgtgcaggagtatctgcaagggaatccaatgtgggtggagtattgcaagatccccctggcgactctagggtttgagaacaactacgacgtcttcgtgaaagttcagggaggcggcctttcaggccaggcccaggcgatctg

SEQ ID NO: 4046 - DNA, 543 bp, Hordeum vulgare
  UNSURE (8): n stands for any base
attgcttntacttcagaaaaaaacgaatattacaaatctgtggcgtccagcacagaacaaagacaggagatggccttttttaagtggggaaagatggcgcagaaacgactctaacaacaaagaagcatcccgattaacgcttggagaactgggggcgcttgcgcgccttcttgagacccgccttcttcctctcgacgacacgagtgtctcttgtcagcaagccttctgacctcagggggactctgttggcggggctgatcttcagcagcgcacgcgccacgccgaggcagatcgcctgggcctggcctgaaaggccgcctccctgaactttcacgaagacgtcgtagttgttctcaaaccctagagtcgccagggggatcttgcaatactccacccacattggattcccttgcagatactcctgcacatttcgagtatagaagttcagacagacgactaaatatttatcaaatgtttatgatttgcatgtatcccatcaggtacagaagaagaaaagctgcaccaaaatttaactcatttagt

SEQ ID NO: 4047 - DNA, 394 bp, Hordeum vulgare
acgccctccgccgctcacgcctccattctccgcgagatccgagcctactccgctccgccgacgcaactcaaggcaagagctttgaatctagttgaaggaaaacaaacaaacaacagccatggcatctcgtttttggggacagggaggcagtgactctgaggaggaggtggacgagattgagtcagaacaagggagcgatagtgaaaaatcagaagctggtgatgggggtcgtgatgtgtccaagaaccgctatttgcatagagaggacagtgacgactctgatactgagagccatcgtgtgattcgctcgttgaaggacaagcgcaatgatgagatgaaagctactgccgaccagatgcgcaatgcaatgaagatcaatgactggcttagcttg

SEQ ID NO: 4048 - DNA, 406 bp, Hordeum vulgare
ttttttttttttttaggacttgaaccgctataaatcgcaacaaaatcagccacaagtccattctaaacaaaaaaagtaccactgcatagggtaaacctttttgtcaaatgtaggagtgtgcacatggtcctcgctcccacaatgcaaaacagaaaactcggtttgagtttattcagatcaaaagctaccaagaaaaaaatagcaaacagattcagatcagaaaactcaatttgagtttcctgacaggttcagaaccgtggaggatttctaatttatggaagaaaactagtgcctcaaaacttctttttcctaatggagtgcttcaaaacttgatgtgctctgatatgtctactgtatgtatgctccttctaatctctacctgctcaggctcaccatgcgtgcaccc

SEQ ID NO: 4049 - DNA, 514 bp, Hordeum vulgare
cggacgcagccacagcgctccgctcccccccgaaaaaaagagaacagcaacgggaagaataatcttcccccgtccgcgtgcgatcgacgcggagccgccgcccacctctgccccgaccccatggccttcatgcgcacctcctccaatgcatcctctggcatgggagttgctcctgatatcagggagacattcctggagcttcagatgaagaaggcatttcgctatgttatcttcaagatagaagaaaagcaaaagcaggttgttgtggagaagacaggggctacaactgagagttatgatgatttcctggcttgtctcccagagaacgactgcagatatgcgctttatgatcttgactttgttactggggagaatgtgcagaaaagcaagattttcttcattgcctggtcccctgacacatcccgcatccgagccaagatgctgtactccacctccaaggaccgcatcaagcaagagctcgacgggttccactacgagatccaggcaactgacc

SEQ ID NO: 4050 - DNA, 554 bp, Hordeum vulgare
ctaaaaaacactgagtttagggacatacaagtacatgagagataagccatggtaacaagtcaggtcatgcaacggaacatgacaccaaggagagcattcaggagaatccaagcctagcaaaccagtattaataccacaacacatgcgtttttgggaggtgtttcttgcgtttacaggctccgacatcatacgagtagagacctcggacaacacttcatcagctagagccatgcataacggccgaatgatacgttttgcaggaaacctggatatatctgtcttattaacaacactgtggcagcagcattaccacggatggcatgaatttgcatccgactgaagcccacaggtgatcatcgatacgccctagtgcgcccggtcacggaggacgtcgagctccacctcggtcgggtcagttgcctggatctcgtagtggaacccgtcgagctcttgcttgatgcggtccttggaggtggagtacagcatcttggctcggatgcgggatgtgtcaggggaccaggcaatgaagaaaatcttgcttttctgcacattct

SEQ ID NO: 4051 - DNA, 523 bp, Hordeum vulgare
ctgcagtgctctaaggatggatagcggtgctgcggaacctgcttaacaggggcaatctggtcaacaccgtcggtggagccgagaagcatttctattgggaagcagatattctgcaataggtcactcaacatgaggaacatcaccgcagtaggatttgatatggactacactctcgcgcagtacaagcccgagacattcgaggcccttgcttaccatggcactattgagaagcttgtgaaggatctgaactaccctgtggagctgttgacatggcaatttgactggaaatacatggtcagaggactagttcttgataagaaaagaggaaatatcttgaagatggaccggcacaagtatgtaaaagttgcataccatggatttagggagatgtcgaaggaagaaaaagttgctgcttatggaagtacattgataagggattcctttgatgaacctgattatgcccttatagatacacttttctcactgggtgaagcctatctgtttgctcagcttgttgatttca

SEQ ID NO: 4052 - DNA, 533 bp, Hordeum vulgare
tagattatttactttgaaagttggaatgatcaacattgaacattggtttcattcgccccatgttagaacatgttatgtacaaaatgggaaacccgtgtaatttcctatgagcaactctagtatataaacatgtggaaatgggtgcagtttcaccaagtataaacctcatccattgtgtgaggatgtaaacaagttattcagtaccatgctaaaattgtgcccctatcttgcttgcctacacctcaaaggagaactccgattctgcatgagcacaaactagtactacaggccaagcacatcgaactcatggggcatgtaatcttcgctcggacggtaatacttgttgggagaatacaacccaaagtctgtaacttggctgcagtataggcacgcaaatctctcgacctgatgagcaaaccgagaattttggtacccagtcttcataagctgtccccacaccttgtgaaacttctgatgatgttgcatctgagcatctcggagaaggcagcggatacccttcagcttttgcagta

SEQ ID NO: 4053 - DNA, 519 bp, Hordeum vulgare
ggtcaagcatgatggactgggcccaagcaaggaacaagtgatgaagatcctggacccgaggctgtcgaccgtgccggtgcacgaggtgatgcacgtcttctacgtcgccttgctctgcaccgaggagcacagcgtgcagcgcccgacgatgcgggaggttgtgcagatcctgagcgagctcccaaagccagctgccagccaaggtgatggagaggaagagcttcctctctcaggcgacggtcctgaatccaaccctcctgctccaaccagttcctctactgaagcaccgacaggcaatgcaaaagatcatcagcagcagcacacaagctcggagtcgtcgcctcctcctgatctcatcagcatctgatcatccaaacatgcgggtgcaagcctaggcctgaatctagggtttgtggagtgaaagaatttgttgctgtgttgtacatatccaagctgctttcgtggtggggtgtctaagacttccagtttggtgtgtgtgtgtgtgtgtgtttggtactt

SEQ ID NO: 4054 - DNA, 542 bp, Hordeum vulgare
aggttctattctggactggaccgaaggcacttgacattttaatggctactactactactactgccagtactacatatgcacaagggaaagatcatgaaatgctctactactagagtaccttgactacaccactatagaagccctacgctacaagcagcaaagcaaagtaccaaacacacacacacacacacaccaaactggaagtcttagacaccccaccacgaaagcagcttggatatgtacaacacagcaacaaattctttcactccacaaaccctagattcaggcctaggcttgcacccgcatgtttggatgatcagatgctgatgagatcaggaggaggcgacgactccgagcttgtgtgctgctgctgatgatcttttgcattgcctgtcggtgcttcagtagaggaactggttggagcatgagggttggattcaagaccgtcgcctgagagaggaagctcttcctctacatcaccttggctggcagctggctttgggagctcgctcaggatctgcacaacctcccgcatcgtcggg

SEQ ID NO: 4055 - DNA, 519 bp, Hordeum vulgare
gggaacccgcgaggacgacaagcgaaggctagagcagctaattcaggcaggggccaacgctattgtgatcgatagctcgcaggggaactccacctaccagcttgatatgataaagtatgccaagaagacgtttccggaggtggatttgattggaggcaatgtggtgacaattggacaggcacagaatttgattgctgctggagtggatggcctgcgtgttggaatgggctctggttcaatttgcactacccaggaggtttgcgctgttggtagaggacaggccactgctgtttacaaggttgcatcatatgccaaggatcagaatgtgccagttatagctgatggtggtatttcatactctgggcatattgtgaaggccttgtcactgggggcatcaactgttatgatgggcagtttcttggctggcagccatgaggctcctggggcctatgaatacaaggacggccaccgagtaaaaaagtacagaggcatgggctccctcgaagccatgacaaaggg

SEQ ID NO: 4056 - DNA, 542 bp, Hordeum vulgare
acatcgcctttattgttacagccttcccatgtccatgttttcaacccatagcgatggtgggagatagatgatgatgcccatgttacaaccataatagtagtggtggatccataggggagggacagccccacggtcttctctgcagccaaccttggatggaacacacagaaaaccagtatgccagtcctcgatttaaagatggggctagaatgatttcttctcgtacgacactagcccgtggatgcctccctccacttgagctgcgccggtcctcacctctaatcgaagagtctcagctcgtaaaagatcatgagctgactgcaaagaggatgcaccaagatcttggaatccttgtttaacagcttgcattgtgtacggaataaacctcagaacagaacctttgtcagctaccgctccaacaactccctgggcaactttaagcttcagagtatcaccaagataccttgcatcgctcccctttgtcatggcttcgagggagcccatgcctctgtacttttttactcggtggccgtccttgtatt

SEQ ID NO: 4057 - DNA, 518 bp, Hordeum vulgare
ctaattaatggtttacgtgttgccttcctctgcccattgccatccacagaactgagtgcggctctgattgattggggaagggtagaagatggttgtccaggagttcgccgtcgatctcgacaagcctcttgttttccaggttggccatctcgaggaacactaccaggaatgggttcaccaacccatcgtcagcaaagaaggtccacgctttttcgcaaatgataccatggagttcttgacacgcacaaagtggtgggctgtgccagtcatatggctacccgtcgtctgctggctgtttgccaagtctattctgatgggtcacaccattcaggaattaatccttatggccctgtttggagtgtttgtctggacgttgattgagtacagtttgcaccgcttcctcttccacatcgagacgaagagctattggtcgaacacagcacattacttaatccatggatgccaccataagcatcctatggactcgctcaggctcgtattccctcctgctggggcag

SEQ ID NO: 4058 - DNA, 545 bp, Hordeum vulgare
gaaatgaaagcgttgttgcagaatgtagctatttatcctagctaacacgaagatgaatcctctagcatcgactaccaagaataatagcccattggctggggatggaattttaaggccaatcgaacatcttcacaccggaacaggcatcagcttcgcacctaagcttgacctacaaatcctctctaaaactttctcatgcaaagaacacgtttacgtgtgtcaactgagcttcgcgacgatcttggacgaaggcaacgtcccgaaaacggcgtcccagagcgaagaggtgatgccgaagcccttgtcctgaattctgaaatggtggctgaggtgataccgcttgagatgctttgctggatctatggatggctgtccatggtgcaggtagtagtacgtgcaatcatacatcacataccccagcaggccaccggcgaatagcgcaggggtggtagatggactggcaaagaatgctacgacattccagaacggcacacataagatcgctgccccagcaggagggaatacgagcctgagcgagtccatag

SEQ ID NO: 4059 - DNA, 501 bp, Hordeum vulgare
aagtggaaactggattgacaccgctgaagagattgatgatttgttcctaggcgacgcagaggtttggaggaggccatccattggaactgccggtccatcgggaggcgacttcccgctggttaccaaggagggccatcacatacttgatgttatcttcacaaccccctttcttgatcttggaaaggtagcggaaggcttggagaaaatcgtcggcgttgttgaccatgggataatttgcaacactacgccgtatgctgtcatcgcgtcgaaaggggaggttcaggtattggatcgaaagtcatcggtgataccaaacacataaatctacagttgagttgcagagcagagcaaccatttcccctgcatttcgacgggagaatctgttgtgagctggctggaagaagaagaaaaaaatgcaatgagccaatcgtgccatagctattttttgtaccgacaacgttgctgtcggtaaaattctgtgtactatgtccaaagttttcc

SEQ ID NO: 4060 - DNA, 543 bp, Hordeum vulgare
tccattcgcattgaccacttgcataaacttgtgatttggaatctcagggtgcttacagagtcagcaattgcgcatctgtgaacatgctcatacatctggaggggaaaactttggacatagtacacagaattttaccgacagcaacgttgtcggtacaaaaaatagctatggcacgattggctcattgcatttttttcttcttcttccagccagctcacaacagattctcccgtcgaaatgcaggggaaatggttgctctgctctgcaactcaactgtagatttatgtgtttggtatcaccgatgactttcgatccaatacctgaacctcccctttcgacgcgatgacagcatacggcgtagtgttgcaaattatcccatggtcaacaacgccgacgattttctccaagccttccgctacctttccaagatcctggatgggggttgtgaagataacatcaagtatgtgatggccctccttggtaaccagcgggaagtcgcctcccgatggaccggcagttccaatggatggcctcctccaaacc

SEQ ID NO: 4061 - DNA, 518 bp, Hordeum vulgare
gaggttcgagaaggaagccgctgagatgaacaagaggtcattcaagtacgcctgggtgcttgacaagctcaaggctgagcgtgagaggggtatcaccattgatattgccctgtggaagttcgagaccaccaagtactactgcaccgtcattgatgcccctggtcaccgtgacttcatcaagaacatgattacgggtacctcccaggctgactgtgctgtgctcatcattgactccaccactggtggttttgaggctggtatctccaaggatggccagacccgtgagcatgccctccttgctttcactcttggagtgaagcagatgatctgctgctgtaacaagatggacgccaccactcccaagtactccaaggcccgttatgaggaaatcgtcaaggaagtctcttcctacctgaagaaggtcggctacaaccctgacaaggttcccttcgtccccatctctgggtttgagggtgacaacatgattgagaggtccaccaacctggactggtacaagg

SEQ ID NO: 4062 - DNA, 554 bp, Hordeum vulgare
  UNSURE (22),(23),(38): n stands for any base
gcacaaactactgtaatattanntggcatgaatcaagnctcatcacaaagcagtaaccacctctgcatgatagcagagtgaaattgcaaatgggaaagcaggtaatgcctatctattactagcattcaacacagactgaaaaccacaaataggataagagcacaataatagaatcgaaatagagtatttaaaagacacacaatagctcgcacacaggtgcaggagtcaaagtgcaacaacgcccaggaacaacacttaacatacactaagattctccaaaaaagactggacgctaaaacttctgctagataactggatggcagaagctggagcactcatttcttcttgatggcagccttggtaaccttggcaccggtgggatccttcttctcaacgcccttgatcacaccaacagcaaccgtttgtctcatgtcacgcacagcaaaacggccaagaggagggtaggtggcgaaggtttccacaaccatgggcttggtgggaatcatcttcacgataccagcatcaccgttcttgaggaacttgggcagcgcctc

SEQ ID NO: 4063 - DNA, 512 bp, Hordeum vulgare
tcggtacgcacgccagatcgcatgagcctccgagccggcatcgtcggcctgcccaacgtcggcaagtccaccctcttcaacgccattgttgaaaatgggaaggcccaagctgcaaacttccccttctgcaccataaacccaaacacaggcgtcgtggctattcccgatcctcgcttgcaagtgctctcgaaattaagcaagtccaagcagacggtcccaacatccattgagcttgtcgacattgcaggcctcgtcaaaggagcaagcaaaggagagggactgggaaatcaatttctttcaaacatccgtgaagtggattctatactccaggttgtgcgatgttttgaagatgatgatattgttcacgtgaatggaaaagttgatcccaagtcagatattgatgtgattaacttagaactcatattttgtgatcttgaacagatagagaagagattggataagcttaaaaaaagcaaaactaaggatccacaagtaaaagtgaaggaaggagc

SEQ ID NO: 4064 - DNA, 535 bp, Hordeum vulgare
ctataatatatctggcagagtttattaaagtgatttacaaaactcaccaaggatccaagttatgatgcagatctattaagtatctgcagatgttacatggaataaaatgattgtattttccttcgaaaatgcaacgatgccgagtacatgaacagttgatgcctcaaagacaaaatctgatggtctacccaaattttgccttgccttgtaagttcgtacgaaatttgagttgaataaagcttgaaacttcttgcatggtactgttgtcacacattgaatcggaagagcatgacatctccttcctgcacaatatattccttcccttccaacctcatcagtcccttctcccttgctgctccaagagaacccgccgcaacaaaatcatcgtaagatacagtttcagctctaatgaagcctttctggaagtcgctatgaataactccggctgcttgaggtgcagtcatgcctgaaataatggtccaagcttttgtttcctgctctccggtagtgaaataagttcttagtcccaaaaggt

SEQ ID NO: 4065 - DNA, 516 bp, Hordeum vulgare
ggtcccagagagatcgcggaggggaggaggatgacgggagggcgcgcggtgctcctgctgccgctgctggtgatctcggcgctgttcgcgcagatcagcgcgtcggatccgctgttccacgagtccttcgacgagagcttcgacgggagctggatcgtgtccggcaaggatgagtacaaaggtgcatggaagcactcgaagagtgatggccatgaagactatggcctccttgttagtgagccagccaggaaatatgccataatcaaagagcttgattaccctgttactttgaaggacaagacagttgtcctgcagtttgaagtgaggcttcagaatggccttgagtgtggaggtgcttatatcaagtacatccgtcctcaggctgtgggatggaacgccaaggactttgacaatgatactccatacacaattatgtttggtcctgacaagtgcggttcaacaaacaaggttcacttcatcctgaagcacaagaaccctaagactggcaaatatgtt

SEQ ID NO: 4066 - DNA, 520 bp, Hordeum vulgare
cttccttggagctaagcacgttcagccatgggtaaggagaagactcacatcaacatcgtggtcattggacatgtcgactccggcaagtcgaccaccactggccatctgatctacaagcttggaggtattgacaagcgtgtgatcgagaggttcgagaaggaagccgctgagatgaacaagaggtcattcaagtacgcctgggtgcttgacaagctcaaggccgagcgtgagaggggtatcaccattgatattgccctgtggaagtttgagaccaccaagtactactgcaccgtcattgatgcccctggtcaccgtgacttcatcaagaacatgattactggtacctcccaggctgactgtgctgtgctcatcattgactccaccactggtggttttgaggcaggtatctccaaggatggccagacccgtgagcatgccctccttgctttcactcttggagtgaagcagatgatctgctgctgcaacaagatggacgccaccactcccaagtactcgaagg

SEQ ID NO: 4067 - DNA, 249 bp, Hordeum vulgare
gccagccagcagcgagcgagccccctcccccgcaaccaccaccggaccccggcgaagcggcgacgatgagggagatcctgcacatccagggcgggcagtgtgggaaccagatcggggccaagttctgggaggtgatctgcgacgagcacgggatcgacggcacggggcgctacgcgggggactcggacctgcagctggagcggatcaacgtctactacaacgaggccagcgggggccgcttcgtgcccc

SEQ ID NO: 4068 - DNA, 550 bp, Hordeum vulgare
ttgtgagcgacgactataataacataatacttggtagaacttacaaggaggcgacgactagctcaaggagagcactcgacagttgaggccgtcgtcaggtaccgaccaaaggatgctgaacaagacagactgcaacgcactactaaccgtagcaaattacaaaacggggcacacgacgcaacctcgactcatccaagccacggggaaaccacaaactctcactggacacgacctgaagcggtggacatatagctgcacggagcggagcggagcgcatccgttgccgctactctgcgtcgcgttcctcttcctcctcctcgtcatactcttcatcggcggtcgcgtcctggtactgctggtactcggcgacgaggtcgttcatgttgctctcagcctcggtgaactccatctcgtccatgccctcgcccgtgtaccagtgcaagaaggccttcctcctgaacatggccgtgaactgctcgctcacccggcggaacatctcctggatggacgtggagttgccgacgaaggtgcccgccatcttcaggcccct

SEQ ID NO: 4069 - DNA, 348 bp, Hordeum vulgare
tgttgagatactcgaccgctatttcggcagtgtatgcgagctggatttgatattcaacttccacaaggcctactatgtactggatgagattctcatttctggtgagcttcaggaatctagcaagaagaatgttgcaagacttattgctgcacaggattcgttggtggaggctgctaaagaggaagctggctccatcagtaacatcattgcccaggctacgaagtaaaagcctgcgtctgatgatgcccctccgctctttggtttatgttcatgttggtaaatttgatgtaatagctccgttgatgtatccattttcctcccaaagaaacacgacttcctggattcgga

SEQ ID NO: 4070 - DNA, 299 bp, Hordeum vulgare
ttttttttttttttttttttttttttttgagcacaaagaatgagctgctgaattatgatcacgaatttacaaatatttcttaatatatccactaaacagattactggcgaacaatctccatgataattttatcttgaagtgtcccaaattcagttgcaaaggaacacacacacaacgtagttacatgacactcattctgaacaggtccgaatccaggaagtcgtgtttctttgggaggaaaatggatacatcaacggagctattacatcaaatttaccaacatgaacataaaccaaaga

SEQ ID NO: 4071 - DNA, 514 bp, Hordeum vulgare
gtacaactttgcgagagcctttgcaagaatggcaagggcaatgagatgtgggagatgtttagagtgcttttggataagggctattgcacgagtgagagggagtatcatttggtggtgtcattcttgggcaaggcagggaaggtcagagaggcatatgatgtgataaaggagataaaaaggaagaagctagatcctggcatttcatcatacaattctctcatggtagcactctgcagaaatgacctccttaggcctgctaagaagctgtgggatgagatgttcaccagtgggtctagtccaaatctgcagacctacaatatacttataacaaaatttgcagatattggtgaaagtgaacaagtccaacagctgtttgatcacatggtccagaaaggagtgaccccagatagtacaacatacacatcagtcattactatgttgtgccaagaaaacaaatatgaacaggctgaggagatcttcaacaaatctgtagcgcaggatcctaaactagcta

SEQ ID NO: 4072 - DNA, 559 bp, Hordeum vulgare
  UNSURE (34),(35): n stands for any base
ctcatttttctgcattaatggcgcctcaaggttnngacctccaatagtctcaagacagttcgggcattcttggcaaaatggacaagcggtattatgatatgaccattgaaactatggttcaagcataatcatcttctatcaacttcatccatgggccaacttcattaacaagcccctgagaatgtaaataacagaccaacttcctgacaggttgaaggctagcagaagtggaaagagaagccatgagttcattcattatattctgaaaagcagagctgcagtagcgtctaatccacattatgtgctcagaagccatttctatttcctcaacatctgttaggcacttcaacagaatgacatgtgaattcgagctctcaatagtggatggcagacttgacataacacccaatgctgctttgaagccaccttgtttacagagtacaataataaagacagttaacactgaactagctagtttaggatcctgcgctacagatttgttgaagatctcctcagcctgttcatatttgttttcttggcacaacatagtaatgactga

SEQ ID NO: 4073 - DNA, 370 bp, Hordeum vulgare
atgcatgcaaacaaatcactagcgagccgcatacatcacatcacaaacgaagcgcggcacgcaatggcgccctcctcgtcgtctccactgccggcgtctccgctgctcgtgctgctgatggtgccgctcctgctcgccatggcgcgtccgtgctccggcgtggacgccatcggcacctactgcgctaagaacggcaccagcgcggagacgcaggccagcatcgaccaggtcctcgcggcgctcgtcccgcgcgcctcggcggcgtactacgccacggccaccgccggccgctcctcgtccgcggtctggggcctcgcgcagtgccgcggcgacgtcccgcgtcaggactgctcgctctgcctcgccgcgg

SEQ ID NO: 4074 - DNA, 449 bp, Hordeum vulgare
tttttttttttttttttttttgcattcaactactttcaaataagtaattactctaggtaggtagtggctttgcaaatatgaaaattacacgatggcggtttgcgcgaaattatattttcacgagcaaacatgtacacaaacaaacacaaggcttggattcaaggctagctacgagctagccatacactaacaaatggattcgccaccaccaccaggaccaggtacgcacaacgagctggagtgccctcgtagatagcaccgtagttgactacacgtagtttgtactccacaaacaaatacatcacgcgttcaagacaatcttgtcgcactgtccgacctcgtcggccgacttgtcggcgccgtcgagcgggaagaagaaggggtacacctcgtagcgcgccatgcagctgctgtagatcacgcggcacccgcgccggtaccggcagtag

SEQ ID NO: 4075 - DNA, 526 bp, Hordeum vulgare
ggcacgaggttcggttctggtgtctccgacctgctccgtctccgcctccggcatcggcacggtgtcccaaggcgacgagatcgccgtgagatccagcgccgccgccgccgccgcgtccgctagcccgtcactgccttccgccgccccctcttcccgctgcaaagatggggaggataccgtccctgaagaacttcaatgcgttcccgcacgccgaagaccacctgctgaagaagacttactcgggtgctatagtgacgattctcgggctaattgttatggtaacacttttcgcgcatgagctcacgttttaccttacaacctatacgatgcatcagatgtctgtagatctgaaacgaggagaaactctaccaattcatataaatgtgtcgtttccttctttaccatgtgaagtcttgagtgtggatgcaatcgacatgtccggcaaacatgaggttgacttgcatacaaatatctggaagcttcgtttggataagtatggccaaatcattggtactgagtacttgtc

SEQ ID NO: 4076 - DNA, 551 bp, Hordeum vulgare
tcccctttaaagttgatttatgctatttctatactgaggatatgcctttttcatggtacaagctaaatgtatcacaaagtatgttcatcagccacaagacatcgttagcgcctccattgcatcattgataacaaaactgtatacttgccactagtgccactctaacatgattaatcataagactaaaaccatatcttttaagttatagatgcatggactggacaaaacatgaaggcccgcaggggggtgaccgtgctttgatcacttggttgagacaacaacatcgtcgactactgacttgactggccacagggtagtaagtagcctccttcgctcagcatgggatgcccggttaccgcattccacttctaggttttgagctcgagatagactcaatgatcctgtacatccatcggtcgagcattcctgtcattgcaaatgtacccccaagaactgcacagaggcgggttatgaaatgtaggaagttccgtctttcttctctgatggtgactgtgattggtgagagatcatacaggaagtaaacggctggc

SEQ ID NO: 4077 - DNA, 889 bp, Hordeum vulgare
  UNSURE (12): n stands for any base
ggtgccccgggnctgcaggaattcggcacgaggtcgagtgtttttttttttttttttggaaacaaaattttttaccaattttttttggcaccctttttttttggccagcccaaccttcgggcaggggcgggaaaccaccggcggggcccgggaaaaccaaaattttttaccaattttttttggcaccctttttttttggccagcccaaccttcgggcaggggcgggaaaccaccggcggggcccgggaaaaccaaaatttttttggcccggccccgggtcgggtttttttcatcgaaaaaaaagccccggcgagggggcaccaaatgaccaggctgccccgggggaataaagctttttttcccagtggcggcaccaaacgggaaagctcgggggatccaaccccccggccggtggcagccccagcagaattggctttcaatggtggccggggggcccatgcaccacccatagggggcccttggcccgccccggggccgaaaacataaggcaaaagccggagagaacccgcccccttttgcttcaccacaaaattccctttcaaaaggggaaggagggatgccaacccgttttgtcaataagcgtacccccggagggcccgtgcccccccccggggtttgagggggcccgggaaaccaaacggttccgggggggcccggcaggttctggttttttttcccccggcaaaacaaatttgggttttaaggaggagtaaggttggatgttatgatggtttcaacctcttctgtcccttccccctgaatctggttggtggaaggttggacattggacacaggcttttaaccccggttttttttttttcaaaaacccgacgtccttgggcgccctattttaaaattgcacaaaccg

SEQ ID NO: 4078 - DNA, 543 bp, Hordeum vulgare
attttacaatttctttttgcaccttctctatttgtcagtacagacatcaggcaagtgcaggaaaacaacggcagtgcacgggagaaacaaaattattttacaatttctttttgcaaccttctctatttgtcagtacagacatcaggcaagtgcaggaaaacaacggcagtgcacgggagaaacaaaattatttttgcccggacacgtgtcgcgtcattttcatcgagaagaaagcgccggcgagagggcaacagatgagcaggctgctccgggggaatcaagcattttttaccagttgcagcagcagacaggaaagctcaggggatacgatcccacggccagttgcagccccagcagcatctgcattcgatagttgccaggaggaccatgcaacaaccatagcgtgcacttggtccggcccggtgccgtagacatcaggcgaaagccggagagaaaccgcacactcttgcatcaccacagaattccctctcagaatgtgaaggaaggatgccgaaccgctttgtcgataagcgtaacgccgga

SEQ ID NO: 4079 - DNA, 408 bp, Hordeum vulgare
ggaattcggcacgagggctgcgcttagacccggcgtcgcctctacttcaccgttagcaacgacgaggtcgcccgggtcgtgggcgggtgggaggcgcgggggctcgtggccgagtggaaggccatgttcgcgtgcttcgatcgggagaccggcaaattcagggacttcgataaggagggaacaatgaagaagtatgtcggagttccaggcatgaactcgatatgcaaatccctgtgtcaagaggatggtgtggtgggcaaatttggtatcactattggaaagatggattggctccaagataggagctcatggtcattggctagcttggatggcactgatcttggcagttttgattttgttgtggcaacaaataagaacatagcatcacgaaaagtttctgggctgaca

SEQ ID NO: 4080 - DNA, 471 bp, Hordeum vulgare
ttatacataatactatttaacaaccgatatcatccctataggggcatgataattatttttgtacaaaaaagtgcatttctttaaacgacaaatgcactcatagatacaaaccagcgaggaatcaagaagaattgatgacagtcaaaactcacaagtcacaaccctgatggtaagtttaaacatccaaggattttggaagctcctctcatgccactaagaacagccccttccacagttggacttgcgcagaaatctccacagatagccaacttcatgttcttttcccagacacacttatcatcaccgccaatagaaatggctgggaaagcaccaccccatctatgagctttcataaagacaggctgtggaatgttcagtcctgtagtctgaaattctctgaataattcctctgcaaccttagcaagggcatctgctgaaggttttctgggacccatactgtctattaccttg

SEQ ID NO: 4081 - DNA, 553 bp, Hordeum vulgare
  UNSURE (20): n stands for any base
gtacccccgggtctgcaggnaattcggcacgagggttaaaagtgtgtcagaggttgctggtggtcaactagagccatttccaaagaggctcaatgcagtaccacctcggatagcccgtggttttgtatccgggttctcagttcaaacatatcaggacgacaataaactctggcagaaacatgttaatgcttacaagaaaaccaatgacttgcttgatactggaaggtaccgcaacataatggacatgaatgcaggtcttggtagctttgctgctgtactggagtctccaaagctgtgggtcatgaatgtcgttccgttcattgcagatactaatactttaggtgtaatctatgagcgaggattaataggaatgtatcacgactggtgtgaagggttctctacttacccaaggacatatgacctcatacatgctaacggtgtcttcagtttgtaccagaacaaatgtaaatttgaagatatactactggaaatggaccggatcttacgcccagagggcgcagtcataatccgtgacacgattgacgctcttgta

SEQ ID NO: 4082 - DNA, 480 bp, Hordeum vulgare
agactcaaaactgttctgttattcagcttcagttcatgaatttctaagatacaacacgaacaaaaacaaacaaaaatacaacacgaaccataaatagaagacagagtactctcctctggtttatcgccggcttggtttcgtcagttctctacacgcggactaatgtgtacttgcaatgaacactgccagtgccagggacagagttatcctgaagagaagcgagaacaataatccagacatgttagcggcggctcttgctgtcggcagtccagtattgcttaactgcaaagaggatcttctcaggcacacgagggccgccctcatggtcggccagtgttgtctcccacctcatggcattggctactttttccacctttacaagagcgtcaatcgtgtcacggattatgactgcgccctctgggcgtaagatccggtccatttccagtagtatatcttcaaatttacatttgttctggtaca

SEQ ID NO: 4083 - DNA, 135 bp, Hordeum vulgare
tcccccgaccccgtcgtgcgcggcaagcccgccaccttcaagatctccgcctccacggataaaaccatcaccaaagggaagctggtggtagatgtgtggtacttcttcttccacgtcgattcagaaactcacgac

SEQ ID NO: 4084 - DNA, 409 bp, Hordeum vulgare
  UNSURE (25): n stands for any base
ttcataaaagtacaatgggacaaancatttaggtgcttgacagtgcggcctctatcttctcctcttgacagtgctgctgcctgggtggacagcgcgcgagcagcaacccaggacaggtcctccacggatggacgcccctgtcgggccatcacacgatgaatgccgcagcggccccaactaacaatcatccaaaacgcccatgattcgtcgaaagcaaccgccgaatccaaccacacaagtataaacacgcacaaccgacattcgacactcaggaaactggcaccggcagcaaatctgaataaaaagtctcagtccaacacatgctctctcactcggggtgattcagagttcacatagttctgcaggtacatacatacaaacgtggtgtgctctttgcaactgcaaccaa

SEQ ID NO: 4085 - DNA, 201 bp, Hordeum vulgare
tttttttttttttttttttttttttttgaggaaactggcaccggcagcaaatctgaataaaaaggctcagtccaacacatgctctctcactcagggtgattcaaagttcacatagttctgcaggtacatacatacaaacgtggtgtgctctttgcaactgcaaccaagggcgtgtttggtccgcggcacatatttggttca

SEQ ID NO: 4086 - DNA, 281 bp, Hordeum vulgare
gcgccacaccacagagctttgcctccgcagcgatggcgaccaaccgccgcctccgcgacctgctcctcctcgccgcggcgctcctgctctccgcctcctgcgccgccgccgtcgacttcgagtactgcaataagggccgccactatccggtgaaggtgagcggcgtggagatctcccccgaccccgtcgtgcgcggcaagcccgccaccctcaagatctccgcctccacggataaaaccatcaccaaagggaagctggtggtagatgtgtggtacttcttc

SEQ ID NO: 4087 - DNA, 937 bp, Hordeum vulgare
  UNSURE (870),(871),(874)..(909),(915)..(937): n stands for any base
gtacccccgggctggcgggattcggcacgaggggagatgcacgtagactagtctcgagttttttttttttttttttttttaaaaacaagcgcccgccccttgttaaagtctcaccctttaaaagagcccccaacaaagatttgcaaatggaggcccgattttttggcacaaacccgctgaggtccactccccaaacaaaaatctttgtttgaaaaaacccacaccagaagcttttctagggctcacaggttgaagacttaacaccatttttataaggggtacttactacctgaaaaacaccaaaacgggggggaagccccttggtgaaaagtgtgatttctttccggcttgtgaaaccctcccaaattttacccaacgtctcttgaagcctccaatgaataccccccccctttttttttctttgctcaatgataatgtttgaaacgccccccccgttgcccaggagttttgcactatggcccggcaaccaaaaaaagcgttttgtctgacaaaagcgcttggacatgttaaaaaaactgaggaggagctagttttcaacaagcaccccaaatttgaccacttggtttcaaagtcgtttaagaactgtcagagggcccttgctcagggccttaagagcacattgggctttttactacgactggctaagcagtattaaagtcctggggctttcaaaaaaccgaaatgggggccgaaatggggggggcaccctaaccgggggatttctcctgcccatttttttgggggcttcaaaacccaaaccgaacctggggccgcgaaatttgtggggggcgggggggcctcggccctcctggaaggggggggccccggcaccaatccgcctagaggttnnaannnnnnnnnnnnnnnnnnnnnnnnnnnnnnnnnnnngggggnnnnnnnnnnnnnnnnnnnnnnn

SEQ ID NO: 4088 - DNA, 542 bp, Hordeum vulgare
tccagcctaatttaaatctacacgtttaagatagcaccaacaaaactctgatatataggtccgaatctctggcaattaagccatgatgtccaagcaccagaaacgaaactctgattcaacaaaaccacagacgatgatgttcataggctaacaggtttcagacatgataacgatcttatcaaggctactagcatcctggaagacacggaaactggaaggcagtcccctagtgcgacttgacgtattcctgcacgatgtgaagaccctccgaatcttcaccatagtccttcacaacgacacatgagcagcccaccacctttcttgccttgccctcagagtcaatcttgcaaagcccagcccactcgccaagagttttggcactaggcacggtgaccaagtgaacgttgtgctcagcacagagtgccttgacaagcttcacataatcaggctggtcgcaatcctcagcaagcacacagatctgagcagcatgcttctcaatcgcttttgcagcttcacggagtcccttgacaaggccatcatga

SEQ ID NO: 4089 - DNA, 517 bp, Hordeum vulgare
cgcggccatcgccaagcagcagcagcagcccgcgatggcggcgggggacttctcccgcgcctgctccaacgtctccgtcctcttcggctgcctcggcatcgccttcaagttcgccgagatggactacgtcgccaaggttaatgatctactggaggcatccaagacgatttcgacattgccctccatggttgagcttgacattcagaagggcactgttaggcagccggggagccatacgaggaatctactgagggttaagcgtgggattgatatggtgaaagttctgtttgagcagatattggtcacagaaggcaactccctgaaggacgcagcaacaaaggcttatgctcaggtgtttgctcctcaccatggctgggccataaggaaagcagttggtgctggaatgtacgccctaccttccaagtcgcagctcctgaaaaaactgaatgaagatgaaaattcggcaagggctcaaatgcagagtttcgtcaggtcgtccggacaagtgattctctac

SEQ ID NO: 4090 - DNA, 525 bp, Hordeum vulgare
ctttctgcatatacattgcacggtagcatttcagtttaacagcttacagataagctggaatttcaggtttgtaacaatggctcccgtatccacccatccagaacctccacggcagcacggcttattgaatttacgttacaactccggactctcaaactcaaacaccaagaccagctacagttatttgagggcacggcacaccatccgatcgcatcagtacattggaagtctgtataggctttgctcaccagtctagtcctaaattactcgaggtgaagaggtcttcgacgtagagaatcacttgtccggacgacctgacgaaactctgcatttgagcccttgccgaattttcatcttcattcagttttttcaggagctgcgacttggaaggtagggcgtacattccagcaccaactgctttccttatggcccagccatggtgaggagcaaacacctgagcataagcctttgttgctgcgtccttcagggagttgccttctgtgaccaatatctgctcaaacagaa

SEQ ID NO: 4091 - DNA, 519 bp, Hordeum vulgare
gtgcaggggaagtggtgagaccatcagtgataaggatcgttgcgggcagtgcaagggtgagaaggtggttcacgagaagaaagtcctggaggtggtggtcgagaagggtatgcagcatggacagaagatcaccttccctggcgaggcagatgaagcgcctgataccgtcactggagacataatcttcgtcctccagcagaaggagcaccccaaattcaagcggaaggctgacgacctcttctatgagcacaccctgaccctgacggaggccctctgtggcttccaatatgtcctagctcatttggatggcagacagctgctcatcaagtccaaccccggggaagttgtcaagcctgattcattcaaggcgatcaacgacgagggcatgcccatgtaccagaggcccttcatgaagggcaagctctacatccacttcacggtggttttccccgactcgctgagcttggaccagtgcaaggccctcgagacggtcctcccgcccaagccggcatcgcagta

SEQ ID NO: 4092 - DNA, 559 bp, Hordeum vulgare
agtagttaatatattactatactagcaccaaaagggtaagaaccctaacatggaaaacttgagaaggacagaaacgaattcatctgctcactgacgatcacaacatcctgcctgactactgctgggcgcactgcaccctctgcccgccgccgcccggcatatcctcgtcctcgtcataggcctcctgcgcctgctgctgctgttgcctccgcatctcttcctcaatgtctatatcgtaggccatcgtctcctcgcactcgtctagctccatgtctgtgtactgcgatgccggcttgggcgggaggaccgtctcgagggccttgcactggtccaagctcagcgagtcggggaaaaccaccgtgaagtggatgtagagcttgcccttcatgaagggcctctggtacatgggcatgccctcgtcgttgatcgccttgaatgaatcaggcttgacaacttccccggggttggacttgatgagcagctgtctgccatccaaatgagctaggacatattggaagccacagagggcctccgtcagggtcagggtgtgctcatagaa

SEQ ID NO: 4093 - DNA, 402 bp, Hordeum vulgare
ccccaccttcccccagataaaacccctcctccccccctccccttcctcgaacatccgtccgtcggccatggccaccgccgctgcgtcccaggtggctttctccgcgcccgtcgccggctcggaccgcgccgtcaggagctccggaatcaagggcaccaacagtctcagcttcggcaacaagtcatggatcggcaccgcattggcgtgcgacggcaaggccgcactgcaacagaggcatgtctgcagggccgtccagcagtcgagcaagagcaaggtctccgtcgcgcccctcgacctggagagcgccaaggagccgccgctcaacacctacaagcccaagggcccttacacggccaccatcgactcggttgagcgggcggtagggccaaacgctccggggga

SEQ ID NO: 4094 - DNA, 522 bp, Hordeum vulgare
ggattttaagaacaaaggttcatgcttcatttcacgcatcatgagatgcagaagcttatgaattacatggaaagtcttatgatcctctcaaaaataatgtttggtaattttacaccatcacaagaatcatcccatgtgtgtgttctgccttttcctgacattgtctcatagcagagcgaattatagatagctgaacaattgccatcctagtaaacctcaacgtgccattgcttgttcttcttgagctgcgatagtttctgatcccagctctcccctctctgctctgccaccttcttgagcgtatcctgaatccctggcatcattcctttcaaaccacagaagtagatgtgtgcgcctccatccaaaagcttgaaaatctcgtcgctgtactcttcaatcttgtcctgaacgtacatcttgccaccactcttgttcttctgctccctacttagtgctttgtcaaacctgaaattgtctggatactgcttaaggtagcttgtgaactcttcgtcatagagaagg

SEQ ID NO: 4095 - DNA, 484 bp, Hordeum vulgare
gcaggggaagtggtgagaccatcagtgataaggatcgttgcgggcagtgcaagggtgagaaggtggttcacgagaagaaagtcctggaggtggtggtcgagaagggtatgcagcatggacagaagatcaccttccctggagaggcagatgaagcgcctgataccgtcactggagacataatcttcgtcctccagcagaaggagcaccccaaattcaagcggaaggccgacgacctcttctatgagcacaccctgaccctgacggaggccctctgtggcttccaatatgtcctagctcatttggatggcagacagctgctcatcaagtccaaccccggggaagttgtcaagcctgattcattcaaggcgatcaacgacgagggcatgcccatgtaccagaggcccttcatgaagggcaagctctacatccacttcacggttgttttccccgactcgctgagcctggaccagtgcaaggccctcga

SEQ ID NO: 4096 - DNA, 545 bp, Hordeum vulgare
ttaatatatccatatactagcaccaaaagggtaagaaccctaacatggaaaacttgagagaaggacagaaacgaattcatctgctcactgacgatcacaacatcctgcctgactactgctgggcgcactgcaccctctgcccgccgccgcccggcatatcctcgtcctcgtcataggcctcctgcgcctgctgctgctgctgcctccgcatctcttcctcaatgtctatgtcgtaggccatcgtctcctcgcactcgtctagctccatgtccgtgtactgcgatgccggcttgggcgggaggaccgtctcgagggccttgcactggtccaggctcagcgagtcggggaaaacaaccgtgaagtggatgtagagcttgcccttcatgaagggcctctggtacatgggcatgccctcgtcgttgatcgccttgaatgaatcaggcttgacaacttccccggggttggacttgatgagcagctgtctgccatccaaatgagctaggacatattggaagccacagagggcctccgtcagggtcagggtg

SEQ ID NO: 4097 - DNA, 381 bp, Hordeum vulgare
ccacttgctccgctcgccacaatactagcggttaagtaactaaccccttcttcctcccttgtccactccgcttctccccatccaagaaacagcgccaacagctccacccatcgaggagaatcaagaaaccgcgccggcgtggtgatcaaggacatccatcgatcgaacgaccgaccctgccttgcctgagtcaacccggcggcagccatgaacaacctcttctcgagctcgtggaagcgggcgggcgcggggggcgacggggacctggagtcgggcggcggcggcgtggagatgacggcgccgccgggcgccgcggcgggggcgagcctggaccgctccttcgaggacgtggagtcgatcaaggacgacctgcgggagctg

SEQ ID NO: 4098 - DNA, 296 bp, Hordeum vulgare
tttttttttttttttttttggaaaagtatatagtcatgaaataataatcgagtggctcaacgaaccacatggatggagtaattacaatcgcaaaaaattccacaaaagacaatcaacaacaactaccaggaagcaatccaggaccaggatcaccagagacagacaacagatccgcaggctgttcctaccactactgctggctcttgttgttgttgcttttgttggtgttcttgagcacgatggggatgacgatgatgactgatgacgacgagcaggatgccgatgccgatgaaggt

SEQ ID NO: 4099 - DNA, 403 bp, Hordeum vulgare
  UNSURE (378): n stands for any base
atttccccattccaccccaggagagggaggagcgagaggcgccacagcgggcgagagaggggagatgcgggaggaggtcaggagctcgtcgggggcggcggccgagccgcaggtcgccgtcgtccggtcgtcgtcgccgccgcccaccccggtggccagttctgctggtgcctcatcacctgctatgcaaattaatatagtaagcatagattggctgggtaacagacaggcttccagggttgattcctcatcacacgttgcaccacatgcctatgggcctgctcatagctttgatgctgctggaactgctttggattctgcaccatcttgtagaccatgggagcgtggagacttacttcgtcgactggcaacattcanacctttcacttgggatgctaagccg

SEQ ID NO: 4100 - DNA, 336 bp, Hordeum vulgare
ttttttttttttttttgggggcgaaaaacaatcaattcacttgcaaaattctgcaaatgttccttttggaacgagggatgacgagttgaatcgactcttcggatataaagacagtaaaatcactggaacaacatgtgcaattccatgcccaccatatggggcaacaatctacagactagctgaaatggtgaaatggattattaacttgttttcttcctccgatgacaaacctaatttacgaagggtacgtacagcaggcagcagcactgcatgtaaataagcacccggatgcgccaatctggagaacttggccgaatgccatgcatgtttgggaag

SEQ ID NO: 4101 - DNA, 553 bp, Hordeum vulgare
gtcctcccgggcctgcagggaattcggcacgaggacgcccacctccgcaccgacgaagcttcccccccgcaccaccagcccggggaacccatcgagaggcggcggccgctccgggagcgagggatcgggaggaacggggccaggcgggggctcggagatgtcgacgccggcgaggaagcgcctgatgcgcgacttcaagcgcctgcagcaggacccgcccgccggcatcagcggcgcgccgcacgacaacaacataacgctctggaacgccgtcatattcgggcccgatgacacgccgtgggatggaggtacgttcaagctgaccctgcaattcacagaagattaccccaacaagccaccaactgttcggtttgtctcaaggatgttccacccaaacatctatgcagatggaagcatctgcttggatatcctacagaaccagtggagccctatatatgatgttgcagcaatattgacctctatccagtccctgctgtgcgacccgaatccgaattctccagccaactccgaagcagccagaatgtacagcgag

SEQ ID NO: 4102 - DNA, 554 bp, Hordeum vulgare
aactagcaaggttgcaacaaacttcttagctatatataaaatctttaaatggctagcatgccttagttcaccaaacaggtcacacgcactgaaaaaacaacaggagatcaagcacagggacacaacggccatgggttttttaatgttttagttcggtggtacagaccagcaaagccagaaatggagacgttccgggcatcgcttattgcaggacctggtgacgctagtccgctgtccagctctgctccacgacctcacgcaccttgcggttgtactcgcgcttgttctcgctgtacattctggctgcttcggagttggctggagaattcggattcgggtcgcacagcagggactggatagaggtcaatattgctgcaacatcatatatagggctccactggttctgtaggatatccaagcagatgcttccatctgcatagatgtttgggtggaacatccttgagacaaaccgaacagttggtggcttgttggggtaatcttctgtgaattgcagggtcagcttgaacgtacctccatcccacggcgtgtcatcg

SEQ ID NO: 4103 - DNA, 519 bp, Hordeum vulgare
atgctgtgggtggaccaagcaccggccgaaaaccctagacaggtcatcgtccatgagcaggtcgcgcagaacctcaagaaattcgtggcggagcaggactgcccgcacctcctcttctatggcccgccggggtccggcaagaaaaccctaatcatggcgctcatcaagcagatgttcggcgccggtgtggataaggtgaagatggagaataagacgtggaagatcgatactgggacgaggacatttgatcttgagctggcgatgttgtcgagttcccaccatgtggaaatgaaccccagcgatgctggctttcaggacaggtatgttgttcaggaggtcatcaaagagatggccaagagtaggccgattgatgccaagggcaagagagcatttaaagtgcttgtcctaaatgaagttgacaagctgtcacgagaagcacaacattctctccgtaggacaatggagaaatacagtgcatcctgcagactcatattatgctgtaatagctcctcaaaggtg

SEQ ID NO: 4104 - DNA, 561 bp, Hordeum vulgare
  UNSURE (21),(22): n stands for any base
gtaatactagggtggggcgannctccacctttgaataccaaatgattcaaagtaaataaagacttgctcacatgaaatcagtacaaactacactgactgaataacatacagaatgtaaacacccacacatcagaccaaagcgattgcgacgacgaagactgagaactgggagcatcttcttgcagcagcaaacatccgtatgctctggttttcctcaaccaaatgcagcacaaaggaactccttgtaaatgctcatgaacttggccacgaaagcttccagatgaaaaatggccttggacccaagtcgcatcttgtgttcatagtgtgcagcccagtgacaaacttcatgcttcaaatcagagtctaacttcttcattaactcagttaacaacttcttcaagatactttcaggtgggatacaattcacaagtaactcgtagaatttctggcgtacagaatatagccttttagggctttgttcactcaagatttcagttgctatttcagacacatactgctcccagtcaagaggaggcgacacttgatttgctgaaaatggat

SEQ ID NO: 4105 - DNA, 517 bp, Hordeum vulgare
cctgaacccagtagcagaccagcgtatccattttatggtggccaaatctaccagggaaaacagcagaggccttctattggcaatcctacttcaactgattcaaatcctaaaagcaaggttcagttgaagaatcagaatactcaacctcttcctcctctgatgagtttacctaactcaccggttgcttcaatgtacgctggtaatgggatgtacaacagcaatgcctatggtggcttttggtatggatcccaattttatgggccaggaatgtatggtggatggaataatctgtcggatggaaaatacaagccccgagggaggacagcatatggatcatatggatttcccaatgaaaaccttgatggtttgaatgagttgaagagaggaccacgaagtggactctctaatatccaacagggctttggaccagctgctgcgacagctgtgaaagcacaggatgtttctgctactgatggctctaatgcagttgtgcaggatcagtacaaccggcctgact

SEQ ID NO: 4106 - DNA, 553 bp, Hordeum vulgare
ctctgaaacagacaagttacttcttgcaaaaccagtacaaatcaccacacctaggtaccatttcctaacaacaacaagataaaaaagacaacacaccaccaccaccaccaccccagatcaacaactgatgatctctatctcctaccaaccgaactcagctccaagatagagaaataataatacagaggggaaatctcaagagaaacctaaccatatccgtcgaactttctgcaaaaacacctacggaaccccaacagaaccctgattgcctccaacagttgaactgccgccccagcctcctccaaaactcccaagctgtcatgtcaccttactcacaactcaacagacaaaaaaatcagcagccatttgcaacagccaagcttgcggctgtggggttagcatctttcggggcaacaccagtcacggcagccgccaccacattgtcttccgcagcagatttttcctctccggtaacttcaggcttctgtgattcctgcgcattgccagagtcattttcagcattgtcaacagtaggcagcagcttcgggctcgt

SEQ ID NO: 4107 - DNA, 502 bp, Hordeum vulgare
tgttaatcttgatcatcgacaagcttgatgcacggacagcgacaatcaccactatcctttcgaagcgatggcgggatctctatacacactcgcacacatgttataaccttatggttgatgacattctccctccacggtaccacagactgaagcaaattgtggtggaggcagggtatgaggcagagaagaatgcactgaagtcggaccgcagtcatgcttctagagaccagttatattccttcaaatactggaagtggaaagtccgcctgctaacacccatcctgcagcgttatgagcgttgggccatgcgacgctatgttaaacgggtgaatgcattccttctgtctcccaacaatgttcagcggtgttctatccagaagctgaggtttcaagcctgtgggacgagctatttcactgatcaatggattactgaggcgattggcagatggggcgttgaagatttggagcttgtcattgacaactctttctggcgctatgactt

SEQ ID NO: 4108 - DNA, 548 bp, Hordeum vulgare
gctctcctcctctcgataataatcagcaaaagtaaagcacaagataccaacacaaacttccacatgttgttcatcttttagagccagcataacataatcattaggaggccatggcatacagctgcaatccctacaaacggaaggccaccagcacagcaacactcgtaccaaaagtcattccaaaactatttcgagatgcggccaactaatcccgtctgcgaggtctccgagcacctccgatctctcgcgctcgtgccactaccggcggcggtggcggcggcggaccatcccgctcttcgtcctcgacaacatgcccgtccagcaggtggacgcactccaggatcggcgacgcctgcatgacccgcttcacaaagcatgtctgccacgccgccccgtcgaagccgatgaccacgagctctttcaggtgattgtggtgctgatggtgttccgcttgcacatctgatgatcctgttgcgcccgccttctctgagttgtcgtcaaaatgaacatggagcgactccagggcaggtgcggcagcaagtaggtgg

SEQ ID NO: 4109 - DNA, 112 bp, Hordeum vulgare
tttttttttttttttttttttttttttttttttttttttttttttttttttttttttttttttttttttttttttttttttttttttttttttttttttttttttttttttt

SEQ ID NO: 4110 - DNA, 366 bp, Hordeum vulgare
  UNSURE (348): n stands for any base
aaactgcaaccaactttgggcattggctggcgcagtgtacggttgagcgttgagaagagcacccccagcagaaggtgaagttccagatgaccgcacaccacgacgcaccatggcagtcaagattcatggtggtagtcttcatgcatttcagacgaggttagctcggctgggaagcagatggtgttgccttgccttgctgttagatgctctggtctctttcttaggtaaactaaacggggcatatgaacgcgaagcctagctgcaccatatgactccatgtatatacacactgtctcactttgctatgcatgtatatacagatatcctttcttaaaagaaaggaaacanatgtggaatgtggagcga

SEQ ID NO: 4111 - DNA, 559 bp, Hordeum vulgare
  UNSURE (13),(24),(29),(33),(54),(92),(101),(106),(107),(123),(125),(132): n stands for any base
taacctcccgggnacttgctgggnaattncggncacggaggcggtaaacgtttntgcatggggcagggtattgggcaaagattgcctttttnattggatgnaaagnngcggttgctttgcggnanacacagnagaacttgaagatacattaactagaagaagagagattcaggaatacgacaatgtttgacataatttatgtgcgggaaactcatccactatctgctcatattgcattactgtatcagatgtactctcaacaaatgataacagatccttcctattgtctccccattgaccctgctgctagtggcggaatgaatggatttctttgtttatctcaaagaaattggtacagcatctctgtagaatctccagttaagggtttcaatggcatcaccaataaccgagttttgtaagtattataagatgacaaagcacattataagccaaattttaccataaaatctttcaagtgttatattcttctattgttttccaggaatgctacctatgttagccctcagtatcacaaacacatcctggagcctccagaggg

SEQ ID NO: 4112 - DNA, 552 bp, Hordeum vulgare
  UNSURE (13): n stands for any base
gtgatgtggggtntcaatacgtccttgccaccggcaagggtaattgtcacgcgcaaacagtttcagggttacagacatacaacagcagtggttgccctctgctgacatcctgtcctaacaactaaataaggctttatctaaatcattgtgctagatcattcggacgcgatacagcaggtcaacttcaatcgacctgatcaagaacagttcaactccattcagacgggatacatcgggtgcggcaatgggataatcaaattcatgtcgaccaacatagggaggaaccactatgtatggctgctttcagcaggagtatgttgagttgaatgaacctccttgtggcagcatgcctgtgcacatggaacacaaaagatcatcttggagtagttccgggttgccgattcttgatggtcatctctactccggcaagtcattgggagcttggcctttgacacggtacatcaccttggcggcctgatgtctgctctcatgctgtgacctcaggttatcctgctttggcttaggatgtctgtttgtcctcgggtcttgctt

SEQ ID NO: 4113 - DNA, 533 bp, Hordeum vulgare
  UNSURE (461): n stands for any base
agcaattcggcacgagggctgggccttcatccgcaagatctacgtcatcctctccgtgcagctcgccatgacggccgccgtcgcgggcttcgtcgtcaaggtccccgccgtctccgagttcttcgtctcctccaacgccggcttcggcctctacatcttcctcctcatcctgcccctcatcgtgctctgccccctgcgctactaccaccagaagcaccccgtcaacctcatcctgctcggcatcttcaccgtctccatcagcttcgccgtcggcatgacgtgcgccttcaccagcggaaaaatcatcttggaagctgcaattctgacagcagtggtggtgatcagcttgactgcctacactttctgggctgcaaagagaggccatgacttcaacttccttggccccttcctgtttggagctcttatggtgctgatgatgttctcacttatccagatctttntcccactgggcaagatctccgtcatgatctatggggccgtggcgtcgatcatctttctgtggctacatcatc

SEQ ID NO: 4114 - DNA, 544 bp, Hordeum vulgare
attaccaaaggcctcctaaaatgtaacaacttcgtagcaaggaattaaatttaagcgtcttccagtcacaacgcaccagtgagcctattttcatcatgcagacaaatggtcacacattgcatgccccaggaaactagttaacaagacacaggtagagtctacggacggcagaatttgctgataacgagtgtacatgcctacaggtatctgcaggcatccatgaattttctgatatgcacaagctagaggacttaaatcaagcggacgaggctcaggtgcgctcagctatcagccgcacgcagaatctgcatcagattcaggaacaggttgataatgtcgaggtagagggacacggcagcccagatgtactcatcatacgtgtagcgcttgatgatgttgtccgtgtcgaagatgatgtagccacagaagatgatcgacgccacggccccatagatcatgacggagatcttgcccagtgggaaaaagatctggataagtgagaacatcatcagcaccataagagctccaaacaggaaggggccaa

SEQ ID NO: 4115 - DNA, 544 bp, Hordeum vulgare
gtcctcccgggcctgcagggaattcggcacgaggcgcgccgttcaggtgccggactggttccttaacaggaagaaggactacaaggacggcaggttcacccaggtggtctccaacgccgtcgacatgaagctcagggacgaccttgagaggctcaagaagatcaggaaccaccgtggtcttcgtcactactggggcgtgcgtgtccgtggtcagcacaccaagactaccggcaggagaggaaagactgttggtgtctccaagaagcgataagcttctcaatgatcccgcatagctttgctaccattactgtgttggtccatttccagaatctgaaggagtgttcctgtttagacgattaccttggatgatgttttgccctagataatgtttttcggttctggaacctttaatatattgtatcttgaattcctcgttttgaactcctaaagagtttgtttgccatgggctttcgagtcatttcaatgtttggcaagagcatgtctatcagtgatactcctgaaggcctttctagtcatttcaaaa

SEQ ID NO: 4116 - DNA, 504 bp, Hordeum vulgare
tgactagaaaggccttcaggagtatcactgatagacatgctcttgccaaacattgaaatgactcgaaagcccatggcaaacaaactctttaggagttcaaaacgaggaattcaagatacaatatattaaaggttccagaaccgaaaaacattatctagggcaaaacatcatccaaggtaatcgtctaaacaggaacactccttcagattctggaaatggaccaacacagtaatggtagcaaagctatgcgggatcattgagaagcttatcgcttcttggagacaccaacagtctttcctctcctgccggtagtcttggtgtgctgaccacggacacgcacgccccagtagtgacgaagaccacggtggttcctgatcttcttgagcctctcaaggtcgtccctgagcttcatgtcgacggcgttggagaccacctgggtgaacctgccgtccttgtagtccttcttcctgttaaggaaccagtccggcaccttgaactggcgcg

SEQ ID NO: 4117 - DNA, 550 bp, Hordeum vulgare
  UNSURE (20): n stands for any base
gtctccccgggcctgcaggnaattcggcacgagggtcaaacctcaattagccgtgaagcgaaacggatacgtcgatccttagtttgtcagagtggttggacagcaacctttgacccaggtggcgtcagcataccttaacgagtgtgtttgatgttcgcctcagatcttgctacttgtctattaacagaaatgatctgcttagtttgggttcggttgctggagtgtgcttgttttgtaatctggtgtgcccacagaagtaagcagaagtggttcagacaaaaagagcaccgagcaaatgggagtagaatccactgaatgtcaatggcagcctaagcctttggtggtcttttctattgatgtgtagttggtgtgggttaaactgcagttgttccaaactttttgtttgagagattgttccaaatttgtatgtactccagacgtgtgggtttcttcagttagatatgctagagttgtagtgtgccggcctcactgagggcgatgtgttcatgtttgtaagatagtgaatggttgatccgttgaatctgcgact

SEQ ID NO: 4118 - DNA, 533 bp, Hordeum vulgare
ccaatctaattttgatttagcatcctgagaaaaacggtaccaatcacagtcgcagattcaacggatcaaccattcactatcttacaaacatgaacacatcgccctcagtgaggccggcacactacaactctagcatatctaactgaagaaacccacacgtctggagtacatacaaatttggaacaatctctcaaacaaaaagtttggaacaactgcagtttaacccacaccaactacacatcaatagaaaagaccaccaaaggcttaggctgccattgacattcagtggattctactcccatttgctcggtgctctttttgtctgaaccacttctgcttacttctgtgggcacaccagattacaaaacaagcacactccagcaaccgaacccaaactaagcagatcatttctgttaatagacaagtagcaagatctgaggcgaacatcaaacacactcgttaaggtatgctgacgccaccttgggtcaaaggttgctgtccaaccactctgacaaactaaggatcgacgtatc

SEQ ID NO: 4119 - DNA, 517 bp, Hordeum vulgare
ctcagcactgaagccaagaagaacgacatcgagctggtgctgcttacaacaccatctacaaagccagaaaggatgaatgagatcacagcggcttccgaagggtttctgtaccttgtaagtatcaacggattaacaggggcccgcccagatgtgaatccacgtgttaaggatctactcagagagattaagcaggtcactgacaaagcagttgctgttggatttggcatatcgacccctgaccatgttagacaggttgcacaatggggtgcagacggtgtgataatcggtagtgcgatggtgaagcagctgggtgaagcagattctccgagaaaagggttaaagaggctagaagtatacgccaggagtcttaaggatgcactgcacgccgtgatatgtacaatataggatatgtttacaaaatatcaatgaaccggaattgcgatggcaagttggcttggtgttcctagtaagaccagtgtggtggtagaagcaataagctatttcttatgaaaaaaaa

SEQ ID NO: 4120 - DNA, 496 bp, Hordeum vulgare
gcttattgcttctacccccactggtcttactaggaacaccaagccaacttgccatcgcaattccggttcattgatattttgtaaacatatcctatattgtacatatcacggcgtgcagtgcatccttaagactcctggcgtatacttctagcctctttaacccttttctcggagaatctgcttcacccagctgcttcaccatcgcactaccgattatcacaccgtctgcaccccattgtgcaacctgtctaacatggtcaggggtcgatatgccaaatccaacagcaactgctttgtcagtgacctgcttaatctctctgagtagatccttaacacgtggattcacatctgggcgggcccctgttaatccgttgatacttacaaggtacagaaacccttcggaagccgctgtgatctcattcatcctttctggctttgtagatggtgttgtaagcagcaccagctcgatgtcgttcttcttggcttcagtgctgag

SEQ ID NO: 4121 - DNA, 517 bp, Hordeum vulgare
caggaatgaagggattgatttaacacacaatcctgaattacaacagttgagttttatatggcttatgcagattacaatgacttgatggagcttactgaagccatgatatctggtatggttaaggagctgacaggtgggtataagatcaaatatcatgccaatggagttgataatccaccgatagagattgatttcacacctccctttagaaggatagacatgatcgaaggattggaagctatggccaaactggagataccgaaagatatttccagtgatgaaacaaacaagtatctgatagatgcatgtgctaagtatgatgttaaatgtccacctccccagacaacaacacggttgcttgacaagctagtgggccatttcttggaggagacatgtgtgaacccaacatttattatcaaccacccagagataatgagtccattggcaaagtggcataggtcccgacctggtttgacagaaaggtttgagctctttgttaacaaacatgaggtgtgca

SEQ ID NO: 4122 - DNA, 547 bp, Hordeum vulgare
  UNSURE (13): n stands for any base
acaaataccctgngctacaagctaagaggaagaggcagcagctctacatctggtgttgtccatctccatacaataagaaagcaatgcaactgttactgttacgacgagatctgaggaagtgtataacaataccaagtcctaattttgctttttcaattttcaaacagaaaaacaaacaaacatgcagcacacttgggctcctccgatgaatgttcccttcatatgcctcactgttcgtcctatccagagctcaaaatttcaacaacccttcgatcgcacaagtagctgacttgtacctccagtgctgctacacatgttctgtccagtgcaattaaaactccctgtattgtcaagtaccttcagctgatgggtttcatctttgcaaacagctactcttggggcttcatggccgggaacaggagaacttccttgatgttctgggaatctgtcagcatcattgtaaggcgatcaattcccaaaccccaaccacctgttggtggcagtccatactcgagggcagtgcagaatgtttcatccaaagccatag

SEQ ID NO: 4123 - DNA, 1764 bp, Hordeum vulgare
  UNSURE (499),(510),(616),(1014),(1141),(1325): n stands for any base
tagaaaaaaaatgataaaaaatcacgataacaaaataacgataacacattctagtggggcctcggataaagacctgtaatgttatacgggtgactcttcgccccactacgccacctgcgaacaggcaaggacggagagtccggattctacgaccatagtgaacaaagatatagagtgaagcaggggcaggagcatctgaaggtccgctctgatcggggccattcgtcgcgcgagaaggctacaggatgcgcgcgggaacagcggaggacaacggcgcgcagttgccctgtgcaggaccctagcgcatcgcatagcttgtatctgaaatccatgatactagaagcttcccaccctcctcccggcgcgccggaacgcgaactatctaaatgccgcccttcccaccacccagacgccatgagtgctaatactgacctcccacaatcccgaccagatatccccaccgccctgcgttccctcgtcgcagcatagtggcacgcgntggtaccgaangcacaacactaagaatcaccaccgcaagacagcgttacacgtgtctgctcgtaggtgagctcccgtctggcgtttgcacctccgcttttgcggattctcccgattntatgataagtatgaatatgtaagtaagtgtgtaataactattatgtagtaatatagatgattaagagtaacactactcgatcctccgcacaatctacgcgtcaacgccgcactcattagccgcttttcaaccctcatagagacgcgaccccactaacccacagatcgagaaagtgaaccacacacaagcaatacgcccagcacatagcgcccgacccgacatacaccataaatcataaatacagtatagacattactcgggcgcctcacacgagaaccttggtcctctagcaccgcatagcccgcgccagaacgctaaaccaacaaccggagaactacatcgatgactcgtcacctatgtccccacataatgaagacctgtctagcctccccgctctntctacgcgcacccagcgctaccagccacacaacacacggaccacagaccaccaacaacaattatgaagcgagacacgatacgccacaccggcgcacgaccggcggaaagtgcgcgggacgctgaccnaccccaagccagccccatctacatcaaacgaccacacgagaatagaccgcgcaacacataacccgctattctcgtagcttctctcatgaaactacgcacaagaccaacgatcgccccgtgaatacacagagagactgtagagacatctcaaacaccgttagcgatcgtattccgactccacccntgagctagtacacgtctctactgacaatgtaacctcaacacaccacgtcacagctcatcgtgtttgccgcccacgtcagatctgtccaattgcacatgatccaaccactacccgcgtagtacgtctgctattagagacatgcccgacgccgcgctctatgtatacatgtttaaggccaagtgatgtgtttcgtctgtcgtatatatatttatacggtctgttcacatgtaactgatgttgtcacagtctgtctcaacgtctctacgcgctacgcacgtctactcgtgtttgatgtggtacgcgtgacgatacacgacttacaacctgccgcgcgttcctcgctacgactacactaaattgttgcacgccacaacaaccgccacaggtgatgcctcgcacgctcagagatcacaacggcgtaactttacgcgacgcgagt

SEQ ID NO: 4124 - DNA, 544 bp, Hordeum vulgare
taaaacagacggcccctactaaacagttacagagactaggcagtagttaagtgaagctcctgcagtaattaacccgcagctccttcccccggttgaccggacttgatcgagtcaaccactgcactactccttcctcccgttgaccgcacttgactcgccgtcggcgtccctgaacttggcgtagatgtcgctgcggtagaacttgcgggtgcgccagacgagcacgagcgagacgagcgcgccggcgacggtgacggcggtgatgatgaggaaggcgagcttgaagcactgcacgccgatgcaggtcttgtcgccggcgccgtcgagcgtgccgccgtgctgcctggcggcctccacgtcgtagaggtaccccgcgacgcgcacgttgagcgcgtatgcgccgatggggcttgccacggatccgaagttgtagagcgtggagtagtacttgagcccgaacacctcggagatgatggcgaagagcagcggccactgcgccccgaagcagaacccgatgaccaccgacgccgcgtagagcgactgc

SEQ ID NO: 4125 - DNA, 512 bp, Hordeum vulgare
ggtcgtatgcccaacctcagtgcaccgacgcccagaccgggctgatggggaagacgctcctggttcagcccaacaagggcgacgtgcttccgcctcacaagttcgggacgcacgacgtggttgccctcaagccaaataaagcagatgctggatcccctgctcttgggcaaggtgtagtttatcgcttgaaggattcttccattaccgttgttttcgatgatattcctgaagatggattaaatagccctctccgtcttgagaagcttgcgaatgaggttacttaccgcaggatgaaagatgcactaattcaacttagcaagggcatccaagcaggaccttctgcaaaccttgttcctgtgttatttggagagaactcgcctatgcattccaaggacgccgtgaagttcagtccgtttaacaagaatttggacgactcacagaaacatgctatctcgaaggcactcagatccagggatgtttttttgcttcatggacctcctggaactggaaag

SEQ ID NO: 4126 - DNA, 541 bp, Hordeum vulgare
gttgtagatatgactattggatcaatctcataataaaaatcggtactacttgtactttgtagtctccgaaaataataataacaagaaactcataccaagagcaggagtcgacaaagtggctacaactgctacactccacacaacacggtgaacaatttaaccagatgcttgttcagctgtagcattctgtggcaatgtatgcatcggctgtgatttgcaccaacatgtccacttgtgttgtcgcatgttgcttgtttccggtgtctctgctgcagtggtcgcatagcgggcacaagagcagcgtatcatgctgcaacggtcagctgctctggtactcagacgcactcaggtactcgccgttctcctcgaagtactcaaccaggcgtttcaggaacctgtcgctgcttacggtctcggcatcgcacactacgcagcactgccgccttgctcgtgttacggcgacgttcatccgcctatggtcgctcaagaacccgacctctttcttttggttggatctgaccatcgaaatgattatggcctc

SEQ ID NO: 4127 - DNA, 543 bp, Hordeum vulgare
gtcccccggctgcaggattcggcacggggcgacgctctcctcgactgtccagtgaggacctcgtccaactcttccccgcgcgcgcccgaagaagttctcgaggggtctgaagaggaagccgatggcgctcgtcaagaagctgcgcaaggcgaaaagtgaagcccctgctggtgagaagcctgagccagtgaagacccacctccgcaacatgatcatcatgcctgagatgattggaagccttgtgggcatctacaacggcaagtgcttcaaccaggttgagatcaagccagagatgatcgggcactacctggcagagttctccctgtcgtacaagccggtgaagcacgggaggcctggtatcggtgccacccactcgtcgaggttcattcctctcaagtgagaatatggtcaggaaatttgtctgagatgtctggaatccagtgttcttatcgtagtcaagtgtagcacctgatataccgactgtcagtctagtggtggagcagcacccctttgaaccctgaactaatccttttccggattttg

SEQ ID NO: 4128 - DNA, 553 bp, Hordeum vulgare
ctatgttcgaaccttccttacgataacttcaaaatccggaaaaggattagttcagggttcaaaggggtgctgctccaccactagactgacagtcggtatatcaggtgctacacttgactacgataagaacactggattccagacatctcagacaaatttcctgaccatattctcacttgagaggaatgaacctcgacgagtgggtggcaccgataccaggcctcccgtgcttcaccggcttgtacgacagggagaactctgccaggtagtgcccgatcatctctggcttgatctcaacctggttgaagcacttgccgttgtagatgcccacaaggcttccaatcatctcaggcatgatgatcatgttgcggaggtgggtcttcactggctcaggcttctcaccagcaggggcttcacttttcgccttgcgcagcttcttgacgagcgccatcggcttcctcttcagacccctcgagaaccttcttcgggcgcgcgcggggaagagttggacgaggtcctcactggacatgtcgaggagagcgtcgcctcgtgc

SEQ ID NO: 4129 - DNA, 526 bp, Hordeum vulgare
gcacgaggcaacgccagctatcttcagcttcatggagatgatatttatttctcgttggaagatgagcaggaagataacactcaacatcaattgcaatctggaactgcgtttagcccaagcagggagaattcgatgttatctcaaaggcataagcgacatgatgagttacctggcacatggtacaagcaatatgctgaaaagttcaggacattgcatggcaagtttcgcccagatgacaaagaaatgccaaagagaacaccagagggcatgtctgactatcttaaggtttgcagtgtgcataaaaggaagaggactgtgtttattgacaatcagggtcccaacattatgttggaaaatggggaattcagtaatttaacagatgatcctttcattccggaaatacaatttccagctgactgtgttccagatattgcaatccctagagagagtgggatatctatcagcaataaaatagaagttcacggtgttcttgataatttaccagcacctgttagtcgcaacactg

SEQ ID NO: 4130 - DNA, 546 bp, Hordeum vulgare
  UNSURE (21): n stands for any base
tttttctttatttttgtagcntacataacaatggtattttgtcattgaaaatttacaagcttgtagacaacatccctgtgtgcatgtgtattttttacagaattctttgaaacttctaaactgtgattttgaattgtttaaaatatcaggctccacggagccagcccggtaaccaaaaatccacacttacaaccggaaattgctaaaacagatatgtttcataccacgaaaacacctgagctaataataacgtacacattacttataaatcacctcaattagtaagtagtataaatctcttgtatctacgatacacaggctggtcaaaacagatgagacggtagactcgcaagtacagcgaccatacgcccccttttgtacattacagagttacagtgtacattttcatcggcacaaggatggaggatctacttgggggatgtgagtttgctggtgtcgctggacgagtccccgctcaccagttcgtggaacgcctccaccttcaccggcggcacccgcatgccgtatgagttcatcgactgcggc

SEQ ID NO: 4131 - DNA, 444 bp, Hordeum vulgare
  UNSURE (432): n stands for any base
cttcaatacatgtcagcattaaaggcagtcgtgggcatggatcaaagcattggtcaccatatcattcaagcactgctttgatccatgccctacactactgtgaaagcctttataggaggtggcaagatgccgcgtgcgctcagtgcgcgggtaattgatgagacagagccgatatcagatgtctattctgctttctatgagttctcttcattgctagagtcgaagattgatgataacgacccaaatgctgcgctgacacggaagcgtgtagatgcaataaagaaaacttgcaagtcatctgggttgctaaagagaaggggatacgacctggagaagtcgaagtatagaatgcccatgctgatcatgattgcgctcctgttggtggctattatcctgggcgtgctgtatggcaagtgatccggtcaacatggnccttttgtgttc

SEQ ID NO: 4132 - DNA, 554 bp, Hordeum vulgare
aaaaatgtagcatcactggacaaccaaggcgccacgccaaattcataggatacatgttaccaagaaagtctctcctagattcaaacaaattacatgctcaaacaacacatgggacgacagaaataaagaacaaaaacaattagcatgcatggcaccagcagggtacatagcacaatactacatgcaaaccagccatatccatctgcagtcaggaggtacacatgcaaaaccatacaggcgaggcggtgccacgaagaacacaaaaggaccatgttgaccggatcacttgccatacagcacgcccaggataatagccaccaacaggagcacaatcatgatcagcatgggcattctatacttcgacttctccaggtcgtatccccttctctttagcaacccagatgacttgcaagttttctttattgcatctacacgcttccgtgtcagcgcagcatttgggtcgttatcatcaatcttcgactctagcaatgaagagaactcatagaaagcagaatagacatctgatatcgattttgtctcatcaattatccgtg

SEQ ID NO: 4133 - DNA, 526 bp, Hordeum vulgare
gcacgaggcattgtgcgacctcgtggccctgcacgggtcgccaccagcaacgctacgaggacgggcggcggctcgtcgccgggtgcataccattcaggtatagagttgatgaaacttctggtgatgaacagaagaaagccgttgaggttctcatgataaactcccaaagcggaccaggtttattgtttccaaagggaggatgggagaatgatgaaactgttgaacaagcagctgctcgagaagctatagaagaagctggagttcgaggagatatagtgcaatttctaggtttctacgatttcaagagcaagacgcatcaagacgcgtgctgccccgagggcatgtgcagagcggcggtgtttgcgctgcacgtgaaggaggagctggcctcatggcccgagcagagcacccgccggaggacttggctgacggtccctgaagccacgtcacaatgtcggtatcagtggatgcaagaggccttgctgacgggcttctccgagtggcatgacaactggagcaaaagcga

SEQ ID NO: 4134 - DNA, 508 bp, Hordeum vulgare
  UNSURE (38): n stands for any base
ttcacgccagcaccggcagctcgagtcaagtcactttntaattttcaggtctggtaaatacattgcggtatgcatccccagaatcaggagcaaggaatcaaaatcaagctgaatttcgagaaataatatgacgccgcgagaatcaggcacttaaaatttgtgataattctcgtcttcgatgagatataccactacgctaaagacttcaatcccaggaaccaagggtcaatgaccacctactaggcatcatcaagtaaaagcaccacactgtattattgcaatttgcgtgcaaggttggggcctagggaggaagaacaggcggaaagcgagagagggagcgtttagaccgggttgccgccgcccccgccgtcgcttttgctccagttgtcatgccactcggagaagcccgtcagcaaggcctcttgcatccactgataccgacattgtgacgtggcttcagggaccgtcagccaagtcctccggcgggtgctctgctcgggccatgagg

SEQ ID NO: 4135 - DNA, 518 bp, Hordeum vulgare
ccagatcgtggagcagctctgcccggggctcaaggacgaggtgatgaagatcacccccgtgcagaagcagacccgcgccggccagcggacccgcttcaaggcgttcgtcgtcgtcggcgacagcaacggccacgtcgggctcggcgtcaagtgcgcaaaggaggtggccacggccatccgcggcgccatcatcctcgccaagctctccatcgtccccgtcaggaggggctactgggggaacaagatcggcatgccccacaccgtgccctgcaaggtcaccggcaagtgcggctctgtcaccgtgcgtatggtgcccgccccgaggggttctggaatcgtcgccgcccgggtccccaagaaggtgctccagttcgctggtattgatgatgtcttcacttcctcgcgtggatccaccaagacccttggcaacttcgtcaaggcaaccttcgactgcctgatgaagacctatggattcctcacccctgacttctggagggagacgaccttcaccaagactc

SEQ ID NO: 4136 - DNA, 553 bp, Hordeum vulgare
taattattgtagcatccattttgacgataaaagaaagtagcatagttccacaaacaaaagcttagtacggcaaacagaggcatcctgaggcagcacgattcaaagtcttaataataactataataaaacaaagtgcattagacagctcccagctagtaaaaaccctttacaccgacatcctaagcttctatcttctcggctggtacatcatggatcagggccttggtcggtttcgccaagatgtcggtgaactcctggtacggagtcttggtgaaggtcgtctccctccagaagtcaggggtgaggaatccataggtcttcatcaggcagtcgaaggttgccttgacgaagttgccaagggtcttggtggatccacgcgaggaagtgaagacatcatcaataccagcgaactggagcaccttcttggggacccgggcggcgacgattccagaacccctcggggcgggcaccatacgcacggtgacagagccgcacttgccggtgaccttgcagggcacggtgtggggcatgccgatcttgttcccccagtagc

SEQ ID NO: 4137 - DNA, 546 bp, Hordeum vulgare
  UNSURE (16): n stands for any base
gtcccccggctgcagnaattcgcacgagggcattgcgagggtatacctaggcatgcacagcttgaccgatgttatcgctgggatctcttttggcatcgtgatccttgcattctggttggttgtccatgatcatgttgatgcctttgtcgtctctggccaaaacgttacattcttctgggcaagccttgccctagtgctctgctttgcatatccaaagccagagttcccaactcctagctttgaattccacacagcattcaacggggtcgctttcggaattgtctatggcgtccagcagacatacacccgtttccacggccccgacgcgcccctcattctgagccatcaactacctctcctcgcgtacgccgggagggtcctggtgggcatcccgaccatcctagccgtgaagtcctgcagcaaggcgctctcgaaatggctcctgccggtcatgtgcagcaccctggggatcccgatcgtctcgtcctgctacgtgcccacgctgaagccgtcaaacagcagctcgggcgacaagccggacgatgc

SEQ ID NO: 4138 - DNA, 545 bp, Hordeum vulgare
aagcatacctcctgtatttgctgcagttatatctggagtcaggattcagttctaagcactaatggcgcacatggcagtcagtcagtaactgtacccatcatcaagcaaaaatacaggtcaacacgtgtacacttccctcgttgctactctggacaactgtacaaaagagaaaacacccccgtagaggacgtgctagacagacaaacatacaacacaaaaatgaggccgaggtcaatggatctacagcctgcctgcgagacatggaggagggatcatcagccgtcctcccaagaaatgaacaaaatgccgctaaccttgatccgctaattcgatcggcttcacaggttgaggtgcgtgaagatcaccggcaccaggtcgaccaccgaccaagcgagcccggcatactgcacgaacctgatgcccgtatccacgtcgtatgccttctgcgggaagagggagaacaccctctggaggtacccgccggccagctttgcatcgtccggcttgtcgcccgagctgctgtttgacggcttcagcgtgggcac

SEQ ID NO: 4139 - DNA, 518 bp, Hordeum vulgare
ggaaaaaggcacctgtgttcgtatctgcaagatctaaagaaggcttctgctgaagagatgcgcacaagtgtgtatgcgaactatgctgcattcatcagaacatcaaaggagatatctgaacttgaaagggaactgctatctatcagaaatctgctaaatacagagtcagctcttattcatggtctgtctgaagggattcagattgattccttgatcataggacctgaagattctacagaagacaccatctccactattgaataccaggagctttcagaaatacagaaatggcatatggattttcccgacaagcttgatgtcttgctagctgagagaagagtggatgaagcactggatgccctggatgaagcagaacgaattgctgttgatgcagaaaagaagcagactcttgccacagctgacattgttgctttgaagggggttatctctgataatcgccagaagttgtcagatcagcttgctgaagctgcttgccagtcttctacttgcggcattga

SEQ ID NO: 4140 - DNA, 549 bp, Hordeum vulgare
tgtagcgaaaatatataaaccttaagttcttgacatttgaacaatcgatgattcaattcagagtaacatacattttcttcttatgcgattccaccgcaaaggactttttttttatgtatacagtctatatactctatactcactgggctatataatcacagcattgctagctgcacaatagatcacagaccgcacacagaggcccaagatacagcagggaatgaatatatacagatgaggaggagtacacctatgctacaaggacctgtctactgaagatgatgcactctaagagcttccatgggacctggccgacgacacggactgcgccgagacggaggccgtcgggctgagcacctccctctccgaggtggccggtcgggccctcccgctgatcctgctgatgctgtcctgtgcaacttcgatgaaccagtcgtcgctcggaagcgcgctatcaggatccaatccggtagcggagaatgctgccatcgctctatcgattatgtgcagtatgacgctgtgcacgtgccgggacaagaaccggccttg

SEQ ID NO: 4141 - DNA, 549 bp, Hordeum vulgare
gtcccccgggctgcaggcatgcgcaaagatccttgcctctgggcgtgtcaggtcgtgctcatgggcgccgtcgagggttaccgcattgccggaggaccacttggtgagattgttgacccgctctacccaggcggcagcttcgacccgctcggtcttgccgacgaccccgaggcatttgctgagctcaaggttaaggagatcaagaacggtcgcctcgccatgttctccatgttcggtttctttgtgcaagccattgtcactggcaagggtccacttgagaacctcgccgaccacctctccgaccctgtcaacaacaatgcttgggcattcgccaccaactttgttcctgggaaataagctgtcctagagactatgctcgcggtgaagtgtgccctcgtgcagtctaatttgtactatcagattgtaaattacaaggattttgtgcaaaagcattacaagatttgcccgccttcgatctcacactccacatcgatatagacatttggtgtgatcatttcgcattttgttaaacatgtcttccgtagatgg

SEQ ID NO: 4142 - DNA, 554 bp, Hordeum vulgare
gcttcaacattttattatataacatgcatctgcgatgaaataagtccactaacatcactctacctatgtgaactggctacaacctaggaacaatcttgaaggtcgttagattattccatggctctgcattttgcaccagggatggcacattgataatttactttaaaggcagacactactccatgagaatttggttatgttcctgctcgtgtcttttcccatccaattgccgagatacacgatataatccaatccaatccaatagtacaatagccatcgccatcgtgtgatattattaactagtaaatttattagttgcaaaactaactacatggctatgttgtcaaattttaataatatcggtacttgttatgaagctacaacactttccataacaaagaaatacgcttgcaccatgctaaatttaaacatattttgtcacaaaacatataccagtttttgtctccgagtcatatttacatgaaaaggtatttaaaataaatttgtaagaaagactgaaaagtaaaaaaaacacatgcttccacggattgatt

SEQ ID NO: 4143 - DNA, 519 bp, Hordeum vulgare
ctggcgagcccccgagctacctcaccggggagttccctggtgactatggctgggacactgccgggttatcagctgaccctgagaccttcgccaagaaccgtgagctggaggtgattcattgtcggtgggctatgcttggcgcactcggttgtgtcttccccgagctgcttgcccgcaacggtgttaagtttggtgaggccgtttggttcaaggctggatcccagatcttcagcgagggcggcctcgactaccttggcaacccaagcctcgtgcatgcgcaaagcatccttgccatctgggcgtgtcaggtcgtgctcatgggcgccgtcgagggttaccgcattgccggaggaccacttggtgagattgttgacccgctctacccaggcggcagcttcgacccgctcggtcttgccgacgaccccgaggcatttgctgagctcaaggttaaggagatcaagaacggtcgcctcgccatgttctccatgttcggtttctttgtgcaagccattgtcactg

SEQ ID NO: 4144 - DNA, 550 bp, Hordeum vulgare
accaaatgtcttatcgatgtggagtgtgagatcgaaggcgggcaaatcttgtaatgcttttgcacaaaatccttgtaatttaccaatctgatagtacaaattagactgcacgagggcacacttcaccgcgagcatagtctctaggacagcttatttcccaggaacaaagttggtggcgaatgcccaagcattgttgttgacagggtcggagaggtggtcggcgaggttctcaagtggacccttgccagtgacaatggcttgcacaaagaaaccgaacatggagaacatggcgaggcgaccgttcttgatctccttaaccttgagctcagcaaatgcctcggggtcgtcggcaagaccgagcgggtcgaagctgccgcctgggtagagcgggtcaacaatctcaccaagtggtcctccggcaatgcggtaaccctcgacggcgcccatgagcacgacctgacacgcccagatggcaaggatgctttgcgcatgcacgaggcttgggttgccaaggtagtcgaggccgccctcgctgaagatctgggatcca

SEQ ID NO: 4145 - DNA, 517 bp, Hordeum vulgare
tctcgcctcctcctccctctgcaggaagctcgtcgagatgtcgtccgaggcggcgaaggtggtggtgccggagtcggtgctcctcaagaggaagcgggaggagctctgggccgccgagaagaagaccaaggccgtcgaggagaagaagaagtcgacggagaaccgcaaggtcatcttcgcccgcgccaagcagtacgccgaggagtacgatgcacaggacaaggagttggttcagcttaagcgtgaggcccggatgaagggtgggttctatgtcagtcctgaggctaagttgctgtttgttgtccgaatcagaggtatcaatgccatgcacccaaagaccaagaagatcctccagcttttgcgtttgagacagatattcaatggagtgttcctcaaggttaacaaggccaccatcaacatgctccgcagggtcgagccatatgttgcatatgggtacccgaacctgaagagtgtgagggagttgatctacaagagaggttatggaaagctcaacaag

SEQ ID NO: 4146 - DNA, 557 bp, Hordeum vulgare
gagattaaataccgtctcataacaatcccatacagagtcagattcttccaaacattgcatcatggttccgaaatatcaaaactgcatccaccatccacttcctaatgtaaagcgggcttaacaaacaaaacatcttccaaacacaaggcgccatcgatcaatcaacctagttcatcctcctgacgagctggttgatgtagtcctcacggttgccggcgtcaccaccctcgacgtagtggttcctcttcttcttgaggcctcccagcggcgccttgagcttgaatggccacaggaagttgttggcctccttgaagtgagggccaaccgtcaagatctcgtggacaacgtcttcaatgcagatgatgttgtgctttccaagaccctcctcgatgaccttgttgttggtcagaggaatcctttgcttgttgagctttccataacctctcttgtagatcaactccctcacactcttcaggttcgggtacccatatgcaacatatggctcgaccctgcggagcatgttgatggtggccttgttaaccttgaggaacactcca

SEQ ID NO: 4147 - DNA, 534 bp, Hordeum vulgare
  UNSURE (3): n stands for any base
ggnaattcggcacgagggctccatttgggaagtacgctgaagcgtacagcagaagcaagtgtgcgagcatctgaggcgaagcacacaaggaggacctcaggagagaataataatggtggcattcctgtgaaggatattacagttggtaaaacgtcctttcattagctggatgtcctagtggtccttatgttgcaaatattatacatgcatatgctcatgatatataatcatttgctaggagtgcaggaagccacctaaccttggaggtcatagctggcccatctcatggaataaaccgctacctgcagtcaggtaatacgtccatgctcccgatgactcttggaaggattcctcaaagcgacttggtgttcaaggattctgaggtgtcaggaaagcatgcacggattgactggaatcaaaatgtaagtttcacatactgtattcaaaccctagattatttcgaaaattgacatatctgtggatgtaattgccagagtgtttgcttgcttctgctggaacctttagtgcttcgaa

SEQ ID NO: 4148 - DNA, 548 bp, Hordeum vulgare
tctataggtttaatgttaaaaaggttggcaagctttttaactgaatcggtaacaaaaaatataactgcataatgacatatctgagtatgtgtataccagggtacagtttgatttatgtatagacaaatgcacaggagattcctatcaagcagaaggatacagttcgaatgcattgtacaccaatatatatatatatatacgattaacaattgtggacccatcgccagtcaacgatgtttcatgctaatgataacataaaaattaagccaccaagacttacagatacttttgatgaactcccaagtgtaataatatcaccatcagcaagttcggcaggttcactccaacgcctagaaccaacatcaggatgggcaactgcctgggaattcaagaaggttccatttaaactgcccatatccacaagttcccatctgagtgtctgcgatataagagtaatgatttactgaatgggaatggaagaaaggtagctatattcacatgtacatatacattgtgattgtatgaattgaatatattatgatttatga

SEQ ID NO: 4149 - DNA, 550 bp, Hordeum vulgare
  UNSURE (12): n stands for any base
gtctcaccgggnctgcagaaattcggcacgagggccaataaggcaatttgaacagcatttgttgtaacaaagatgatgacttcgaaagtttataaaaggaggttatctgagggtgcctacaaatggcctggaatggacatacttctgaagtatgtcaggaatgttgatctacatggcgtgtttcttgcgggggtatcgcacacaaggacctgtgtttctcatacttacaaacactgcaggagtttcatacaagtaatgaagagatgctaccataaggcttccaggttccacaaagcaatacagtaccactgctctcctgatgatgatgggcctaatgccttcttcttgggtgggtccatctcaaaatcatgcatttctcttccttatgagaaattcaagatttccatttcatcagcacaacaacttcactacgaggttcaagtgtatcttcaagacgcaatgagatccaacagttatagcagaggtctagcaagtgagccagtcacattctgcctggcgtatctggtcgtcatatttccgttgtggatca

SEQ ID NO: 4150 - DNA, 553 bp, Hordeum vulgare
ttctgcaaaaggctgtacaagagtgacgatcaaccaatgcctcagatttaacagtttcatcgtaattacaagatgtagataaatacagcctatatttcacgctttgataatctcaactcctctatactcgtccaaggtaaaagtagatggccaaaactgtgatgctccagccagtacttcacatcttcaagccaaatcgtgtcgagaaaatgaaccacgtgatccacaacggaaatatgacgaccagatacgccaggcagaatgtgactggctcacttgctagacctctgctataactgttggatctcattgcgtcttgaagatacacttgaacctcgtagtgaagttgttgtgctgatgaaatggaaatcttgaatttctcataaggaagagaaatgcatgattttgagatggacccacccaagaagaaggcattaggcccatcatcatcaggagagcagtggtactgtattgctttgtggaacctggaagccttatggtagcatctcttcattacttgtatgaaactcctgcagtgtttgtaagtatgaga

SEQ ID NO: 4151 - DNA, 772 bp, Hordeum vulgare
gtacccccgggactgcaggaattcggcacgaggcaagggctctgttgggaaggcagaacaggaccccgacgatcgtgatcgtctggtccatcctgttggcttcgatcatctcgctcctgtgggtgcgtgtgaaccctttcctcgcaagaccgacggccctcttctggaggagtgcggtctggactgcacctaggagatgaaaggattggatcaaaacaagtcgatcatgtggagtaattttgaaggtgtttttgtgcccataattttttttcctcttccattcctccctgcctccctccctccctcccctgtgtagatagaaaacaaacatgccacacgtgttaaggtattggttattgtccatggtgagtagcctgggccttatatatgcaaaatatttgggccagacgggaggctgcgggaacccctttcacctctgtgcaggttcgggcaccaagaagaaaaaaatacagccagcccgccaggccaggggagtcaggttccaggggttgttttcattggcccagcccaccaccacaatttttttatttggttggccccctggttttaaaatgggggaaggggtaaaaaaatgttttgttttgtggagaccgcgaaaaatttaaaaagccggggcggcccccctttggattgctttttggggccccgaaagggattgtttttttattttttggtttttggttcaaaaaatcttcgaaaaacaaacactgggggggatttttcccctcttcccccttttttcttgagaagg

SEQ ID NO: 4152 - DNA, 545 bp, Hordeum vulgare
  UNSURE (39): n stands for any base
gattgcaccttgaagaaacaggttgcagtaccaacaagnaaattccaaagtgctagtataaggcaccgatctcgcaattacaggatgatatttgcttggttcaaaaattccacaacatgatctacacttttttgttacaaaataacatatgaaaacagaagttcaaaaggcaatttgcagacacccggcttgagcagcgtcgatggatggaccgcaactaatggatgattctctagacaagctcgatgtaagccatgggtgcattgtcaccccgccttggaaatgtcgggatgatccttgtgtagcctccgtttctttccccgtacctgtctggaacctcagcaaacaatgcgtgtacgatgtgcttctcataaatataccccagggcctgcctcctcttgtgaagagatccatccttcgccatcgtgatcatcttatcaacccacttcctcattgcctttgcccttggcttggtagtctttatcctcccgtgcttcagcagctgtgtggtcagcccacgcaggagtgctttccgctgatctgca

SEQ ID NO: 4153 - DNA, 551 bp, Hordeum vulgare
gtccccccgggcctgcagggaattcggcacgagggccggctcctgagctcgcgaacaaacggaggatctccattgctggttcttcaaagacgttggctaatatcctttattcataccgcgggatgggactttcaatcggtacaatgattgctggatttgatgaaactggtccgggcttgtactatgttgatagcgagggtgcaaggctcaagggaagccgattctctgttggttctggctctctatatgcttatggcatcttggatgagggttacaaattcaacatgtcagttgaggaagctgctgagttagcacggcgggctatttatcatgcaacattccgtgatggagctagtggtggctgtgttagtgtctactacgtcggccctgacggctggaagaagttgtccggagatgatgtcggagagctgcattaccactactacccagtccaggcggctcccgtcgagcaagagatggccgaggccccttctgcgtcaacctgattaatgtcgtacgaaatcctgtgaactgtgctgaagcaccttgtt

SEQ ID NO: 4154 - DNA, 551 bp, Hordeum vulgare
gcagcacacaatatttagtataacggagatagcgtggagccgtggacaaacgaattcaaatgaaacttcaatggaaacatctataacattcatcagtctacaaccacaccgccataaccgatgcgtaagtcggaggagaacactctaatgtcgaggaggagacaaacaggccccaagtccataaaacaaggtgcttcagcacagttcacaggatttcgtacgacattaatcaggttgacgcagaaggggcctcggccatctcttgctcgacgggagccgcctggactgggtagtagtggtaatgcagctctccgacatcatctccggacaacttcttccagccgtcagggccgacgtagtagacactaacacagccaccactagctccatcacggaatgttgcatgataaatagcccgccgtgctaactcagcagcttcctcaactgacatgttgaatttgtaaccctcatccaagatgccataagcatatagagagccagaaccaacagagaatcggcttcccttgagccttgcaccctcgctatcaaca

SEQ ID NO: 4155 - DNA, 256 bp, Hordeum vulgare
  UNSURE (227): n stands for any base
ttagggaaagataaatggctaagcgctttggcttttaggccttgaggtccttccttgttatgataggatacgatgccatgttgtatccaagatttggattacccaaccatttttcctgtctgagggaggaggttctatcatttagaggccactacaagtatcatgtcttaataaactaggagtacttaatacactgattgagggcagtgagtacacattttttgcanaaaaaaaaaaaaaaaaaaaaaaaaaggtc

SEQ ID NO: 4156 - DNA, 253 bp, Hordeum vulgare
ttttttttttttttttttttttttttttgcaaaaaatgtgtactcactgccctcaatcagtgtattaagtactcctagtttattaagacatgatacttgtagtggcctctaaatgatagaacctcctccctcaaacaggaaaaatggttgggtaatccaaatcttggatacaacatggcatcgtatcctatcataacaaggaaggacctcaaggcctaaaagccaaagcgcttagccatttatctttccctaa

SEQ ID NO: 4157 - DNA, 515 bp, Hordeum vulgare
cttgatcgttctgggacgccgcctgctaagaaggaatctgtggcagcattgccaactgtgaacatccaggaagtattgggctgtacagtctgtcttgaggagtttgaaatggggacggaggcgaaggagatgccttgccaacacaagtttcactccaattgcatccttccatggctggagctccacagttcttgcccaatttgtcgatttcagctgcctactgaggagtcaaagaacccatgtgaatcaggcagcggtggtgggacagtgagtgctgatggagatcatgctgagtcaagtaatagtgatataggtactgaccacgatggaggcagcgtgcttgatcgtccagacgtgacgtctgctttgaacgccctcttcggtgatgcgtcctcatcatcttcatctgatgaaaatggtccaggtgctcccgagagctgaagccagcatcgccctggctcccgtgcttccaacatgtagacggagtcctgaaagaagactcccgtgaggccggc

SEQ ID NO: 4158 - DNA, 550 bp, Hordeum vulgare
agggaggaaaaggcatgacagaggaagtactacatttacatatcaaccccgagaaccttctataaaaatacaaggaactattccacccatgttggaccggctacaccttttccaatctgaagctgcaaaacacaaatataccaagcaaaaaagctagtccagctggcagcttatgatcccacaatcaacaggttgtgacaacacatcattttcatgttgcacaacctcctgtgaataacaagaaataacaaccaactgagcacatgttgagtgggatttaaaatcagatgaagcaacacctgcaactaagcacagttgccacttgccacatcacagctttggatcagtatcctgaactcagtagacacagcacaacttcgaaggggaatgccgcaatttgaccacaagcatccatctggtgtgaggacttgagaccagataaagcaacacctcgatcattttgtgcaagcacaacaggttgcaacaaaccttacactgaatcaacatcctggatcctgagttcagttggaacacaggcccaaggccccaa

SEQ ID NO: 4159 - DNA, 543 bp, Hordeum vulgare
  UNSURE (4): n stands for any base
gggnctgcaggcaattcggcacgaggggccgccgcaaaccctagctagagcctcgcctccctcctctccccctcccgggcgcctccaccccccgcccagcggcgcgaagcgaccatgacgttcaagcggaggaacggcggccgcaacaagcacggccgcggccatgtcaagtacatccgctgctccaactgcgccaagtgctgccccaaggacaaggctatcaagcgtttcttggtgaggaacattgtggagcaggctgctgtgagagatgtgcaggaggcttgtgtgcatgatggatatgttctccccaagctgtatgccaaggtgcaccactgtgtttcttgtgccatccatgctcacattgtccgtgtccgctcccgtgagaacaggaggaaccgtgagcccccgcagcgtttcaggcgcagggacgacggccctaggcctggacaaggtggcccgccccgtgctggaggccctggtggacctggtggtgcgcctgctggcgctggcgctgttcctggcgcccctgctccccgtgcattg

SEQ ID NO: 4160 - DNA, 548 bp, Hordeum vulgare
ttttttttaccaagaactcctattttctttgaagggggtacgtttgaaatacaggctcatcatgaatggtgaactaaaatataagggcatgaagacaaaaccacaagggggcaaccacagacaaaccaaaaggttctctctgatatagatagcagcgaaattgtcaaaatataaagacctgatcacaaattgtgcttgaccaaccaactttcagtacaaccgattgcagcaaaaactagaatagttcaatatccagggatgagtaaaactagggctggcaccatcacggaagcatattcccaaactagatcaatgcacggggagcaggggcgccaggaacagcgccagcgccagcaggcgcaccaccaggtccaccagggcctccagcacggggcgggccaccttgtccaggcctagggccgtcgtccctgcgcctgaaacgctgcgggggctcacggttcctcctgttctcacgggagcggacacggacaatgtgagcatggatggcacaagaaacacagtggtgcaccttggcatacagcttgggg

SEQ ID NO: 4161 - DNA, 412 bp, Hordeum vulgare
tggcctactggagtcatcagtgtcccggtggtgactactcagagctcggccagatcccacccacacccacacccacgcacccaatgcgcccgcgcccctcgtgagctaccagagccgaccgacagacacactgcgcagagcaccaccaccgaacggacgccatggcgaggctcctcgccgtcctcgccctcgtcgccgccgccgcgccgttcctccgggccgccgcccagggtgacggcgagctgctgccgttcgcggtgggcgcggcgccggcggggtgcgacgtcgggcagggcgagtgggtgtacgacgaggtggcgcggccggcgtacgaggaggcggcgtgcccctacatcccggccgagctgacgtgccaggcgcacggccgccccgacatgtcgtaccagcactg

SEQ ID NO: 4162 - DNA, 424 bp, Hordeum vulgare
ttttttttttttttttgagcagggaacacacatttgatcacattgccaaaaaggggaatgaattatagccatggcgtccacacgatgcagcacaccgattgcaacgaaactgtacgatgcgtgttagaacgacgacgacgacgatcgacggtcagagcgcctggtcgctggccgggaagaagagcttccagtacagcagctcgttccatgcgtcgggcacgccggggaggcaccagtgggtgcagtcggcgtagctcttggggtcggcgagctgctccttggtcggcggcgcccactgctcgctatacacctgcgtgtgcgcgtcccggcggtactcggacatctgcgtgacgttcaccacgccgacgggcaccctcgccgacgcgcccagcaccttgccggtcacccgcagcatcgccctgct

SEQ ID NO: 4163 - DNA, 546 bp, Hordeum vulgare
gtcccccgggctgcagagaggggctcttcgcttgtaggctgctccagaccctccgtgatgacttgaggggcttggatggcattggcagggacagggacagggacagcgagagagaccgggagagggagagggaaagaagggacagggagagaagggagagggagagggctagaagagagagggagagagcaagggagagaaaccgagggggagaaaggacagagagcttgatactgatcaactccaacaatgaggccattattctgcaaggaacatttggacctagtgacaaccaagagaactcaagcaacacaagtactggcgtttcacttggagactactttcttggtcctggcctggatatgctcttgcagcgtttggcggacagtgacctgaatcgttctgggacgccgcctgctaagaaggaatctgtggcagcattgccaactgtgaacatccaggaagtattgggctgtacagtctgtcttgaggagtttgaaatggggacggaggcgaaggagatgccttgccaacacaagtttcact

SEQ ID NO: 4164 - DNA, 541 bp, Hordeum vulgare
tctctacattgatgagagtattctgcctttgccaaacagatgctccaggcatataaactactcagcagtttcctttggtaattatcccgttcaagtaaacatactagagtacctttatttcacacacacacacacatactgtaaacacggcgggcattaaacggttacaagccaagccacataggtttcagaagcgaagataaacagctttgtcttgcagggtcgaattgaaatatttacagggaaccacagcataaagacgccggcctcacgggagtcttctttcaggactccgtctacatgttggaagcacgggagccagggcgatgcttcagctctcgggagcacctggaccattttcatcagatgaagatgatgaggacgcatcaccgaagagggcgttcaaagcagacgtcacgtctggacgatcaagcacgctgcctccatcgtggtcagtacctatatcactattacttgactcagcatgatctccatcagcactcactgtcccaccaccgctgcctgattcacatgggttctt

SEQ ID NO: 4165 - DNA, 384 bp, Hordeum vulgare
accaagcaagccagatttggtacagaaagaagaccccccccccccctctccttctcctggcggcgcccaggccccgccgccatgtcgacctgcgcctaccactcgccgcgcttctccgaggataatgcgtggctcccgcaatggcttcagccgcatcggcagccgacggccggcgagcaccgaacagacagcgccggcgtgtcgccgccgccttgtgaggactgtgtgttcattctggaccctgcacaggagcaacggagttgtccgaatgccacggtaaacgctggtggttacagcgggttccgtttgcatttgtcaggagatgaggatacacctgctgcaagtactccgacagacagagaggttctgcctttctctctgcac

SEQ ID NO: 4166 - DNA, 342 bp, Hordeum vulgare
ttttttttttttttttttgtatccccgatccaagaaagaactttattatgcactacagaatttctgctcagttgccgatttctaagctgtatacagcctccagtgaacattacgatcttcaggaaagtaaataacacacccctgaatgatgtttggcgtcattcaccccggtagtttagcccttggtcttcttcgaatataggcacccgtacatcatatcaccactacaggtgctttgacgtcagaccctttccaatatttgtaaaaatgatgaaaacacaggcatcagcctccacgcagcgcaggtggatacaagtcgtggcagaaacatgccattcaaaa

SEQ ID NO: 4167 - DNA, 528 bp, Hordeum vulgare
caccaggcaacgctggctgctgccgctgcaggctgcaccctaaagcagcgggcgctttccacctctcctctccctgccaccccacccacacacgcaccgccaccacccccgcctcggcctcggctgcggcgccctgtgtttccgcctctccggaggggccgccgccgccatgtccgggctgtacggccagcaggggttctcgccgtcgaggaacctgtccccccagattagaagcaacccagatgtcgtcgatagccagtacttggccgagctgctcgccgagcacgagaagctggggcctttcatgcaggtgctgcccatatgcagcaggttgttggtccatgaaattatgcgggtatcaaactcttcccacaaccctggattcagtgatttcgatagacatcgattcagaagtcctagtccaatgtcttcaccaaatccaagatccaatctctctggcaatgggttcagtccttggaatggactacaccaagagagaataggcttccctcaaggaaacagtatgga

SEQ ID NO: 4168 - DNA, 535 bp, Hordeum vulgare
aacaatataaacacaaagatccatgaacactgattttgacagtaaaaaccagactgcaacattgtcagttcggaacctccacggcccgaaccaaacaccacgactccacaaggcacaagctgataatgatccttataccctttttattattatccgcgactccataatgtagaagggtggataatatacaaggaggttccgacgcctaaaagggggtgaaaaggaaaacatgaaagctcacatactcgggcctctctagtctgtctgtcatggagataacctaccatcatagcaccacattactagggttaacagtcaattaacaaataaagcgaatgttctagaccttacagcaaccgaagctgggccgacccgccgacccaggactatgacccacggacccaggactactacttccattgtcccagaggtttctccttgtccgcaggagaaaccgtgactcgtacagactcgtctagcgaaatgcaggcgtcgcttccttcaagtgcgcccgcggcaaacgttgcccggagac

SEQ ID NO: 4169 - DNA, 452 bp, Hordeum vulgare
aaagaccagtcaatcataagtgggttaccttcagacacaacagaacatactgcatcgcactcagtgttagaagaaggcaatagccaggagagtaagttacaggaaaaagatgcggacaacctcaagggtggtccgtctgaaggccagtcacatactgcagaatcaatggtatctgaagattatcctcatggtgatcataacttggacacagagagtatacttcagccaaacccgttgtggcctagcaatataagtaaatatcttgatgaccttggtgaaggcggctatgcacatgccgagcagccaccagtgacgggatggactgttggacctcagatgcttcatcctaattatggaatatcatcggaagggagccggtttgaacctgaggtcacagattatcgcttgaccagaaagccagtttcagtgagaaacatcccaagaaatccact

SEQ ID NO: 4170 - DNA, 544 bp, Hordeum vulgare
tactattagatctataatggcaacaaaggctaagaatgagaggttaacaatttacactagacctgaacaaattggtctcctaagaacatgcctaccgtctgcagcctttgctgccgggggaggcaagtatacacacagcgaggccaaaaagaatggagagaagaatggcaaaaagacataaacatatgggcatttccctatactatatgtacaagagacaagacgtctcaggaccataagatggcatgcatggctgtgcacccagtccaagatcttgctggtttggcacctttctgccaagacaagaacaccaggagggcaaaatagctggtgctctatgtgtcgctccaattatcgtcgtcttcgtcatcgcttcccaccgcctgtcgtatggcattcgctttctctattattgcagcaactctcaagtttccactagaggccctagcaggggctctcatggatgtcggttgagcagaacccactggtttcaggtcaaaggtcttgttccttatctgctcaagccacgagtttttatcgttgg

SEQ ID NO: 4171 - DNA, 541 bp, Hordeum vulgare
ggctgcaggcattcggcacgagggctcatcgacgtgcccatgagcaactgcatcaacagcgggatcaacaaggtgtacgtcctcacccagttcaactccgcctccctcaaccgccacctctccagggcctacaacttcagcaatggcgtcggcttcggagacggtttcgtcgaggttctagcagcaactcagaggcctggatcggagggaaagaggtggtttcagggtaccgccgacgcggttcggcaattcgcttggcttttcgatgatgccaaatctaaagacatagaggatgtattgattctttcgggcgatcacctctaccgtatggactacatggactttgttcagagtcatcggcagagagacgcaggcatcagcatctgttgcttgcctattgacgacagccgggcgtctgattttggtctaatgaagatagacgacacaggaagagttatttcatttagtgaaaaaccgagaggagctgatttaaaagcaatgcaagttgacaccactctcctcggcttaccgaaggaggaag

SEQ ID NO: 4172 - DNA, 304 bp, Hordeum vulgare
gaattttagggttgccacgcatcttattggaagagtacaaacgaattctttatttctcttgctgaactggagactgaagagtcacttctttcagatcatatgactaatccatccgcgatcaccgagttcttcagcacaaccgtgatgccggaccggatgtggaagccttctgatgtcctgtctgattcctgtacaccctcggcgttagcaatggtcacgttcttccctatcctcgcattcttgtcaatgatgcagttttgaatcgaagtgttctcccctatcccaatcggaacctttccttcgg

SEQ ID NO: 4173 - DNA, 486 bp, Hordeum vulgare
cgcacggggggttggcagcacaagcatcgtgaccttcagtctgcagcctgcgccaccagctccctgccaggtgccatggccgcgccccgccccaccgtcctcgtcaccggcgccggcggccgcacaggtcaaatcgtgttcaacaagctcagggacagatccgaccagttcgcggcgaggggcctggtgaggtccgaggagagcaagcagaagatcgggggagccgacgacgtcttcgtcgccgacatcagggaggcggaccacctcgcgcccgccgtccagggcgccgacgcgctcgtcatcctcaccagcgcctccccaaagatgaagcccgggttcgaccccaccaagggcggccgccccgagttctactacgaccacggagcctaccctgagcaggtggactggattgggcagaagaatcagatcgatgccgccaaagcagccggtgtgaagcacatagtgttggttggatccatggggggg

SEQ ID NO: 4174 - DNA, 553 bp, Hordeum vulgare
gaatctcatgcatcggcaggagtttatttttagcattattgataaaacgattgtgcaattataccagccagcacctccataatacacaaaagcttacacactcatacagtaagatccttgtaagctagaaatgcaagtatactcctggactgatgactcaaaaccgggctgtgacctgggagaacagcgctttgaaatctttagtcggggtgccctcgccttcaggtttcgaagccaaatcgaatgccttgaacttcacctcttcatactgcagagcctgaacacaaacttcggccacatcagccctaggaatcgccttagtgtcagtctggagaagctcatcatccttcccgacaatcagctccctcactcccccatccttgtcttgcagaccaccaggccttatgattgtataaggaactccactgtctgccagatactgttcagacttgcgcttccagaccaatatgttgccattgccaaggctgttgagaggatggttggggtttgtcccccccatggatccaaccaacactatgtgcttcacaccggc

SEQ ID NO: 4175 - DNA, 551 bp, Hordeum vulgare
  UNSURE (44): n stands for any base
gtacccccgggcctgcaggaaattcggcacgaggaggtaaaagntaggtgaaacatttcctacactgttctggtctccatgcactttccggtgcatcgatggtatgcttgaagatttcagcaaggcgacggcagttagtgagatcataagcaacgcaaagaccatcactggatttttgtgcagcagtgcacttgcattgagtttgatgaagaaacatctgcaggggaaggatctgctagttcctgcagagacccgtgctgctatgaacttcgtgacactgaaaaacatgtacagtctgaaggaggatttgcaagccatggtcagttcagatgaatggatacactgcctgctgccacagatacccggaggggtagaagtgagcggtattgttagcaatttgcaattttggtcttcatgtgccttagttgttcgtgccaccgaaccacttgtgcatcttcttaagctggtaggtagcaacaagaggcctgctatggggtatgtttatgctggattatacaaagccaaagcagctatcaagaaagagctggtga

SEQ ID NO: 4176 - DNA, 494 bp, Hordeum vulgare
  UNSURE (14): n stands for any base
actcgctacatggnaaataaatcacaagcaattctctactttttgtccatacttcactagtttacattacaggttcatatccaagttggaaccatctcattcgcccacagacagggttctctcttcatcgttggaatcatctttgtcgtcatcatcatcctggattccttgggaagcgccttggatcatctcatcgtcgactccttcaatgaaggactcgaattcatcacccgggcctgctgatggtgtccagttgaatggttgactaatctccatccagtttggctgctcggttggtcccgagaatagtgcggatctatccaccacccagtcatcaactatgtctatgtagtctgccgatattggatcaaatgccttcgccttgtattgttgcctgttttgtagccgaaggttgcattgaacaaaggtgagatgatgcattcgttgacgttcaaaaatattcattctttggtcatggagtcgttcgaaaggaa

SEQ ID NO: 4177 - DNA, 477 bp, Hordeum vulgare
ttgcatggatcatacagcagttctttaagcctccacggtgtcagagttgatgacgaacactcggctcttgagaacagcagcaggcctcctagtcatattaatatcctaacaccaaaagatgttgtacctatcgaaatggcacggtctaggttcctggacatcatcattgaccattttatcggtcaaaatgctattgaggtggcagagccctctctgtatgactctatcctggccagcaatagaataaacaaaagaaagcaacaagaggtacgatacgaaggcgacccgaggtttgctttgcccttgatgtacatagcgaacttgtatgagtccttggtgagcgacgtcgatgcacgtcttgcttccttgattggatcccgtgagaaaacgatgggggtagctcttgaagctgccggcggcttgtacaggaaactgactcaaaagtttcccaagaaaggaaattgtagcttcaggagg

SEQ ID NO: 4178 - DNA, 547 bp, Hordeum vulgare
atttgcattgaaggaagagtgaactcaacttcagttacaacaaccaaaacccgtcctactatgcacgtacagggttctgcatcatgggccgaaacaacactcaactgcggcaaaattccttaattatgcattactcatcagatccctagcctcttggtgccacactctgagcagaacttggatgtcgcccttagatacggcgaaccacattcgtcacaaaacttcgcaggcctgcttggaagaatattcaagcgtcctccagggtggctgtgtccagcttgcatggaagatagatgcggagataaataagactggtgctgctgtgggttatctgacaggtgtgatgacgatgcgcatggatggatggtagggaactgagaagtatgttggttttgctgaatggcgccatgctctccttgatcgagaaagtgcaagtaaggttgactttctatctgttcaatgtgtcgcttcgatgataactcatgttggttttgcatctcgaatggtggacgaaactctgaggaacaaaccaacggagaagtctcat

SEQ ID NO: 4179 - DNA, 525 bp, Hordeum vulgare
aatccgccgccctctcctcgccagggacgcgccggagaaggaccggacaggcctcctccctctccgcctcccctcccgccctctctccaccgcgcaggcgatccgccccggccgccgatctcctcgctggaatggcgaattttaccaaaaacttccagtcttcaagcaaatcagacagtgaaaagaaataccagggtaccctggttgcttctccagcaaaggccatttcaccaaagacgataaagcatatcgtgccaaaacaattgatcttaagcagggagtcaacagctcatgtggcatcctttttggtgaaggttattgctcttgaggtagtgaggaggatttctaaagcaaaatgcccttttgtatggaattctattcaagcactgcaagttcttggatatcctccatttaggtggattcaacgatgggcaccactcaaatttgtcgtgcaaggcattcagaaattatccacaccactgttgtttctatctgtcacatctacactgggtgatctttcttcta

SEQ ID NO: 4180 - DNA, 549 bp, Hordeum vulgare
  UNSURE (50): n stands for any base
gctgaaagggtgaatatagtagcaacgatacaaacagagagcctccctanacactggagtgaaccatgctgaatacacgcacaactttattcatatctacttactatataaatcttagcggccggggcatcacgacactatacgaccggcttgcagaggaacacggactggtgcgagaaacaacatacagtcaacctcaaagaggaacaaacaacatacagtaacgctacgctagtgaaacgggtagacagttctatgaactgtcaggagacagggggttcaggaggctaagaaatgggctgctgggggtcattcatcccagcgagaaaggcgacaaagatccacaccatcagcaggccgatcaccgcggcccttatcgcgttctcgcagttgtaaggggatggaagctcctccagttcctcgtcgaagtccaggtccgagactggtgatctggagccggcgctgataaggctcctgctcctgctcccctcccctgcctggattagtgaactgtctcgaggcttcttgcatcgagagcagttgcatttg

SEQ ID NO: 4181 - DNA, 401 bp, Hordeum vulgare
  UNSURE (399): n stands for any base
aaccccccacaccactcgccagcgcctccgccgtccactcgccgccacctgctctgctcaccacgagcgcgcgcgttcgtccggagcgacgatggccgccgcaatgccgccgctcgccctcctcgcggcgctgctgctgctgtcgtcccccgccgcggcgcgcgtgcccggcgtgtacaccggcggcgactggcagagcgcgcacgccaccttctacggcggcagcgacgcctccggcaccatgggcggggcgtgcgggtacgggaacctgtacagccaggggtacggggtgaataacgcggcgctgagcacggcgctgttcaacgaggggcagagctgcggcgcgtgcttcgagatccggtgcgtgaaccagccgggctgggcgtggtgcctcccggnga

SEQ ID NO: 4182 - DNA, 326 bp, Hordeum vulgare
ttttttttttttttttgggtatataaatcaggtccatgattgattgattgattgataaatactcgtagtagagtagagtagtggtaacagcagcgtgccatggagacaaagatgacacggcacgggaaggacaccggagaagcagcagctgcgggctcccatctttcagccgcagctttgcagccacttcagccaccactctccccacttcaccattctaattaagactagacttttgctaccagtactagtagtagtacgtagtaagtatgaacctgcttgcaccttgcatctgcattcacaggccacgcaccaccaaggacggg

SEQ ID NO: 4183 - DNA, 518 bp, Hordeum vulgare
gggagaggttcgatctgctcgtgctgccgcccagtttcccctacggcggcatggagaaccccaggatggtcttcctcacgcccacggtcatcaaaggggacgccgcgggggcgcaggttgtggcccatgagctcgcacatagctggactggaaacctcatcaccaacaaaactaatgaggatttctggctaaatgagggtttcacaacctatgctgagaggaggattgtcgaggtagtgcaaggtgaggagcgggcggccttaaacagcggaattggatggagagggttgaatagaatgatggagagatttaaggataacatggagttcaccaagctcaagccgaagatggcagggattgatcctgatgatgtgtactcagaagtgccctatgagaaaggcttccagttcctttggcgcatcgaacgccagattggccgacctgcatttgatgaattcctgaagaagtatattgccaccttcaagttccaatcgatagatacagagacatttctcgaa

SEQ ID NO: 4184 - DNA, 529 bp, Hordeum vulgare
ttcatgcttccttacagggtgcagaataaattacgcacatgcagtctcacatgacacatcacggaaggaagttcagagttttatccaatgtcaactccccgagagagataattttatgtagggcaaatgagcgagcaaacagttctctctacttcaggctcagtaaaatgtggcttcgactcagctagccatgcttcaaaaggatgctctccgcgacgccgcgggctatggggtggtaaaactcctgggcctccgagaagatcctcttggccagcatcttctcctcctcccctgagcatcgagccagcgagctgtagagcgggcgcaggtacttcatccttcccacttgcttcaagcatttctccacctcgttgaagtaacacctgcatcccgtggggatcgctagctggaggaatgcgactttaacctcgtaatcacggctttctgacaacttgtaccgctcatcaagagcagtaacctgtgatgcttcaacgtctgttggtaaattttccaagtaaagctcccattc

SEQ ID NO: 4185 - DNA, 519 bp, Hordeum vulgare
aaccgcaccacgccctcgtacgtcgccttcaccgactcggagcgcctcatcggcgatgctcgccaagaaccaggtcgccatgaaccccatcaacaccgtcttcgatgcgaagcgtcttattggcagaaggtttgctgatgcccctgtccagagtgacattaagatgtggccttacaaggttattcctggccctgcagacaagcctatgatcgtagtgcagtacaagggtgaggacaagcagttttctgctgaagaaatttcttccatggtcctcatcaagatgcgtgagatcgccgaggcttacctaggagtaactattaagaatgccgttgtcactgtgcctgcttacttcaatgattcccagaggcaggcaaccaaggatgctggtgttattgctggtcttaatgtgatgcgtatcatcaacgagccaacagcagctgcaattgcctatggtcttgacaagaaggctaccagtgtcggtgagaagaatgtgcttatctttgacctcggtggcggcac

SEQ ID NO: 4186 - DNA, 531 bp, Hordeum vulgare
catattgcatgttaagacagatcctagtctacgattaaacaaaattttaacccaggtgatatgattggcacccagggccgaaacaaatggcgtatagtgtatttctcactatgaaagagaactaacttagtcgacctcctcgatcttgggcccagcaccgccgctggcagccggcacatcatcgtccatgcctccgggcatgtcagcaccagcaccctggtacatcttggcaatgatggggttgcagaggccctccagctccttcatcttgtcctcgaactcatcaacctcgccgagctggttggcatcgagccactggatggcggcgtcgacggcgtcctcgatcttcttcttgtcatcagcaggcagcttggaggcaatcttctcgtcctggatggtgttcctcatgttgtaggcgtagttctccagggagttcttggcgtcaaccttcttcttgtgctcctcgtcctcagacttgtacttctctgcgtcctggaccatcttctcgatgtcgtccttgctcagcctgcc

SEQ ID NO: 4187 - DNA, 518 bp, Hordeum vulgare
cctttcccctccccctccccgccggattcctccttcccctcccgactcccgagctcggcaatggcaaacgcttcatcaggtgctgggatccatgacgactgcaagctgaggttcgtggagctcaagtccaagaggatgcaccgcttcataacctacaggctggagaaccagaaggaggtcattgtggaccaaaccgggcagcgcgatgccacctatgaggatttcaccaagaccctccctgaaaacgactgccgattcgcagtgtttgacttcgacttcaccaccccggaggatgtgccaaagagcaggatcttctatatcttctggtccccagacaccgcaaaggtgaggagcaagatgacgtacgcaagcaccaacgagaagttcaagaggaccctggacggcatccagatcgagatgcaggccaccgaccccagcgaaatcagcctggacgtgatcaaggagcgcgcacactagggcggcaaaccaaccatccatccaatgctctgccctttgga

SEQ ID NO: 4188 - DNA, 549 bp, Hordeum vulgare
acatttaattatttataatccgaacttggaagaacagtgcagcagcataacgcccggcatataaatgggcagcggaagaaggaacggattacatgatagaacttagaacaagacctcgtggtggtctcaccacggggatctttcgacacggtaacaaagccacaaatcatcaagaaagtttcaagagtcacaccgccaaatctataattgacataataaatccatgtcgccgtgaggcgtccaaagggcagagcattggatggatggttggtttgccgccctagtgtgcgcgctccttgatcacgtccaggctgatttcgctggggtcggtggcctgcatctcgatctggatgccgtccagggtcctcttgaacttctcgttggtgcttgcgtacgtcatcttgctcctcacctttgcggtgtctggggaccagaagatatagaagatcctgctctttggcacatcctccggggtggtgaagtcgaagtcaaacactgcgaatcggcagtcgttttcagggagggtcttggtgaaatcctcataggtgg

SEQ ID NO: 4189 - DNA, 516 bp, Hordeum vulgare
ccgccgccgagccctggagctccgtcccgccgtgtcgccacttagcgtacgccccaccggaccatcagcaggcgagggccggccggcgacctacttcaacggagcgtggacggaaggtttctatatcttccatggcgctcgtggtgatgtgcggccagccgtgcagcggcaagtcagaggctgcagcttgtcttgccgccgctcttcgctcctccgtgcctgacgtcactgtccgcgtcattgatgagtcatcgctccatcttgggcgcaatgaaagctacaaagatatggtcgtggagaaaaacttaagaggagttctgaggtcagaagttgacaggtctgtttcacgggatggcataatcatcgtggattctttgaacaatatcaaggggtaccggtacgagctgtggtgtcttgcgcgtgcttcgggaataagatattgtgtgttcttttgtgatacagaagtggaccattgtagggattggaacgtcaagcgtcaggagaaaggagaaccct

SEQ ID NO: 4190 - DNA, 431 bp, Hordeum vulgare
  UNSURE (20): n stands for any base
tattagtaaaatttcaaatntctgtagttacaaggttgcaagcacccgcaaaaactatttgggtggtcaggagctcagaatacacagcggcatgccatttctgaatacttgcggtgaagctcatgcgaggcaaaataatctctttggacggcccgaaggaagccatatgaggagcatggcaggggaaaacgctagcagcgcctgcattccgtcccctgggaagtagtacatcataggccggactactcatcagagatgggagaaccaaccatcacccaccgatttctcggttcaagtagtcaacaaacatcctcttcgcgctgtcagcatctgttggtgggggtcgcccgctcaagctgtactgccctgccagcttgatgaacgtgcgtcggaggctccgtagctcaggcaggccaaccaacctttgaaga

SEQ ID NO: 4191 - DNA, 1126 bp, Hordeum vulgare
  UNSURE (1)..(5),(14)..(16),(18),(22),(24),(26),(27),(29),(30),(33),(47),(61),(71),(608),(635),(1048): n stands for any base
nnnnnttgggaacnnncntgantncnnanntgngaggccctccattnagatgacaacaaanaagccctacnatgccctgagaagactgaagtgggggcgttcagcaagtgagaaggatctgacagatgatattgataataacctttcctcaattagggctgcctacgcagatcaagctgaaggaagcatttttcaagtattcgagggagcaagtttgaaggccttcactattggaggaggactgtttttctttcagcagatctctggttggggggggggtccatcctatttcttttttctcgtgcggatttctggttgcacaggcgctcgtgtttctcgtcatcgtttccccccgtttgtttccgctcttccgctgcgcgctcacccgttcccctctctttcgccatgcctctgtatttaatctttcgcggttcttccggctctcctctttcccgcgcacctcgtttcaccccctaccaccatcccttacgttttagcacttctctctatcacttttctttccccgctcccgcatgcttttgctctgtcccttgtatgcgttttttacctctctcctgttgctatgtgttgcccttgtttcccctctnttatggacggttctcccctgttcttantgacgcttcctcaactttcccctttttttctttccccccgtgctgttttctctctctgtcactgccccattactccttcttacccctcctttccttccaaactccgtcgcttttgtcgcccatcgcctgtcgatctcccttttgcacacaggcacttggtattataaagaagtcttccgaattgatgtcgtatacactcgtattgccgcctgtctttcacacgacgctgtccgatgtttcttttcacgtcttttatatacttcacattgttctccattcaccttcgacagcgacttggtagaatttaactgcgccgcttgtccttcgtccgcccattgtttcctcgttcctttgcgtatctctccctagcatttttcttccgtcattttaccctcctgccggctgtttatacncgcggatgcctgtagtagcgtcactgtcgcgcggaccacccctaatattcccattccccctgtttgtcctatatgtgg

SEQ ID NO: 4192 - DNA, 552 bp, Hordeum vulgare
ttcacatacacttgttaacagtaacatcagaattacaggcatcaacggaaaatgacagctgattcagaaaagagggccgtgaagcgtggtcatgagtggtagtacaactacatatgcatgtacagctacatcaactacacgggcaaaatcagcaggaagagctttacagggagacgcacgcgctaaaggtgccgtggcgcgctccgatccgatccatggagcggacatggaagaggctagaggatgaatatcagctggcatttccattcacttcttcaggatcttggattcgatctcctccaggctcagccctttggtctctgggacgttgaggatgacaaacaagagggcgagcagcgatatggctgcgaaaagaaggaagacgttggccggtccgaggtatccctgcaagggtgagaatgcgaatgtcactaacgcattcgatccaaaatttgtgagtaccgcgaggctgattccgcgtccccttgttcggagtgggaagatctcagagaccattagccagcttatcggaccaaacgaaagctggtaaca

SEQ ID NO: 4193 - DNA, 361 bp, Hordeum vulgare
cctcgtgccgaattcggcagagggcaccccgcactcctggccgccgctcctctctatcctctactggctcacacttctctgccgcttcaccgacggcctccacgcctcccctcccgcccccgcctccgcctccaatgaattcatgacctacctcacccagggctactgcatgtacctcaactgccaggatgacgccctcgcctccctcgacgatgactaccactccaaggcccgcgcccaagtcgctgcgtcggcggtggcaattcaggatctagagaaggaggttcaggagtgcgaggccaagcggaggaagcaaatgtcggcgccctctcgcctcaagggcgctgcaggagaagaagga

SEQ ID NO: 4194 - DNA, 544 bp, Hordeum vulgare
tcacagtcccgtcatttcaccaatccctaaacgcatcatacatactcccctcggttccataatgtaccgatacagactttttgacaagttaaagtcaaactttgacaaatcattttcctacgtggagccagccctaagaccacgacgccgccatgtcctccgcgcattcgtacaggtctttattcatctcgtcactcgtttgcaccactaactccttgaacttcgtgatgccctccatgagctggagcagctccctcgcgcacgcctgggtttctttgtcggtctccctcagcgtggcctggagatcctcttctgagttcttcaaaacctcctctgcttccttctcagcggtgctcatgtgatgttcctttttctctagctcttctttccattttctagcatcgtctgcgcagcgtgagacatggctttggatttcacgatccagtgaatccagctgagcagtcatcagagccatgagtcccaacattcagctgtaacaggcacatcactgtcagagtcacaagcatctaagtccgtccatgaa

SEQ ID NO: 4195 - DNA, 472 bp, Hordeum vulgare
ccttgcttagtaatccgccttggactcgcgtgctctactatagcccctcgtgatagacctcgttttgggcaagccgtagtttctcagattgaccatggtattatacatttgaccaacgaagaagatccaagaattactgttttgctggattgccatgggatttctccattcagatttccgatgcaaatgatgaggtcatttgtcaacttggttcaagaaaactacccaaatcgtcttggagtattaattgttgtccgtcttcctccagttgtcagagttattgcgcatacttttattcaactcctgaaaccatccacaaagcagaagctgcgtttcgagggggaatcgtacaagaagacgttagccgagttcttacagatcgtcccagctttcctcggcggcaaatgcaactgctctcgatgcaagaagcctcgagacagttcactaatccaggcaggggaggggagcagga

SEQ ID NO: 4196 - DNA, 543 bp, Hordeum vulgare
aacaactgctgaatacacgcacaactttattcatatctacttactatataaaacgacactatacgaccggcttgcagaggaacacggactggtgcgagaaacaacatacagtcaacctcaaagaggaacaaacaacatacagtaacgctacactagtgacacgggtagacagttctatgaactgtcaggagacaggggggtcaggaggctaagaaatgggctgctgggggtcattcatcccagcgagaaaggcgacaaaaatccacaccatcagcaggccgatcaccgcggcccttatcgcgttctcgcagttgtaaggggatggaagctcctccagttcctcgtcgaagtccaggtccgagactggtgacctggagccggcgctgataaggctcctgctcctgctcccctcccctgcctggattagtgaactgtctcgaggcttcttgcatcgagagcagttgcatttgccgccgaggaaagctgggacgatctgtaagaactcggctaacgtcttcttgtacgattccccctcgaaacgca

SEQ ID NO: 4197 - DNA, 478 bp, Hordeum vulgare
ctccctgatgccttttgtggaggatgggttggattcttctcatatgatacggtgcgttatgttgagacaaagaagcttccgttttctaaggctccagaggatgataggaaccttcctgacattcatctcggcctctacaatgacgtagtcatctttgatcatgttgaaaagaaaacacatgttattcattgggtgaggttggactgctatcactcagttgatgaagcatatgaagatgggaaaaataggttggaggccttgttatcaagattgcatagcactaatgtcccaaccctttccgctggttccattaagcttaacgttgggcaattcggctcagcactacagaaatcaaccatgtctagtgaggactacaagaagtctgtcgtgcaagcaaaagagcacattctagcaggtgatatatttcaagtagtactaagccaacgtttcgagagacgtacattcgccgacccttttg

SEQ ID NO: 4198 - DNA, 540 bp, Hordeum vulgare
tattgatcgaacttattcctagctcaactgtctattcggtgcggcaaacaacccacagcaaacacgctctgaaggtctctgccacgggccttttccacgcaaatctggtcctacatgtcggagaagtccaggaacgtcgactcagcgagatcgatggcacgggcgaggccggcggccttgttctggcactcctgctgctcgtcgtccggtttgctgtcggcgacgatcccggcaccggtctggaggtgcgccacccactcctggcgagcgttgctgctgttggcggcatacgagtacatggtgtcgaaccgggacgccgtcgggaagacgatggtgcgcagggcgagggcgatgtccatgtcgccgcggaaggagatctggccgaagccaccactgtacggcccgcgcatcgtcacttccatctcgtcgatcagctccatcgctctcaccttgggagcaccactgacggttccaacaggcaatgcagctcgcagagcatcccaacatgtaagatcgtcacgaagctccccagtaaccgtt

SEQ ID NO: 4199 - DNA, 396 bp, Hordeum vulgare
tgccaaatgtggcaataactgttggagctgttgcaaaaatcacagagaagaggctgaggaaaatctacaagatacaatcagagaaagattttcttctgttggcgaggattaccatgccgtggatatcctattggcagagattgatgtatatgaactttttgctttcaagcattgcatgaaaagaaagatacaacttgccctttgcaaagaactcgatcagagaatgcacgagctgaaaaatgaactcgagggataccatagtggagattctgaacaaattaataagaagaaagctcttgatgcattgaagaggatggaaaaatggaacttgtttaaagatacctctgaggaacatcatagttacacagtggctcgtgattcatttcttgcacactt

SEQ ID NO: 4200 - DNA, 553 bp, Hordeum vulgare
tccaggagagtgccatatgtatcatgctcaaggactcagggtaaaatgaaaccctagttcaggtttgggtaagatggattctgttaaccacgcaacaaaattaggcccaaaaatgtatgcatcatccagtgcatgtttacaccctttccatgtcagctcttctaaaatgaagggcccgcaagccccctcgtcatctaaatagagagtgtgaccaaggaggattgaaccactgtgtgctgctcgctcatctagcgttgcttgagtctgtcttgtagcccttttagacctccacataagctatcacccatggggcaagcatctacaaggatcatgtcaaactgtgtacccaagttgaaaattactatgctcagttgatcttgggctttggcctccttggtcgcaaaagaaaccaaagcaacccaaaaacaactataaaagcagggatggttgtcatgtctagctgtacgtcaattttcctttgacgagcacattttgcagggtgtagacttgagatggttgagttcacagcatgagaaaatccattagaagcatc

SEQ ID NO: 4201 - DNA, 520 bp, Hordeum vulgare
ggatatacaatcctgcaattcaagtgaagaagagactgaaaagtggtttaatcagtaccaagtcaaaacctctgcatcctgggctggtctttctgtattgcactttaaacaaggagcttcatgacttcatcagagacaccgaaggttgttatggttttattggtgctacaagaggttctattaaaaggcagattaagaagcctaaaccaattccagctgaagaagtcgaatcaattattaaaaaggaaaaggaggaacaagagaaagttgacaaagaatttgaagacctggaaaactggaataatgtcggttcctttagcaaacctgttgaagactctgaacttatgttaattaataagatcaagaaacaggtcaagaaatcaacttcaaaaggtgcctccagcaacgacacttttacgctcggtgccagtgttcatgttctctccgggccttttgcaggcttcactggctctcttctggaagtaattcgtaaaaataagaaggttactgtccagatgac

SEQ ID NO: 4202 - DNA, 554 bp, Hordeum vulgare
  UNSURE (36): n stands for any base
caccatttgatttggttgaaaaatgaatgtactgantagaattatgaaatgaattagtatcctgtggtgctaaaaaggaatacaaagtgttgaaacattgctctctacatgatagtagaactataggtcgaggtgaaactttagcaaccaagtcggcgatttcctgttgaaccaatcctggtccgcaaaaaccagcgtttccaaacacttgccaggggcttaatgtttactgtggctcacaggctaactattctgttgtgtttgtcacccaatccggtggtcttcaacagatccatataccccaagtgctttattcatatctccagggcccaactgacaaaacttctgaatctatttcgacaaacaaaactactgatacagtgcgtctgtgcctagcattaagtattgagtgcctcaatttgatcaaaatctagatctacaaagctctccttgccaaaaagtgtcatctggacagtaaccttcttatttttacgaattacttccagaagagagccagtgaagcctgcaaaaggcccggagagaacatgaacact

SEQ ID NO: 4203 - DNA, 552 bp, Hordeum vulgare
  UNSURE (20): n stands for any base
gtacccccgggcctgcaggnaattcggcacgagggctcgtcaacctcagcgtcgccttcagtccccgccacccctccgccaagcccctcgactacttccgccgcgcctacggtgacgactactacgtctgcaaattccaggaacctggatatgaggcacgatttgctagtcttgacttgaagaggttcttcaaaatggcaataactgttcaaaccacaggttcttccgccatgtcccttgaaaaaatgcaggcaagcaacaggcaaatcacactgccttcttggctctccgaggaggatgtcagttacctagcaagtgtatatgcaaaaactggcttcgctggtggtcttaattactaccgctgtttagacctgaactgggagctgatggctccatggaccggagcaaaagtgcaagtgccaaccaagttcatcgtcggggacggtgacctagcataccatcatccaggggtcaagaactacatacacaagggtgggctcaagagagacgtgcccatgctcgacgaggtggtggtgatcaagggtgctgggc

SEQ ID NO: 4204 - DNA, 548 bp, Hordeum vulgare
gtgctaacaccggctatgttatcaagtgagctttagctatggaccacaggctttgaagttttacaagtgtactcacatacaggtctctttattaactttgtacatcaacaaatgacctcacaattttgataatttacgtgccggatccatgctaaacttcttgatgtattcatatatgtgttcgctgatctcctgcgctctctcctgctggatgaagtgcccagcacccttgatcaccaccacctcgtcgagcatgggcacgtctctcttgagcccacccttgtgtatgtagttcttgacccctggatgatggtatgctaggtcaccgtccccgacgatgaacttggttggcacttgcacttttgctccggtccatggagccatcagctcccagttcaggtctaaacagcggtagtaattaagaccaccagcgaagccagtttttgcatatacacttgctaggtaactgacatcctcctcggagagccaagaaggcagtgtgatttgcctgttgcttgcctgcattttttcaagggacatggcggaag

SEQ ID NO: 4205 - DNA, 237 bp, Hordeum vulgare
attctatgcggcatgcagagatctacttcggccatataatcctgtcccaaagttcattataatcaaatcagtcgtgtttctcacatactggcagggtgtcctggttttccttgctgccaagtctcgatttatcaagaatgctgaaaaggctgccgatctccagaactatgtattgtgcgttgagatgctcatagcagcgattgggcacctgtttgcctttccctacaaggagtatgc

SEQ ID NO: 4206 - DNA, 548 bp, Hordeum vulgare
  UNSURE (24),(25): n stands for any base
tattagtattggtatttcatttanngtctcatgtcacatcagttcaccttgagcccacaacattgtacacggttagtcgaagagtagggcgagagaggccatgggacagctgtggtgcaggcatgaataagcccccttcttaatagggggaaagactggaactggaagtagtacacacacatttttacagcgttatctatgacaaaatggaaggtcacgattcccccaatcgctaccgagacacataggctgtcgcacctggtcattgttttcttacatcagagatcgcaggaaccttggcagggtagctagacaagtccacgtcgagcaggtccgtgaggtcgtacattcctccaggtgggtcgactttgttcctgatcggagtggtcatcgactcgtcctggtctacctggttggatgatacgcttgaggtcactggactgtttgaggccaccacggtgatgccagccaactccacattccggacagttggcacggcgctccctgaagggaactttgtcggtgcactctccccctcattgtggttg

SEQ ID NO: 4207 - DNA, 502 bp, Hordeum vulgare
agacgaggtatcattagcattgacaaccagtattgcgtctgaggcgcttcatggtgatatttcacaacatcagcgtgagaggacattaaatggtttccgccaagggaaatttactgtgcttgtggccactgatgttgcttctcgtggtcttgatatacccaatgttgatttgattattcattatgagttgccaaatgaccccgagacttttgttcatcgttctggacgcactggacgagcagggaaagcaggaaatgcaatcttaatgtttacaaccaatcagcgaaggacagttaaatcacttgaacgtgatgttgggtgcaaatttgagtttattggcccacctacaatggaagaagtactggattcatctgcagagcatgtcattgctactctgcgaggtgtgcaccccgagtcgattcaatactttgttccagcggctgagagactaagccaagaactaggacctactgctcttgcttctgcattggcacatctgagt

SEQ ID NO: 4208 - DNA, 542 bp, Hordeum vulgare
tgtaacagtctctgaatgctttcttggttctatagaactttacagggcccatgtagtagtagctgttgttaacattctatcaccaactccgacaagcggcaaaccaaaaaaaattaaaacaagcaacgttcctgtaaaacccctagatattacacgaataattcagcggaaggccaggctccccttcggcgtgtcagcagcgtgccagaaaaatcatctcctctgtgaaacgacgaccacacaaaactgtagtagtatctagcacagccagccgttcatcgggcatatgcagatcacagatcgacacacaagggaggccggccttgcgatgttccttggcgttgtgttcagctttgtccagccgcttgtcggaagctgatgaggcccgaacggagcagcgcggcaggcaagcagcacttcgtatgcgccgtctacttgttcgggcagtctgatgctctgtgccctgattgcccgcatgtgaagcacgcgccactgaagcttctgtccctgctgccaaaggacgagccaccgcgaccaccgta

SEQ ID NO: 4209 - DNA, 556 bp, Hordeum vulgare
gatccccccgggcctgcaggaaattcggcacgaggtatgatttaaaggtgaccatttgtcaaagaaaacctagtcgcaacattactatggcccccattagtcacataacaccctgatcccgacatcactatgctcccatagccacgtacccctaatccaagcaataatgtaggtgttcttttttctttgcaggttctcattgagacttgcattgaaaatgttggagagttacttagaacaaactttggcaaagatttattgtatgaggtaatctccttggtccattctccatgcttctacctgtatagccagtatcttgggataatattcattcatctgtgctatttcttcttgaaaggagttacttatgataaatatgcttttacttgcatgaccttcacaagagccaagcattgttcctgattattatttgacaatgtgaaaatgttcttataagttgatgcaaccttttctctgggatgtgttagtccttgtgcccatgcttagtattactgctattcacttttctttaatgatgaatcaacctcctgcaaaa

SEQ ID NO: 4210 - DNA, 547 bp, Hordeum vulgare
ggtagcaactcgccacataatatgtagtcgaactgcgccatagatgacacgtgagccgacatcccctcacatatcttaatttattttggaaatttaatatacttgtgatgggatcatgttggtgtacatgctattcttcttcctccactcatctctgttctcgcttaattgcagcaacaccatggaatgcatgttccatcaatacagatgaaactttcagcatgccaaatatgaaaaggaaatctgctttgaccacatcgtctgctcagatgtgatggtgaacggtcaaacttatgccacatcacacgaatataacctccccagtgacaagtattgacctaaaccaccttaacgacctgtatttcgagtacattggtattcagtgacaaaattgaacatacacctcgagtagaatgaccacggatgtatgtattacactctttcagtttcatccaacaggcaagcacggacgctgccttggcccgcttgcgttgctggcgatggcgaggggaccgtcgagagaagacttcacttcttctccgctgct

SEQ ID NO: 4211 - DNA, 532 bp, Hordeum vulgare
ggaattcggcacgaggatggactgccgccacggccgcgccctcttcctctccaagggccaccgggacacgatggaactcatcgtgtgggagccaatcacgggcgccctgcagcgcgtaccggtgcccgctgccgcggccttcaagagcgaccatccgacggcggccgtgttctgcgcgtcggacggatgcgaccaccgcgactgcctcgggggccctttccgcgtggtattcgtctttggcttgtgtttctgtgacgacgatgacaatgaccaatgtgtcacgtcagcgtgcgtatactcgtcggagtctggcacttggggcgagctgacctcgatgcacgaacagttcggcaactttggagatcattccagcgttcttgttgggaggtctctgctttacttcatgtcatatggggggttgattctggagtatgacttgagcagggacagcatgacttggttggacacaccatgtgagcactacccgaatccggagcaaatgaacctcatgttgatggaggaaggcggactc

SEQ ID NO: 4212 - DNA, 520 bp, Hordeum vulgare
gtaagattgcttaacttttgaataatttaaaagaagaaacattttcttgtatttgtgtacaaaatttctaaatcaagcgatgatatgtgaacataatgtgttcatcatcattggagattattatttttttcttccgtggcaacgcacgggccattttgctagtcttactaaactaactacaaatgtcaaaggtttaatgtgactacggacacgtgaaaaaaaacagtgaactaaatgtaagttattcgtccacacaatccaccatacatacgctacagcctgtctgggagaattaatggagtttggaagtagaaccctaagctgatcttgagggtgtggctgaagcagttaatggcattggcaaagtccgtctccttgagagccttccaccccttatcgaacagctgttgtgcctgctctagtgatttctcgtcccctcccccctgccacccacccacgccctgagtagggttcgggcgtggtggtggatcgtggtctatgcccccaagtgcttggagcc

SEQ ID NO: 4213 - DNA, 544 bp, Hordeum vulgare
  UNSURE (3): n stands for any base
ggnctgcaggcaattcggcacgagggagaacttctttgacccagccacaaagaaatggacctctaagaacactgggacagctacctgcaagaggggttttgttcagttctgctatgagccaatcaagcaaatcatagccacctgcatgaatgatcagaaggataagttgtggcctatgttgaagaagcttggtgtgaccatgaagaatgatgagaaggacttgatgggcaaggctctcatgaagcgtgtgatgcaaacttggctgcctgccagtcgcgctctgcttgagatgatgatatttcacctcccctctccttcaaaggcgcagaggtatcgtgtggagaacttgtatgagggaccccttgatgatatatatgcaaatgctatcaggaactgtgacccagatggtcctcttatgttgtatgtttccaagatgattccagcatctgacaagggtagattttttgcctttggacgtgtttttgctgggagggttgcaactggcatgaaggtccgtatcatgggtcccaactttgttcctggc

SEQ ID NO: 4214 - DNA, 550 bp, Hordeum vulgare
cattatgatctaagttttaacatcgagagacatcaaaacaaagtgccagtaccacgacagataggacattgcaatagcaatacagcgacagactcaattgacagaaaatagcgcagctctcttagcagcataagcaaactagaccatgtaacagaatcaaaaatttagagcttgtcctcaaaatcagatagaggggtcatctgttccttgagacccttgcgcttgcggatctccgtgacaagggtggcagactgggagccagcctccaaaggatcagaagacatgatgtcccagtggtcaaacacacactgggggaaagcctggccagaagtagctgccctgagggtacttgagaacccgaaggactcaatgaccgggaggtaagccttgatgttgtacagcggggtaccaggtctctgcatctcttcaaacacgtgccctctcttctgattcagaacaccatagataccaccaagtgcattctcaggggcctggatctcaaccaggtacacaggctccagcagccttggcttagccgtgagctgagaag

SEQ ID NO: 4215 - DNA, 554 bp, Hordeum vulgare
gtacccccgggtctgcagggaattcggcacgaggggggcgttggacaagcagcggcgggagcggagacggtcggaggttgctcgccgccgacgcaatgggaatcaagggtttgacgaagctgctggcggagcacgcgccgagggccgccgcgcagaggcgcgtggaggactaccggggccgcgtcatcgccatcgacgccagcctcagcatctaccagttcctggttgtggtgggaaggaaaggaacagaagttctgaccaatgaggccggtgaagtcacaagtcatctgcaaggtatgttgaaccggactgtaagattgcttgaagcaggaataaaacctgtgtttgtgtttgatggtgagccacctgacctgaagaaaaaggagctggccaaaaggtctttgaagagggatgatgcttcgaaagatcttcatagtgctattgaggttggagatgaagattcagttgaaaaatttagcaaaaggaccgtgaagatcacaaaagaacacaacgatggctgtaagaggctgttaagattgatgggtgtccctgta

SEQ ID NO: 4216 - DNA, 554 bp, Hordeum vulgare
ggccaaagtgacacaatactttgccggtcaccatgcgacactctagcaggaagcagcgttagatgtgaattaagttgaaacattgaagctaattttctagattacaagacaagcctaaattacaaccatagcattcacttgacatattccaagtggccatctattcttgctgtagcttggtcacagcttcgctaggtaatcttgagaaccaaagcaactccagatttaaatgaaagaaaaggtgggaggcttcacgtgaactcctgattgcctgcccatcaccaatggctttgaactagaactaccatatctgaaaccagagcttgagctactgcatacttgtacagcagtcctgctcctcagaccttgtcctgaagcacctaaaacgcacttggattccttctctgtagatcctgataggttagctactggtgtcaaaagcttcgctcgccctgctggggaatatctatcgctagcagcctttatcttttctactgccttttccactcgatcagaactgaaactgttttcaaatgccaggaaattcacaaggc

SEQ ID NO: 4217 - DNA, 387 bp, Hordeum vulgare
acgagagagcatccaaaagccctaaaccttttgcccacccccattcctccaccccaccccatgggcgccgaccgcctcctccacctcgtccgcgcgccggcggccgcccctgcctgtcctctccgcggccacccccagccaaacagccgggtccgcctccccctgtcgtccgccgccgggatgcgtcgcgtcgccgtctcctactctgcctccggctccggccccgccgacgaggaaggcatgacctacaagggcgccggcgtggacatcgacgccggcaccgagctggtgcgccgcatccgcaagctggcccccgggattggcggcttcggcggcctctacccccacggggatgagtatcttgtggctggcactgatggagttggg

SEQ ID NO: 4218 - DNA, 319 bp, Hordeum vulgare
tttttttttttttttttcccatagaattttttgcaattcattcagatgtatgaacgggccaggagatgattacctgtagatatgattctcaaggaaattcagcacacaagaggcattcacatcaactgtgaagtgatgttcaagatagcaacaccagctgtttgcagcaagttgtcaccaacctagaaacattattcccgttttttttttttgtcaaatctcactggagtaaactacttttactccgatacttagccccgtaagatagattgcggggttacagaaaaactgggctgctttgcccatcagcagctaaaca

SEQ ID NO: 4219 - DNA, 903 bp, Hordeum vulgare
  UNSURE (1),(2),(722),(819): n stands for any base
nnttggcggtaggcctagtaccccacgagttctggaggcaattcgggacgtagggctccggcgtgcggaagacgggcgtcggcggcgtcatccgagatggcgctgcgtaggctcgtgagcacactgatcatagcggagcacgaaggcgggctcgtgaagccatcttccctaagcgcgtctagccacccattggtcaatgaggttcttgttgcggattcagacgtgtttgcgcatcctttagccgagccttgggccgagctgctccgctgcgtgcagcagaaaggtggatactctcatgtgatagcctcgtcgacgtcgttcgggaggaatttgcttccacgcgccgcggctcttctagatgtctcccctgtcacggacgtcactgccatatctgaaccatgggtctttgtgaggccaatttatgctggaaatgcactctgcactgtacgatataccggggagtctccttgtatgatgagtattagatcaacatcattttctctagctaccgagtctatgtcagaaactaaagttgcgcccataacccaggttgacctttctttcctcagtgaagcgagcctaaggaaatcttcatgggtcattcttactttccatgctccctgacccggggacctgtcaaattctcgcgtggtaccccctgggtgtttttttgggcgcggagcgcggagttttgtaataggttcgcaccgcgctcttcgtgngggtggtgtgtgcgcccggggcgggggtgggcggcgtggcgaccctctttgtgctcgtgcttgtggggtctcgccccgcggggccgccgccttcgcncgcgtgtgtttttttcttctctttggcggcgggcttgtcttccgcgcggcgccgacttggggtggggaataagataatagtaga

SEQ ID NO: 4220 - DNA, 536 bp, Hordeum vulgare
gcattattattctctgcatcataaattcaaattccccttcatctctgggcatgcagtcaatactctggtgcatgtatatgtacaaagtggggagatgagtttttgaaaatgtcaactgtcaacacattcctccgattatgctgcttgcacccctatcccagcaaggtgcttattgaccagccaaccatacaacaatgacatatttcgaccaaagcccttccgtgcattgacaaggaacatgatagatgattgacacgagctggacacttatttcttgtctgggatcttctccaggagctcctcgaggacttggaacagatcgccaacgatcccgtaatctgcgacctgaaagattggggcgtctgcgtctttgttgaccgccacaatgtacttggaatctctcatccccgccaagtgttgtatcgcccctgaaactccgaaagcaatgtagagctcaggcgcaacaatcttcccggtttgcccaacttgaagttcattcggcacatatcctgcatcgacggcagctctggtcgcac

SEQ ID NO: 4221 - DNA, 519 bp, Hordeum vulgare
catgggtgggctttcacccttacaaactttgctaagatgtatgcctccaagtttggagttgatgaggcaaagatgatggagaggctgtggggtgagaacttctttgacccagccacaaagaaatggacctccaagaacactgggacagctacctgcaagagaggattcgttcagttctgctacgagccaatcaagcaaatcatagccacctgcatgaatgaccagaaggataagttgtggcctatgttgaagaagcttggtgtgaccatgaagaatgatgagaaggacttgatgggcaaggctctcatgaagcgtgtgatgcaaacttggctgcctgccagtcgtgctctgcttgagatgatgatctttcatctcccctctccttcaaaggcacagaggtaccgtgtggagaacttatacgagggtccccttgatgacatatatgcaaatgctatcagaaactgtgaccctgatggtcctcttatgctgtatgtctccaagatgattccagcatctgac

SEQ ID NO: 4222 - DNA, 552 bp, Hordeum vulgare
aatgcccagtatacaacagatatataatgctaagttttaacatcgagagacatcaaaacaaagtgccagtaccacgacagataggacattgcaatagcaatacagcgacggactcaatagacagaaaatagcgcagctctcttagcagcataaagcaaactagaccatgtaacagaatcaaaagttcagagcttgtcctcgaaatcagatagaggggtcatctgttccttgagacccttgcgcttgcggatctccgtgacaagggtggcagactgggagccggcctccagaggatcagaagacatgatgtcccagtggtcaaacacacactgggggaaagcctggccagatgtagctgccctgagggtacttgagaacccgaaggactcgatgaccgggaggtaagccttgatgttgtacagcggggtaccaggcctctgcatctcctcaaacacatgccctctcttctgattcaaaacaccatagataccaccaagtgcattctcgggggcctggatctcaaccaggtacacaggctccagcagccttggc

SEQ ID NO: 4223 - DNA, 302 bp, Hordeum vulgare
taagaacaatgccactactggaggtctgtccatgactttagcgggaaacaccatgataactggggcgaaggtggaagacaaactttttgtaggcaattggttaacactggcagcaaacgcgggtgcgtggtccatgaaagcgatactgcgcatggagtgaatgtggtgctgaacctgcttcaaaaagactatcccattatgggcctaggccttgcaactttgggtgcatcactggtaaggtggcataaagaatggactacggctgcaaacttggatacccagttctctgtgggaaggacttc

SEQ ID NO: 4224 - DNA, 545 bp, Hordeum vulgare
gcacgaattgcaaatttatgaataaatacagggatatttatcgccagcatgaacaacaaaaacacaggcatctacttggtcgtgttatttgccacatacatgtgcataaattctacagctatgtcaacacaaatagagatacaataaggaacaggagaagcttcaacagtagtttaatagaacaactggaaactcaaagaagagggacagggataaaaatattaggaaatcaaaactacagaactaaccagtgttactcattattcggatgtgcacgaggacgcatcctgttcctaacatacattgccatcgaatagacacctaatagagcaatcgtcagatgctctgaactgttggccttgatgctcactcgtccagttagcttgttgttcaaatcaacatgaactgccatgtttgaagtccttcccacagagaactgggtatccaagtttgcagccgtagtccattctttatgccaccttaccagtgatgcacccaaagttgcaaggcctaggcccataatgggatagtctttttgaagcagg

SEQ ID NO: 4225 - DNA, 520 bp, Hordeum vulgare
  UNSURE (18): n stands for any base
cggcaccggtaactctgnagcattggcctacaaagaatgtagtttagagacaaacataaatgaagttgtggatgattgctgtgatggttccggagatatgcatcctgtcgtgatgtctaatgccagagccatggaagttgacattgcacctgatccagcaagcaccaaagatgaagctgacaatgacagatgtgatcttcctgatgtcttgggatctgttgtggctggtgatatagaaatgaatacttctgagcattctttagaaagaaacattgttgaagttgaggaggccaagggtgatatttctgttgacatgtcttcactcgtggtatgtgatttgaacaatgatattgctgagcagtcttcactcgttgtatgtgatttgaataacgatgttgctgagcattctcctgcaacaattactgtcaaatccgaggacgcgaaacatgaagatacttctgtggatctcgaggtagaagaagatatctaagttggcatggaggaaacttgcgaagctgcg

SEQ ID NO: 4226 - DNA, 552 bp, Hordeum vulgare
ggtgtcctatattttgaagtacagtcggttgttcaaatctttatgttcggttctcgagtatattccattacaaagagaaggaaataggcatacaaccatttcatcttggaatgcaaccattccattacaaagagaaggaaataggcatacaaccatttcatcttgctaaactgagtagtgtaataataataacatgcaacaacgttgggcggcaatattaacacctaaattcaggcgaaccccaaaaggtagcaaacaggctcggtcagtcaggcagctaactatatcatacaagaggtctgtcggatccataagagagagcatgtcacctgtttcagacaagtaacaattgtgcaaagcaaggacaactagcgggtcgctacaccggcctgattttttctaatccacattccgtggcatcgaggagctcctcgtttgtcgcctttctgttgccgacgtcgttggcgggaggaccttgcgacgcttctggcgatgctcttgcttctctgcggtggactcgacgtctttctctgagcacatgccctccgaaac

SEQ ID NO: 4227 - DNA, 211 bp, Hordeum vulgare
tttttttttttttttttttttttttttgaaaaaaatgccagtatcacaacagatatataatctaagttttaacatcgagagacatcaaaacaaagtgccagtaccacgacagataggacattgcaatagcaatacagcgacggactcaatagacagaaaatagcgcagctctcttagcagcataaagcaaactagaccatgtaacagaatc

SEQ ID NO: 4228 - DNA, 425 bp, Hordeum vulgare
accccttccattctcttcttccgggagcgccgccgcttcctcatccctcacctctccgctcggtagccggaagcgaaaccccaagaaagtatagtcccagcgtgaaattcaaaagcagtcaagatggtgaagtttacggcggaggagctccgtggaattatggataaaaagaacaatatccgtaacatgtctgttattgctcatgttgaccatggcaagtctactcttacggattcccttgtggcagctgctgggatcattgcccaggaagtagctggtgatgtccgcatgactgatacccgtgcagacgaggcagaacgtggtattacaatcaaatccacgggtatctctcttttctatcagatgactcctgaatcactcgagatgtacaagggcgacagggatggtgatgagtacctgatcaa

SEQ ID NO: 4229 - DNA, 518 bp, Hordeum vulgare
cttcctcgccgacatcgccgtctacgacgttgagaacaggctatggtacacgccggagtgcagcggcagcggcccggacgggcagccaggccccagcccgagggccttccacgtcgctgtggtcatcgactgcaacatgtttatcttcggcggccgctccgggggcaagaggttaggtgacttctggatgcttgacaccgacatttggcagtggtcggagatgactggctttggcgatttgccgtctccccgggagtttgctgccgcatcagccataggaaacagaaaaattgtcatgcatggtggttgggatggcaaaaagtggttgtctgatgtatatgtcatggacacaatgtcacttgagtggacagaactagcagttactggatcagcgccacctccaagatgcggacattctgccactatgattgagaagaggctgcttatatttggaggcagaggtggaactgggccgataatgggtgacctctgggctttaaagggtattactgaagaag

SEQ ID NO: 4230 - DNA, 544 bp, Hordeum vulgare
gataatttgctccgtgcctccatggagctctttattttgacaattttaaaattacatttgtacatccaagaaaacaaaagagattctagcttgtagagcgttagatacagagggagtcataaaatcaccatataaatatgacattttgtttttatgcatttcgcaaatacaacatttcctcgtcaattttgctcatcaatagtctgtttgcttgcttgccctgtggcctaggtggctgggccgtcgtccttctcgccccgcgcatcggaagccacagaagcagagaaccgatggtcgtagcacaatggttttagcccacaaggacctaccaggcaaaatagttgtgtgaccctctatcaggtggaaagcagagttctatactcgcccagcaagatggggatgtcatccatgcgcaactgtgaggcatttttcaaatggaagaggcggcgatcttccctttcaaggaatgtcggggatgggttttccacgaagcggcggataatgagacgttgatagtccctcagcagagggcctagctcctgga

SEQ ID NO: 4231 - DNA, 518 bp, Hordeum vulgare
tgcaactaccctctggtggtacatttgtgattgcccactgcctggcagagtccaagaaagcagaaacagctgctacaaactacaacaaccgtgttgtagagtgtcgcttggcagcgattgttctcgccatcaaactagggatggatgcaaaaaaagccatcacatcagttacaaccctctctgatgttgaggggctatgtgtctcctttgctggcaaagaaggttcttcggatcctggagttgctgtgaagaagctattgcatgaggatccatatacgttggaggaaatagagaaaattacaggtcaaagcctggcaactgtctttcagagctctcaaacttcattggatgttttgagagctgcgaagcatttcaagttatttcagcgcgcctctcatgtgtactctgaagcaaggcgggtgtacgcatttaaggatactgtattatcaaaactcagcgatgaaggcatgcttaagaagctcggtgatctaatgaacgatagccatcatagctgcagt

SEQ ID NO: 4232 - DNA, 546 bp, Hordeum vulgare
gaacacgataaatgaggctcacattgtagtattgtacattcagacacgcatgggtggggactaattcagctaatggcagcgtgctcggacctccgagcacgcgtttattcgatcaataggttgcgggcgagtatgtgtgcatgcatgtacaagtgaccgaccacggccggaagtggccgatctacagcctcagtatggccgcgccactcgacggcttcgaagcaaacaggtacaggccaatgtcgctctgcttgatcactcccctgtcgatccttgatttgtagtacttctccttcaaattgaggatgaactgtgggacgatgccctccttgacgagggcgactgcacagccgccccacccggctcctgtgagccgagctccgagcgccccattgtcccggcacacttttacaagctcttccaactcgggacagctgcattcatataacacactgcagctatgatggctatcgttcattagatcaccgagcttcttaagcatgccttcatcgctgagttttgataatacagtatccttaaatgcgt

SEQ ID NO: 4233 - DNA, 553 bp, Hordeum vulgare
  UNSURE (20),(46): n stands for any base
gtacccccgggcctgcaggnaattcggcacgaggacggaaaggggnctattccttcactacaaccgcagagcgggaaattgtaagagatataaaggagaagcttgcctatgtcgcccttgactacgagcaggagctggagacagccaagagcagctcgtctgttgagaagagctatgaactgcctgacgggcaggtcatcacgatcggtgccgagaggttcaggtgcccagaggtgctgttccagccctcgctgatcggcatggaggctcctgggatccatgagaccacctacaactccatcatgaagtgcgacgtggatatcaggaaggacctctacggcaacattgtgctcagtggagggacaaccatgttccccggcatcgcagacaggatgagcaaggagatcaccgccctcgcgccgagcagcatgaagatcaaggtcgtggcgcctcccgagaggaaatacagtgtctggatcggtggctccatccttgcctctctcagcacattccagcagatgtggatatccaagggagagtatgatgaatctgg

SEQ ID NO: 4234 - DNA, 495 bp, Hordeum vulgare
acaccgatatacttaatgggaaggaaataattatacatacacagccagcgttctgcactctgcagccacacaacagcccaagcccaaacccgaaaccggtgcgtcgcacacgcaccggctaaatatcaaccaacatagtagtatatcactaagaacaagcggcatcttctgtattaagtgatacaggacctacttttccttcatccgtgaaaacggccgcagaaagctcggggaatacttcaatggaggggagtcggatacaagctcaatcataggaaaagtgcacagagacacggcccaaggcttagaagcacttgcggtggacgatcgaggggccagattcatcatactctcccttggatatccacatctgctggaatgtgctgagagaggcaaggatggagccaccgatccagacactgtatttcctctcgggaggcgccacgaccttgatcttcatgctgctcggcgcgagggcggtgatctccttgctca

SEQ ID NO: 4235 - DNA, 545 bp, Hordeum vulgare
gtcccccggctgcaggattcggcaccaggccctcgtgccgaattcgcacgagggccgacatcgccgtctacgacgttgagaacaggctatggtacacgccggagtgcagcggcagcggcccggacgggcagccaggccccagcccgagggccttccacgtcgctgtggtcatcgactgcaacatgtttatcttcggcggccgctccgggggcaagaggttaggtgacttctggatgcttgacaccgacatttggcagtggtcggagatgactggctttggcgatttgccgtctccccgggagtttgctgccgcatcagccataggaaacagaaaaattgtcatgcatggtggttgggatggcaaaaagtggttgtctgatgtatatgtcatggacacaatgtcacttgagtggacagaactagcagttactggatcagcgccacctccaagatgcggacattctgccactatgattgagaagaggctgcttatatttggaggcagaggtggaactgggccgataatgggtgacctctgggcttta

SEQ ID NO: 4236 - DNA, 541 bp, Hordeum vulgare
tagcttgtatttccctccgtaaagaaattaagagcgtttagatcacagagggagtacatcaaaatacaaccatcatagatcatgacattttgtttttctatgcatttcgcaaatacaacatttcctcgtcaattttgctcatcaatagtctgtttgcttgcttgccctggggcctaggtggctgggccgtcgtccttctcgccccgcgcatcggaaaccacagaagcagagaatcgatggtcgtagcacaatggttttagcccacaagcacctaccaggcaaaatagttgtgtgaccctctatcaggtggaaagcagagttctatactcgcccagcaagatggggatgtcatccatgcgcaactgtgaggcatttttcaaatggaagaggcgacgatcttccctttcaaggaatgtcggggatgggttttccacgaagcggcggataatgagacgttgatagtccctcagcagagggcctatctcctggagctgtattgagctggatggagaacttctccaatgatcacgaagtgcctgaa

SEQ ID NO: 4237 - DNA, 519 bp, Hordeum vulgare
  UNSURE (1): n stands for any base
ngtccgtatcatgggtcccaactttgttcctggccagaagaaggatctatatgtgaagagtgtccagcggactgttatctggatgggaaagaagcaagagtctgttgaggatgttccctgtggtaacactgttgctttggttggtttggatcagttcatcacgaagaatgcaaccctgacaaacgagaaggaagttgatgcctgcccaatcagggcaatgaagttctccgtgtcccctgttgtgcgtgttgctgtccagtgcaagacggcttctgatcttcctaagcttgtggagggtttgaagcgtctggcaaagtctgatcctatggttctctgtaccattgaagagtctggtgagcatatcattgctggagctggagagcttcaccttgaaatttgcttgaaggatctgcaggatgacttcatgggtggtgctgaaattattgtttcccctcctgtcgtctccttccgtgagactgttcttgagaagtcctgccgtacagttatgagcaagtcccc

SEQ ID NO: 4238 - DNA, 541 bp, Hordeum vulgare
  UNSURE (3): n stands for any base
atnctgatgacagatatatatatgatctaaagtttaacatctgttacatcaccacaatcatcatcaaaacatagtctcaggtagcaccacatacaaacagcaagatacacatcgggagaaaataatgcggctcccttcacagcaagggcaagtagcaaaacattacccaaaatttagagcttgtcctcgaaatcggataggggagtcatctgctccttgagacccttcctcttgcggatctccgtcacaagagtcgcagactgggtgccggggtccaaaggatcagaagccatgatgtcccagtgatcaaacacacactgggggaaggcctggccggacgtcgcagccctgagggtgctcgagaacccgaaggactcgatgacaggcaggtaggccttgatgttgtagagtggggtaccttgcctctgcatctcctcaaacacgtgtcctctcttctgattcagcacaccatagataccaccaagcgcattctccggcgcctggatctcaaccaggtacacaggctccagcagccttggct

SEQ ID NO: 4239 - DNA, 506 bp, Hordeum vulgare
gtcccccgggctgcagggcgaccgcggccatggaccgcccatttggcgcaatcgtggtccgcaacgacaaagtggtggtcagttgccataacatggttgtgaagaacaccgatgcaaccgcccatgccgaagtaactgcaataagagaggcttgcaagaagctcggcaagaccgacttgtcggactgcgaaatgtatgcttcctgcgaaccttgcccgatgtgttttggcgctgtccgtctgtcccggatcaagaggcttgtgtatggagccacggcagaagctgctattgccatgggaagctgctaccagaatgctaacctggagataaagcgagcagatgggaacgaagccctgcttgctgaacaagtgtttgagaacaccaaggggaaatttcaaatgtactaacagtgtgtatatatagacggcattggtgtgattttgcatcagaaaacataatgcaatcgtcaaaaaatctgtcattgctgatgaaaaaaaaaaaaaaaa

SEQ ID NO: 4240 - DNA, 462 bp, Hordeum vulgare
gacagattttttgacgattgcattatgttttctgatgcaaaatcacacccaatgccgtctatatatacacactgttagtacatttgaaatttccccttggtgttctcaaacacttgttcagcaagcagggcttcgttcccatctgctcgctttatctccaggttagcattctggtagcagcttcccatggcaatagcagcttctgccgtggctccatacacaagcctcttgatccgggacagacggacagcgccaaaacacatcgggcaaggttcgcaggaagcatacatttcgcagtccgacaagtcggtcttgccgagcttcttgcaagcctctcttattgcagttacttcggcatgggcggttgcatcggtgttcttcacaaccatgttatggcaactgaccaccactttgtcgttgcggaccacgattgcgccaaatgggcgtccatggccgcggtcg

SEQ ID NO: 4241 - DNA, 261 bp, Hordeum vulgare
  UNSURE (239): n stands for any base
gagacggttgcccagaaggaagaagagggaggaaccacccaacggcacgcacgcacagggaggcgacggctcggccatccatggcggcgtgcgcctgaccgggccacaggataggctacgtcccgccggagatgaaggtctccaccaaggagcagcagcagaggccggaggcggggaaggagggggccatggactctggagcagcgaagcgggaggatgaggaggaggaggaggcggcncggcccgccggggatgggggca

SEQ ID NO: 4242 - DNA, 416 bp, Hordeum vulgare
ttttttttttttttttgatgcaccacgaaaccatacatacattcataataatcgtagaatgtgctgccactcaaggctagccagcaaaggttagatacatctacaactgctactacaaagctacaaaagcaactcctaattcaattcaatcagcatcaacaacagcatcagacatctctctccctgcacacacacatgagcagaggaacaacccaagccaagcctccactcaagaatccttcctacaagagcaagccaagccaagcacccaccaaagaatcgcacccagacgcgagatgcctcaactgcagcaattacccactccaaccaatcggcaataatcgtcaggaactgtacagagaccacagacggctggccggatcgcctagtcgaagctcgaggaccggctccagtac

SEQ ID NO: 4243 - DNA, 551 bp, Hordeum vulgare
gtctccccgggcctgcagggaattcggcacgaggctctcttgctcgcccaggcggccatggaagctctggccgtcgcctcgccggccctgacgcggccccagccccgccgacgatgcctcgccgcaggttcttgtagctcgtggtgccagaggaggacgagccaactgcacacctccttcagcggcgtcacggtgcagctgcacaaaccgctgagcccaacggcgaccagttcccggcgatcatcatcgtcagtggtggcggtggcgatgttgtcgcgtccgtcgatccagttcatccagggcacggacgagcagacgatcccggacgtgcggctgaccaagtcccgggacggcagcaacggggtggccatcttcaccttcgagcagccgtcggtgttcgactcgtcggcggagctgggcgacatcaccggattctacatggtcgacgaggagggcacgctgagctccgtggacgtcagcgccaagttcgtcaacggcaagccggcggccgtggaggccaagtacgtgatgcgcacccccagggactggga

SEQ ID NO: 4244 - DNA, 552 bp, Hordeum vulgare
  UNSURE (21): n stands for any base
tttcaaagcatatatattatncaaagaatcaagggagaaaaggcagcatgaagaatcaagcatcgcatgctcaatgaacagggtacgcagccacagagcacacaaatcaacagtcacagcgatgactgaactcaatgcagctagttttctgtcaggaatccatccatgaaaccaaaaacatgtagaagaagaataagaatcgaagatgaattcatggatgatgatgatgatgatgatggattggatggacgaacggacggatggctacttcttgaggaactggaggccgttggcctgggagtagcgctccatgaagcgcatgaatcggtcccagtccctgggggtgcgcatcacgtacttggcctccacggccgccggcttgccgttgacgaacttggcgctgacgtccacggagctcagcgtgccctcctcgtcgaccatgtagaatccggtgatgtcgcccagctccgccgacgagtcgaacaccgacggctgctcgaaggtgaagatggccaccccgttgctgccgtcccgggacttggtcagccgcac

SEQ ID NO: 4245 - DNA, 1060 bp, Hordeum vulgare
  UNSURE (1)..(3),(20),(22),(26),(36),(37): n stands for any base
nnnttccaactgccgcatgnancccnaaatgtgggnncatcagaacgtcgcttgaaccgtctacagactttcggttatggaccgcatttaggggtaggagtctcgaccaaaacctggaaaggtatgcatctggcgttggagacactgcttcgtctacaaaaggaggctctgaatccccgccaagagcaatcgggggaatctatgacagaatggcattcccattgtcactgatgcatgcggatgattatgtaccaaaaatgctagggggggggggcgatgttttttatatttttcaccatgttgccgcccaattcgtcttaatgggggggggaggctcattctctcccacccccggtccttcttttggcccttaacttgtcgtcaattctcctttcttctcaataatggtcatccccagccagttccatctctcttatatccctttctctacgtcaccttttacacacctgtggtttcttattcttcccctgttcgcgatctgttcattttttctcttggctgattgtcacccttgcgctagttttctccccaattcttcctctgttcacgtttccttcgcatttcgcgtttctttttgcgtagtttctcgtcttctccttatcgacgtcggttgctgtgttactttctttacctttgtatatgccattgtagttttcccaaattttagcgaacgcgtcgcgcagtcgtgctatttgatttggtgctccagcacaattagccttttgcctatttgtcctctcccctcgttttactctcttccgtttctccttttcttctccgtcgttctcttctgtttggataccgagttgcccgtattccctcttaactggtttcttattgcggtccttgtcttatccgcttctttttccagttcgccgtttgttttccacttgtccgctcactccatttcctttagtatccccgttctgttccccccggtcgtgttttattagcttcgtccgcgatcggttattacccgcttattgtattccgcgttaattttctccgcccttatttcctttgtaccacttttctgact

SEQ ID NO: 4246 - DNA, 559 bp, Hordeum vulgare
  UNSURE (22),(23),(45): n stands for any base
gccaataaaaaataaattaatnncttccatggcaaggccacaagnctactggggacaatccttacatagatgaaaacaaatccagtcaacagtctaacaacaccagaaaacctaatcttatttagcagtattacttgtcacattttatgcgctagtgaagtttctcgggttaatatacatatactagcttcagaaaatactagaaaaagtataccgtactagctaagaaccatgtacacatctcggtacagtactgcagtgacagccaagagccaacaagttggtaagacgtgctgcctatgaaaacagaggcgattttttgtcgcccattgcataagagattatgttcttcttcagtggtgatatgtactgggcaccatggaaagctgcggctcttagcacattgaggggtccaaaatcgacagagtacatcttctggaaaccatctagaactgccgccatcgcaacattagcagccttgcggtcattctcataccgattcagcaaagatagatccccaatatcagcaccaacagaaactccttcagaaataacttcc

SEQ ID NO: 4247 - DNA, 519 bp, Hordeum vulgare
gagaagagaagcagaggtgtggggaggagagccagcagccctgcagcagccacagcgaagagcggcggccgccggcccagcccccccgccctatgcgatgttggccaggtcgccggcgccgcccttcctgacggccaccgagactgctgctgcgccggccttcttccagccctgcgatctctcgacttctccaagtgtgatcctttccaagaagaaacatggaacaggattaactgtccggccaaacattcagcacggcaaagctcagtacgcaagtaggatccacagaaaatggcgggcattctcatctgacccagcacaggccgccgctgtcgtggatactggtgacagcaaaacatgggaagagtgcaaggagatactcacctcattgaatttctccaccgaagacgccgagaagatgctgaagaaggcgttcggatggctccattcgccgtactggaccgaggagagaaagaaggaggttccgagcgccgaggtggtaaacggagtgctggacta

SEQ ID NO: 4248 - DNA, 503 bp, Hordeum vulgare
gtttgacttaagacaaaaatcaatggagcttagtaaaccagccgtaagagtacatccatctatacaaatctgcttggtttgaataaccgacaccgaaacagacagacagttggtaacatatatcatcttaaattctgaagctctccacagtaataacaatgcagaacagcacactaaaacctaacccagcagcgggggcactgcgccgcgcagtcccctcggcaatctacattgtagcccaaaaccttgggattccgtaagaggacactccggagagtcttcccgtttatcccccagtcgctgtccagcttgccgacgttcagcttcacctcgctctcaagatcgcacccaagaacctccgggaatttcttgagcagcttgtaaagatcgtcgtcggagagtccaaggccccttacgtagtccagcactccgtttaccacctcggcgctcggaacctccttctttctctcctcggtccagtacggcgaatggagccatccgaa

SEQ ID NO: 4249 - DNA, 517 bp, Hordeum vulgare
ggggcactcaccgggtatggtttccactaacatgccattgtatgtgaagggtaatagacgcatactcggccaacaaccaaatgtcatatctgggagccgcaacactatcagatctggaagcaacaatgttgtatctgggaatgacaacacaattctatctgggaacgacaatgtcgtaactgggagcaacaatgccgtatctggtagcggcaatgtcgtaactgagagaaaccatgttgtgtatgggagcaacaatgttgtatccgggagaaacaatgttgtgaccgggagcaacaatgttgtatcagggggcaaccatgtcgtatctgggaacaacaaagtagtaactggaggatagtgatatgtgagtggattgattccctcttcccccgaggagctcatgtccttgtccaagttcaatgtagtttacaatcgcttgatgagcccaatcgcgtatttgtaacttcatgggtatagtatccttttactacttaaatatccacaaaacgttttacat

SEQ ID NO: 4250 - DNA, 560 bp, Hordeum vulgare
  UNSURE (16),(24),(32),(33): n stands for any base
gatagcatcacacatncacatggnaatacaanngagatgcaataataccacgtctagacatccatgatgagaatttgcacataagcaaacacgcttgataacatcggcttcaaactagtcactgtttagttcagcatgtatgtaaaacgttttgtggatatttaagtagtaaaaggatactatacccatgaagttacaaatacgcgattgggctcatcaagcgattgtaaactacattgaacttggacaaggacatgagctcctcgggggaagagggaatcaatccactcacatatcactatcctccagttactactttgttgttcccagatacgacatggttgccccctgatacaacattgttgctcccggtcacaacattgtttctcccggatacaacattgttgctcccatacacaacatggtttctctcagttacgacattgccgctaccagatacggcattgttgctcccagttacgacattgtcgttcccagatagaattgtgttgtcattcccagatacaacattgttgcttccagatctgatagtgttgcgg

SEQ ID NO: 4251 - DNA, 518 bp, Hordeum vulgare
cgccctcctccgcgccgtctggtccggcacctcgtgctgcggctgggaaggtgtgggctgcgacggcgcaagtggacgcgtcacgacgttgcggcttcccggtcgtggccttgtagggcgcatcccaggagcatcgttggcgggcctggcatggcttcaggagctcaaccttgccagcaacagactggtcggcaccatcccatcgtggattggtgagcttgaccacctttgcgacttggatctctccggtaattcactggatggggaggtacccaagagtttgatacggcttaagggccacgccgccgctggtcgttcatcaggtatgactttcactaacatgccattgtatgtgaagcgtaacagaagaacactccaacaacaacaaccaaatatcatatccgggaccaacaacaaagtacggtctggtagaaacaatgttgtatccgggaacgacaacgctgtcatatctgggaacaacaacactgtggcggggagcaacaataccatcacaactg

SEQ ID NO: 4252 - DNA, 552 bp, Hordeum vulgare
gtataatttctgggaaattttatttaaagtaggaaaaggatgctatatccatgaagttacataacacgattggccccaccaagtgattgtgagctagattgactgaccatccattaacctcctgtgacgactttgttgctcccagacacaacatgattgctcccagatacagtattgttgctcccggatacggtattgagactcccagatacggtgtggaagcttccggatacattattgtcaatcccagaaacaacattgttgttgtctgttacgatatgtttgctcccagatacgacatggttgctaccggttacggtattgtcactcccagttgtgatggtattgttgctccccgccacagtgttgttgttcccagatatgacagcgttgtcgttcccggatacaacattgtttctaccagaccgtactttgttgttggtcccggatatgatatttggttgttgttgttggagtgttcttctgttacgcttcacatacaatggcatgttagtgaaagtcatacctgatgaacgaccagcggcggcgtgg

SEQ ID NO: 4253 - DNA, 516 bp, Hordeum vulgare
aaacaatgactggcggagaatttcgtagtgctgtgggctgggcaagacgagctcatcaggatgcacgagcaggcatccccgatgttcaggtacgagctgagccggatatcagcgggtgtgttcatcgcgctcgggcaagggaaagtgcagtgccccagcgatctgaggagtcaactgtttcggggatggttcacgccgatgttgaccgatttcggctggcttcaaaggtgctccaaggggctggatgcgagagcgctggaggatagcctggggcaagcccttctcacccttccgctccgggagcagcagagcctgttcgaggaatggttccagtgcttcgcgtctagcggcgcggaatgcccgaaccttagccgagccttccaggtatggtggcgaaggtcattcgctagatagatcgtcggtagagcccctgcagcggcatcctatgagattatacctggttcgcgtgagttatattggtatttgtagtgtgtgtatgattgtaagataagaaga

SEQ ID NO: 4254 - DNA, 510 bp, Hordeum vulgare
cagtcatacacacactacaaataccaatataactcacgcgaaccaggtataatctcataggatgccgctgcaggggctctaccgacgatctatctagcgaatgaccttcgccaccatacctggaaggctcggctaaggttcgggcattccgcgccgctagacgcgaagcactggaaccattcctcgaacaggctctgctgctcccggagcggaagggtgagaagggcttgccccaggctatcctccagcgctctcgcatccagccccttggagcacctttgaagccagccgaaatcggtcaacatcggcgtgaaccatccccgaaacagttgactcctcagatcgctggggcactgcactttcccttgcccgagcgcgatgaacacacccgctgatatccggctcagctcgtacctgaacatcggggatgcctgctcgtgcatcctgatgagctcgtcttgcccagcccacagcactacgaaattctccgccatgtcattgtttcctcgt

SEQ ID NO: 4255 - DNA, 543 bp, Hordeum vulgare
  UNSURE (3),(11): n stands for any base
ggnctgcaggnaattcggcacgaggtgacaatcacctgcatcccaaacttgtttcttgctgagttcctgcgtttgtgtatacataccacaggccacagctgcatccatggcgaaatgctgcctactgctcgccttcttgttggcgtttcttctgccggtggcctacacaacgagccaccctgacgacctccaagcgctgcagggctttgccgggaagatcaatagaagaacactccaacaacaacaacaacaaccaaataccattactgggaccaacaacagtgtcagatcagggagtggcaacattgtatctgggagcggcaacactgtcgtctctggggacaacaacaatgtttctgggagcaataacacagtcacctctgggagcagcaatgtcatagttgacaccaaccatgtcgtaaccgggagcaacaatactgtatccggcaataacaatagggtaactggaaacaataatgttgtatcaaggagcaaccaggtcgtgtccggcgacaacaaagtcgtaactggctaatgatctgc

SEQ ID NO: 4256 - DNA, 557 bp, Hordeum vulgare
caatcttatatatataaatactacacattacaggtaacaaaactacataagagatgaaataacaacatgtagacatccacgatgaaaacttgtacataagccgcaagtcgccattgctgtgcaggtcagcatttattatgtaaaaaatactaatgatattttaggaaaactttattttaagtagtagataggatgctatatcgatgaagttacaaatgtgattgggcccaccaagtaattgtgagccacactgaactcggacaaggacgtatgagctgcaccatggaagccgaaatcaatccactggcagatcattagccagttacgactttgttgtcgccggacacgacctggttgctccttgatacaacattattgtttccagttaccctattgttattgccggatacagtattgttgctcccggttacgacatggttggtgtcaactatgacattgctgctcccagaggtgactgtgttattgctcccagaaacattgttgttgtccccagagacgacagtgttgccgctcccagatacaatgttgccactccc

SEQ ID NO: 4257 - DNA, 444 bp, Hordeum vulgare
  UNSURE (7),(8): n stands for any base
gcacagnnattatgtctctaccagatggtaccgggctccagaggtgctgctgcaagcttcagcttacacgccttctatagacatgtgggccattggtgcaattctggctgagctttttacactgtctccactttttcctggtgaaactgagacagatcagctattcaagatttgcgctgtgcttgggaccccagatcactctctctggccagagggaatgaacctgcctcgttcaagtagcttccagttttttcagattccgccaagaaatctgtgggagcttattcctaatgcttccctggaagctttagacttgatcaagcaactttgctcctgggatccacggagaaggccaactgctgagcaagcactacagcatccattctttaatgtgcgcaagtgggtacaaagacctctccatgatgcttcctactcaaagatgaa

SEQ ID NO: 4258 - DNA, 496 bp, Hordeum vulgare
  UNSURE (18): n stands for any base
gcattataaatatatatncaagaaaaaacccatgtgtgcattcgtacaaaactgtttgtatgtacagagttaacagaatctcaaacacgatgctgtgaaacctactacgaatatgtatgtacatttttgttgctgtctgctgccgccaccgccgtcgccgcgcctcgccacggcggcttattgtccgagtctagcactcgtataaaaaataactccacgcaccacgcactctgggtgattgatgatgatgatcatctactgctgttgataaacgtcgggggatcatcattattcagtcgtcggtcagaagaaattgacctgccggatgggcgccggcgccagcgaccggttctccatgaggttgggctgcagagggaacagcccgaacggagaagagccagggaatcctcctccccccgcagcagctggcagcgtggtggcatggctgtcaagcatgtacgcctgttgccaggatggcatgaccggggctttcccc

SEQ ID NO: 4259 - DNA, 311 bp, Hordeum vulgare
attcccgcatctccactttccatctccgccggccgggatctgaagcaagcaagctccgatcttgccagccagccagcggccatgtcttcctcgtcggacaaccccaacgaagtcaccgaccgcggcctcttctccagcaagagcaacaaggacgacgccgacgccggcaagaagaagaagaaggaggaggagagcaaggaggagggcggcggcgggttcatcgacaaggtcaaggacttcatccacgacatcggggagaagatcgaggaggcggtggggttcggcagcccagcgccgacgtcgcccggaat

SEQ ID NO: 4260 - DNA, 264 bp, Hordeum vulgare
tttttttttttttttttttaacaacaaaggggcgatggaatttattctcaggtctgtttccacttaacaaagttaacacggaaagaatacacattggatgggttcccacaacgaacactgagcaccgaagcataaaaacacggacgatgttcggacgacacaatcaacaaagataccatgagctagagcgagagttcagctggtactaagggtataggtaggcatccccttgcagcatcctcccttgcgccctgtttaactatc

SEQ ID NO: 4261 - DNA, 522 bp, Hordeum vulgare
gctcaaacactctggcgggctcattcctcaagtacaactccatgcagggcttcgtgcccaaccctctcctcagccccgcgcattggtgtaaagatcctaaaaggcccattcaagatgttacaaaggacctagtaggttcctctgtttctgtcaaggtcgttgaagcgaatgaggcagaaaaaaagcttgtcttctctgagaaggatgccagttggtcattgtactcttctcaagtaaagattggtggtatctatgatggaattgttggttcagtgttccactatggtgcatttgttcacctgcaatttcctgatggaaattatcatctcactggtctcgtacatatctctgaggtctcttgggatcttgtccaagatgtccaagattttctaaccgaaggtgataccgtcaaggtcatagtggtgaatgttgatgcggagaaatcaaggataggtttgtcaatcaggcaattggaggaagatcctctgctggagacattggacaaaattattcctttggaac

SEQ ID NO: 4262 - DNA, 450 bp, Hordeum vulgare
tgtcgcgcgccattagcataagtatttattattacatatacttacatgggaacttgagggttcacttctttttacacgcgtgccatctcaggcaccaaccaaatgattgccgatcgacgtgctatatattccagtggtgaaaaaatgtacaactgagcctcggcacaaagccggcccgtaaactggcgttttttttttcttcttccaactaaagtatgtacattgtggtcgcttagttagggtagggcacagtccggggatgattgatatacctcattcttccgaattccgatgagctacgggcgggctggcaggcgggctcagggaacgcgtcctagtactctttgcaccgccttcttcaccccctcctggtctaggctcgtcgtcaggtacacttcctggacctgtctcccagctcgagcaagaagcttgtactggttgtccttagct

SEQ ID NO: 4263 - DNA, 461 bp, Hordeum vulgare
gggctgcaggaattcgttacgagggagaggtttaccttcagagaggtgatgtgggcattctccatttacttggaagctgtagcgattctgcctcaacttgtgttgctacagcgcacaaggaatattgacaacttgactggccaatatgtctttttcttgggtgcctaccgcgtactttatatcctcaactggatttaccgatacttcactgagccccattttgttcactggataagctggattgcgggtatcgtgcagactatgctatatgctgacttcttctactattacataataagctggaagaacaacgtgaagctagagctaccagcctgagcttgctgtttcctttccaagaaagactaagtattacgggcttggtttaactaaatgggatggaccgaaccaaaccttgagtcacaatggatcccactttgggccggtttttggggcccccgggg

SEQ ID NO: 4264 - DNA, 547 bp, Hordeum vulgare
ttaagtccgtactttctttgaggaaccacatggaccctacaacattgcgagttatgaaatacaaccatataagcagcgtacactcaccaaagggagtacagcagcagcaccgccatcgagttccaaacagtatcacaagcacacggcccccttatattaccttacaagatacaaggcgaacctagctttcacctccgaaaacgttagaaggaaacaggaaaaaccagggacccaaaacgcacatatgtatcatgtgactcatgtctgttctgtctatccatttagttaagcaagccgtaatacctagtctatcttggaaggaaacagcaagctcaggctggtagctctagcttcacgttgttcttccagcttattatgtaatagtagaagaagtcagcatatagcatagtctgcacgatacccgcaatccagcttatccagtgaacaaaatggggctcagtgaagtatcggtaaatccagttgaggatataaagtacgcggtaggcacccaagaaaaagacatattggccagtcaagttgtcaatat

SEQ ID NO: 4265 - DNA, 453 bp, Hordeum vulgare
gcaagccgggctccctgctcgacctcttcttcgaaagcttccggacgggggagggcggcgtggcgcggctgctcgaccacctcgtcatcgtcaccatggacccggcggcgtacgccgggtgccagctcgtgcaccggcactgctacttcctcaggaccaccggcgtcgactaccgcggcgagaagttcttcatgagcaaggactacctcgagatgatgtggggccgcaacaagttccagcagaccatccttgagctcggatacaacttcctcttcacggacgtggacgtgatgtggttccgtgacccgttcaagcacatctccatgggggcggacatcgccatctccagcgacgtcttcatcggggacccctacagcctcggcaacttccccaacggcggcttcctcttcgtgcgatcatgcaacaagaccatcgagttctaccggcactggc

SEQ ID NO: 4266 - DNA, 555 bp, Hordeum vulgare
  UNSURE (13): n stands for any base
tttaccactcctnctttaattaattaccaggcctggagattcggccaagaccaggatacatgcatgtgctgcacgcacactggagtactaccgctctgtgtatatttgtgtacatacatatataataacttactaatcatctagctgaattaattccacaaaatgaatcgatgctacgtacccctctcaatcccctcccatctctttccacgagaaaaggagaaggcaaagcaagaagaagagaaagaatgggcaaccaaatgcatggaaccatgcatgcaactcatccaaccaacagcagttgcatcagtggatgcatatcccgggtaccttccactggaacttgccggccctcttgtcggtcaccggcgccgccgtgtagttcctccacacatccagcacattcctcaaatcatgcagcttggccccaagcccaacgcagcaattcgcatgcagcgtgcagatcttgttgaggtccctgctgagctgacagaagccgctgatgtaggtggtgtcgaggaactggatggcgacgccgaggcggtccgtcatctc

SEQ ID NO: 4267 - DNA, 553 bp, Hordeum vulgare
  UNSURE (20): n stands for any base
gtacccccgggcctgcaggnaattcggcacgaggcacagaggtggtcaaacaaaggatgcaaactggtcaatttaggactgcgcctgatgctgttcgtctgatagttgccaaggaaggatttagaggcctttttgctggttatggttcatttttacttcgagatcttccgtttgacgctattcaattctgcatatatgagcaacttcgaattggttacaagcttatggcaaagagggagctgaaggatccagagaatgcactcattggtgcttttgccggtgcaattactggcgctataacaacacccctcgatgttctgaagacaaggttgatgattcaggggcaaacaaagcaatactctggaattgtaagctgtgctaagacgatcttgagagaggaaggtcccggcgcctttttgaagggcatcgagccgcgagttctgtggatcggcatcggcgggtccatcttctttggcgtgctggagaagaccaagtcggtgctcgctgagaggagcagccgcaaggctgtgctggcagagaaggacaagtgaac

SEQ ID NO: 4268 - DNA, 542 bp, Hordeum vulgare
cgggtaactttattaaaggacagtaatgtttacaggggactcatacaggatcataacgataaccgacatctgaaacaaactcttgaaactgattgtatgctctatggttctggaagaagaagcactgcccaacacaaaattggagcaaaacttgaggttaaaggaacgggtaaatggtgggttcactcagcataggatgcacaattcatttattggttggttcacttgtccttctctgccagcacagccttgcggctgctcctctcagcgagcaccgacttggtcttctccagcacgccaaagaagatggacccgccgatgccgatccacagaactcgcggctcgatgcccttcaaaaaggcgccgggaccttcctctctcaagatcgtcttagcacagcttacaattccagagtattgctttgtttgcccctgaatcatcaaccttgtcttcagaacatcgaggggtgttgttatagcgccagtaattgcaccggcaaaagcaccaatgagtgcattctctggatccttcagctccctctt

SEQ ID NO: 4269 - DNA, 504 bp, Hordeum vulgare
  UNSURE (3): n stands for any base
ggnacatcaccaactcgtcacccacttccctccccggagtgatttatgagcttcgggtttattctcttgaggaggcaacatttggagaaattctcacgtccagagcaataagagcggctcattgtttaacttccattcagttctctcctacttcagaacacatactgttggcatatggacgtcgtcatagctcgctgctcaggagcattgttatggatgcggagacgactggaattcctgtatatactatcttagaggtttacagagtttcggacatggagctggtaagagttcttcctagtgctgaagatgaagtcaatgttgcatgctttcatccttcccctggaggtggtcttgtttatgggactaaggaagggaagctcaggatcctacaacacaatggcgcagacgctgcaagcatggggctgaattgctttatcgaggaaaatatgcttgaggttcagaggtatgctttggaaggttgaatgttcatttgtgtcatga

SEQ ID NO: 4270 - DNA, 536 bp, Hordeum vulgare
gttaatgtcagtcactggcattggtgacgacagaaatactacaaacatttcccacaaaaaaaaaactcaaggattagtattgcgagctttctaaaatacaacagcggttgttttaagctcattggagattacatgtacagttttataattacagggtcgtgggaacttgacagcaacgatgaccatgccaaatttacatcttcacaccgcctgtgcacagacctgagttaaaagttgcaaaacgatgcacgattagagtaggcccacagcattctctggaaaccagcaatagatcagtacattgcctttgaacaaactcatggagagtcatctgcctcttgaaagatttagtcggaggcccctgctgatatcttgtgatttagtccatgaggctctcctaaacaaaaatggagcttgcagacaaaagttcctgcagggaaggtacacatataagctcatgacacaaatgaacattcaaccttccaaagcatacctctgaacctcaagcatattttcctcgataaagcaattcagcc

SEQ ID NO: 4271 - DNA, 518 bp, Hordeum vulgare
cttggccgcgaaaaccctaggagagctaatcccccccatggcgacggcgacggcgacggcgaggctgcgatccgcgtcggcgttctccctccgcgggatcctcctccgcctctcctccgcgcccccgcgcgccgtctcagattttcaggttcctggatctgcaacatggaggcatttctcaacatgcaagcctaatcctcttgcaaaagaggatagctttggctcaatgggttctctgtacagccagacaagatgggcttctcaatccactgctgtcaaagaaactgaccccagtggcggcaagataagcattgggcccaaatccaagcagatcaaggaggacgacaaggatgatggactggtttatcaaggaccaatatcatcaaccatcaagaaagtgaagcttctgtccctgtccacctgctgcctctccgtgtcgctaggccctgtgattacattcatgacctcgcccgacatgaatgtgatcctcaagggaggagtcgcatccaccgtgatct

SEQ ID NO: 4272 - DNA, 553 bp, Hordeum vulgare
tttaaaacactccggtgttaaaaaaattccaagccgcgattcgcaaatcttcgcatggaataaaataacagcgataccgtatactacatattctcacaagtattagctacagaaaaaaaggaccggatagctcagccaggttcaagagcacaaatgcggtcaaaacagtagcttcatcacaagttcttgaacgcagactcgttagggagcttaggcgtgagcctctccagcaaggccttgttggagaagtgatcagcgtcgacgaagtagaagttcccttcggccctgaaggtgacgaaaggccggttagtctctgcaggcctgatgtcagcaaacttgatcgtcttcttgaggggtgtagccagccacgacattatctctgcctcgaagctgtctgaaccctgtcgccacctcagcttgtggatgtacgggctcacgaaccagtgcagggctgcggtcgtggtggcgctgaggaagatcacggtggatgcgactcctcccttgaggatcacattcatgtcgggcgaggtcatgaatgtaatcacagggccta

SEQ ID NO: 4273 - DNA, 519 bp, Hordeum vulgare
gccggtcatcttctagtgatgcccctcttgttgcattcggggcatctgatggtgtgattagagttctctcaatgatgacatggaagcttgttcgaaggtatactggtggacataaaggagcaatatcttgcttaatgacattcatgtctgcagccggcgaggtacatttagtttctggtggtagtgatggcctgctggtattatggagtgctgatcatatccacgactctcgggaacttgtacctaagattagtttgaaggctcacgatggaggggtggttgcggttgaactttcaagggtaatgggaagtgctccacagctcattacaataggggctgataaaactttagccatatgggataccgttacattcaaggaaataaggcgcattaaaccagtgcctaaacttgcctgccatagtgttgcatcttggtgccaccctcgtgcaccaaaccttgatattctgacttgtgtcaaggactcccatatttgggccatagaacatccgacttattctg

SEQ ID NO: 4274 - DNA, 543 bp, Hordeum vulgare
  UNSURE (5): n stands for any base
tagtngaattttcccttcacaacggttgcgaattaacatacatactgggaatccaaaacagtagcttagatgatagcgtcttcatcgcaacttgtgtggcaccaccatcgtctcagataccatatcatgaccaaagcttcagaacatgaaccatgagccgtactacagctaaactgatgttagaatttttctactaccattgccttgaggacccagaacaatcctactcagaggatatttcggttttcaagaagaagctcctcgccatctcttcagtcacatcgctgtcaggcgcttcttctttgcatatgagcaaaacattcttggatgaaagaagctgaaagaacttcaccacatcatccaccttcttcagtctctcgtaaagcttggtcacaaattggttatattcctccggctcctgttcgattatacaggccttcctcagagcaacaaaacactcaagtgccttttcgtagtaatctccttgaggagaattttctatcaatgcggtcgtgtacttcttcatctcttccattgccttct

SEQ ID NO: 4275 - DNA, 518 bp, Hordeum vulgare
cactgcagtgcacttcagggtttacaaatcacagcaaaagtacatgatcctcatgtgctccgacctaagaaggtcttccctgagaccaggactgtacacaccagcctatggaggcttctttgaatttgaccttgaaaaggaaagaaagatatccctcaggactctgattgataggtccgccgtggagagcttcggcagcggtggcaggatctgcatcacggccagagtttatccggtggcacttgtcgatgacggcgccacccacatgtatgctttcaacaatggaagtaccacggtcagagtgccgcaactaagggcatggagcatgaaaaaagcacaagtgaatgtgatgaagggtggaaatgtgatcgatgcttagcacaaaagagcaattctagtcagtcgtgtgattgaaagactggccacgcacttgttcatttcaatatttaccatgtgtatttgaacttttgaagtagtggcaattggtaagtaagactagtgcttgttgccaccaacga

SEQ ID NO: 4276 - DNA, 551 bp, Hordeum vulgare
tctctcccagttgaatttcctggcatgcacaagctaatattgtttactccaaacctctgcgaatttaaatcgttggtggcaacaagcactagtcttacttaccaattgccactacttcaaaagttcaaatacacatggtaaatattgaaatgaacaagtgcgtggccagtctttcaatcacacgactgactagaattgctcttttgtgctaagcatcgatcacatttccacccttcatcacattcacttgtgcttttttcatgctccatgcccttagttgcggcactctgaccgtggtacttccattgttgaaagcatacatgtgggtggcgccgtcatcgacaagtgccaccggataaactctggccgtgatgcagatcctgccaccgctgccgaagctctccacggcggacctatcaatcagagtcctgagggatatctttctttccttttcaaggtcaaattcaaagaagcctccataggctggtgtgtacagtcctggtctcagggaagaccttcttaggtcggagcacatgaggatcatgtacttt

SEQ ID NO: 4277 - DNA, 484 bp, Hordeum vulgare
  UNSURE (11): n stands for any base
ctgttactggnacaactgtatgccaagtgctcaaacttttgacagctcttcatcaacccggaattctgcagtcacccttgcagaggtcccaggcaactcgggcatgccatatatgcccacgagctctggactttcagcaatttgttcatcgtcaagcccccctgagatgcagtgtcctccagttctggacagcaactcatccacacaacttcccaacatgagtgctgtgccttctgtgccaaaggctatgacgccaggtctaagtgatatcagtattccaggattcccagatctgcatgatctcataacggaggacgcaattaatattcctgtagagaactatgcaatgcctggtcctgagtgtatattccccttacctgaaggcagtgatgactctgttcccatggaccccatcgacactgatgagatcgatgacactcagaagcttccgggcatcattgattccttctgggagcagttcctt

SEQ ID NO: 4278 - DNA, 491 bp, Hordeum vulgare
ggctcagatcagcaggtcaagttgcgtacagaaaaaatacacatatatgcatctttcactcagggtctctccttcaataaaagaaacatcggctccatgcaaagaaacgaggttcctaccaaccctagaagaagccttgggcccagcagcagcgaaaagattaacccaaaaaccagtaatacacacgagtacaacagtgccaaacaccaccatttttctggattacgtgccaagtgtcagcgaccctggatagcgtgagggagctagtcttttacatgttggggttgaggtccgtgttagtcgcaaccacacaagtacagcagaaacacaacacacggtcgttagatttttacgcctgccaaaaaccttagatacaaaaagatcggaattctcccacgccggtttgtcgacaggcatttcacagttcagcatgattgcgtaacgataaactatatgggttttattaccaggattgatcccagggcaccttg

SEQ ID NO: 4279 - DNA, 365 bp, Hordeum vulgare
ttggtcgacgttgagattggacgagggcgagctgaggggaggatgctctggctgtgccaccggcaatgtgggcggctccaccggcgatgcagagctcggggccagaagatcagcgccccctgcggaagcaaagcgtatcaatttggtgaagcagaagcagagcacccaaagagttaatgtacagagtgcattggcaatgtcttagccagtccgccgttcttcttctgtcgccagcaccaaagcacacaacaccacaggaccgggaactctcttgcgtcgccgccacagcaccacagggctagagctcaacaccaccccccaatcccgtcctgcccccgagcgccaccgtttcctacgcacctcgt

SEQ ID NO: 4280 - DNA, 316 bp, Hordeum vulgare
ttttttttttttttttttttttttttttttttatctatacaattcttcatgtctcatttataatttgtattttacaaatacagataccaggatgtaaatggcattgggacccacatatgccatccaccaaaaaaaatcttgagtatttttcatggacatccaaaaaaagttaacacaaaagcccatctaatccacaacttttgcaccacaccgcactaatccacaactcctaagccatgccctagccatccagccaactgcgggggatccctcgggcctggcctcgggtaggtggatccatggggctgaggagggg

SEQ ID NO: 4281 - DNA, 544 bp, Hordeum vulgare
gtcccccggctgcagcattcgggcacgagggccgccgccgccgccgtcgtcaagcgcaagctccgcaaaatcaaggagaaggagacggacgtgcgccacctcaagggcaccaaggagtggcaggccgccgacgctgatgcgactggcttctccgacgtcgaggaggaatcggagctagagctcgaggaggacgacctggtcgaggtcatcggcgccgaggacgaggagaccgtgctcaccaaggttgtgcgcaccaaggtgttcgagatggcgccgctgacggtggacgaggcgctggagcagctcgagaacgtcgaccatgacttctacgccttcaggaacgagcagacaggcgaggtgaacatcctgtacaagaggaaggagggagggttcgggctcatcatccctaagcaggacggccacgtcgacaaggccaccgtcaacgccaaggagcaccccgtcgccggctgaccacgccctccgtcaatcactagctgtagctgcattagttggtctgttttttccctcatgatggtgggtgtct

SEQ ID NO: 4282 - DNA, 514 bp, Hordeum vulgare
  UNSURE (2),(37),(39): n stands for any base
gnaggaagtgttaatatgactgccgtttcgagccagnanaaacaacttaccaactggtatgtgggatcatcatgagttaacacagcccagagagcgtctgttaatttgcacaaagaaggggctgtctgatctgatgaaacaccaacacttgcttcacagacacccaccatcatgagggaaaaaacagaccaactaatgcagctacagctagtgattgacggagggcgtggtcagccggcgacggggtgctccttggcgttgacggtggccttgtcgacgtggccgtcctgcttagggatgatgagcccgaaccctccctccttcctcttgtacaggatgttcacctcgcctgtctgctcgttcctgaaggcgtagaagtcatggtcgacgttctcgagctgctccagcgcctcgtccaccgtcagcggcgccatctcgaacaccttggtgcgcacaaccttggtgagcacggtctcctcgtcctcggcgccgatgacctcgaccaggtcgtcct

SEQ ID NO: 4283 - DNA, 517 bp, Hordeum vulgare
ccggagccgcgccttcctggatatgaagtcaagggaacaccagatgagactccagttattgcaacagcagcatgcccatttgcagagaagggatccaaatcttcccgccctcaacggtgctatgaactctgatgtatcggctgttctggcctccaaactgatggaaggaatgaggaatcacaatcctatggattccgaggcatcacagctctttgatgcaaataggattgctcttctcaagtcagcagctaaccaaactgggcaacttcagggcagctcagtcaatatggcagctctgcagcagcagcttcagtcaagaaatcagcaagttgacatcaaaggtgatggtgctatgcaacaaagaacaatgcctactgacccttctgcgttatatggatcggcgatgatgcaatcaaaatctggattagccgcttctggactaaatcaaggagtcgggagtgtgccactgaaaggctggccgctaacagtcccaggtatcgatcaactccggtcaaat

SEQ ID NO: 4284 - DNA, 437 bp, Hordeum vulgare
cacagttccctgcactaaaattaactaatatttaattacacaaaataatccatccctctctctttcccactcacctacaaacttgcttgcttcattcatcagcttcacaacagggtaaacgtaggcatcatctgcttcctctttacaaccaatctactacttccacagcttcacagatctgtcgtggctcgccgacgcagtcgaccccgtcagcggggagtgcgcaagcgccgctatcagcccctcgtgcgccgggagcacgttcctctggttatccgccacgctccacagctccagcgtctggtaaccaccgacaatcaaaactttcggatatctcgggtggaatatgcacgactggtactggttcccatgcgatctcagctcgtggatgcactgccctgacgccgccgaccacaccttcacgctgtcctggctcg

SEQ ID NO: 4285 - DNA, 403 bp, Hordeum vulgare
ctccccaacgatgccatccaggccttcaattcgccgctcctacctcacctagcttagctgctagccaccaccagtaccacctcccagtggaagcagctcgccgggagacgccgacaatggcaatgcgagcactacccctcgtcctgctgctcgcgtccacggccgtgaccgcgagcgcggcgaggacgccgacgctggtgttcatcctggcgggccagtccaacatgggcggccgtggcggggccaccctcaacaaccgctgggacggcgtggtgccgcgggagtgcgccccgtcgccgcgcacgctccgcctctcgccgtccctccgctgggaggaggcccgggagccgctgcacgagggcatcgacgtcggcaacgtgctgggggtcggccccggcatgcc

SEQ ID NO: 4286 - DNA, 454 bp, Hordeum vulgare
tttttttttttttttttttaaaataaaatgcataaatcatggcagcaataatctagtcagtttcaacctttgggagcctgacagtctatgctgctgctacggactaactaagcagattccttcattagccacttaatctgtcatccaccaccaccaatcatcaccaaattcttcaatgctgtgcatgaatgatgtgcttactagtagtaatcgggcaggcaaacgcactggtagtcagtaatcatggatggttactggattatgatgaatcagttatcagtggagcgtggcgacgtatgcgtcggcgagcatcttgcctagccggacctgcgccggcgtggtgaggtgcgtgaagtcgttggcgacggggagccccatggcgtccacgtacctgaggttgggcgccctcaccgcccgctgcgccttccgcaccagatccacgaacttgccctgc

SEQ ID NO: 4287 - DNA, 379 bp, Hordeum vulgare
  UNSURE (261): n stands for any base
gctcaaccataaacgattaccgccttggccttcgggctggcgtgcaaggagatccacgtcggcgggtaccgggggtggcgcctcagggtgctggaggcgttcgtcatcatcctcgccttcacgcagctcctgtacgtgcttgctctccactctgggctcttcgggaaccagtttggtaataacaatggtgggtatccggcggagcacgcttacggcgccggcgtcggtgaccaccacaacaagggcatgggcaccggcggncgtcgcaagggtctaaataggataagacttggccgtggcaagcgacgggtggataatacgttgtactgtactagtacgtatttgtgttagttgtgtcacgtacggttagagagcagaa

SEQ ID NO: 4288 - DNA, 552 bp, Hordeum vulgare
gacttctttataaaacactagcaagaaccccggtagtacaacatgcatgtacgtgcgtatgtaataccaggtccccctaaaaaaagaagggaaccatgagtagtacatgcgtgccatgctcacacacataccccactgccatgccatggatcgacgatgcatacaacctactcttctgctctctaaccgtacgtgacacaactaacacaaatacgtactagtacagtacaacgtattatccacccgtcgcttgccacggccaagtcttatcctatttagacccttgcgacgccgccggtgcccatgcccttgttgtggtggtcaccgacgccggcgccgtaagcgtgctccgccggatacccaccattgttattaccaaactggttcccgaagagcccagagtggagagcaagcacgtacaggagctgcgtgaaggcgaggatgatgacgaacgcctccagcaccctgaggcgccacccccggtacccgccgacgtggatctccttgcacgccagcccgaaggccaaggcggtaatcgtttatggttgagcc

SEQ ID NO: 4289 - DNA, 519 bp, Hordeum vulgare
gcaccaatggaaagaaggccaccgttaatctctcgactgcctttcctaaggacaccgaatccccgcgtggtggcgtcgaggatatgaccaggcttgcctatctgcatgaaccaggagtgctgcagaacctcaagtccagatatgccctcaatgagatatacacttatactgggaatattttgatagccgtgaatccatttcaaagactcccccacctctataacaaccacatgatgggaatttacaaaggagcagaattcggtgagctgagtccccatccatttgctatcaccgatcgtgcgtatagacttatgatcaatgatcatattagccaagcaatattagtgagtggagagagtggagctggaaagacagaaagcactaaaagtcttatgcagtatcttgcttttatgggtggtaaagctaaagctgaaggaaggtcagtgcaagaacaaatcctagagtccaaccctgttcttgaggcattcggcaatgcaaaaacagttaggaataataatt

SEQ ID NO: 4290 - DNA, 526 bp, Hordeum vulgare
ctattactgtataactatacatttgctacaaataatggatatttttggatactactacatacatatatcatatatatctacattgactagaaataaagaatcaagaatggatgtgaatgacctccttcctgcctgccgtgtgctctcttcccaacccagcccgcagccattaaaagataaaagagaactatgacatcttacaccaaccagcctatgactaagaaaatggaataatctacaaggcccggccgggggagcggaaagaaagacaaaaacctatatcaactgacaaatttacaacattctatcctccggaggctaccgcttctctgccctgccctcacgcggaacccattcagctcttcaagaactggaatgcagcgttgtccaggagctcttgtggcggagacacgttctggaactccttggtgtccatggaattgcctatctcctcgagcgacaacggcatgcgtgtctcttcatctagtaaataggcacacgaaccagctccctcgttcaccaacgt

SEQ ID NO: 4291 - DNA, 509 bp, Hordeum vulgare
gggtgcaagtgtccaccttgtgtgtcgtggcacagcaccacggtgtgatgacgctgaacgggttccagaaaggcgaggaaggcggcgggccgtcggcgtgcgacggcaagtaccacagcaacaaggaaatgatcgtggcgctgtccagccgctggtacggaggcggccgccggtgcgggaagatgatccgcatcaccagcgagcagaacgggcgcaccgcacaggccaaggtggtggacgagtgcgactccagcaacggatgcaaggacagcatcgtggacgcctctgctgccgtgtggaaggctctcaggctcaacaccgacatcggggaggtccccgtcacctggaccgacgcctgaagccatgcatcgatccactggtaagcaggcgccgacgatcgcaaggacgggagtgcttatcgattggtgcagtcatgtcaagtagtatagcagaataattaatctacccatatggatgacagtgcaggtgtacggtgtacgtatcttgta

SEQ ID NO: 4292 - DNA, 536 bp, Hordeum vulgare
  UNSURE (15),(31): n stands for any base
ttatttgcacacttncgattatatagataangctgagaccaaacatgactcttacaagatacgtacaccgtacacctgcactgtcatccatatgggtagattaattattctgctatactacttgacatgactgcaccaatcgataagcactcccgtccttgcgatcgtcggcgcctgcttaccagtggatcgatgcatggcttcaggcgtcggtccaggtgacggggacctccccgatgtcggtgttgagcctgagagccttccacacggcagcagaggcgtccacgatgctgtccttgcatccgttgctggagtcgcactcgtccaccaccttggcctgtgcggtgcgcccgttctgctcgctggtgatgcggatcatcttcccgcaccggcggccgcctccgtaccagcggctggacagcgccacgatcatttccttgttgctgtggtacttgccgtcgcacgccgacggcccgccgccttcctcgcctttctggaacccgttcagcgtcatcacaccgtggtgctgtgccacg

SEQ ID NO: 4293 - DNA, 283 bp, Hordeum vulgare
  UNSURE (1): n stands for any base
nttattcatgcagttccccgtttgggcaactcttagggtcgggccaattttccaccgtttctctcttttgggttttttcttgctcttcttttctttattttcttcttctttctgtttctcttttcttttttttcttcccattctttttttgtgagtcccctctttcttttgccatggtttccccctgcccctgttccctatcgcggcacctttccattttcccctcctccttcccctctctcttattttttctgttgaggagcttattttttttcgacactat

SEQ ID NO: 4294 - DNA, 534 bp, Hordeum vulgare
  UNSURE (21): n stands for any base
acctcttttagataatatgtntcaatcacaagtatatacgagagttaatgtgtagattgtaatacaatgtaaagggcagggcagattatacaaacaactccattgtaatacaatgtgtagattatgtactagaaatcaacagaccaaaaaatttaatcaatacaaatcgaattgttggcctcatcaacaaaagtaaatacccaaagcacaacgaccttattccggcaagcttctcctccgtgggtggtccgcagtggctggcttcggattcaaagttgaagcattggttttcggttgagcaagctttttcaatcgctcaatcaacgattcaggtgtgctgccacttttctcctttttcatctcagccaaggatgaggttgacttgctcactgcgcttgatttagctgttttctgaggatgtgatgcgccgcttcttgcagcaattctcttttgcctctcttgcttaagcctttcgagccgtttcatctgctccgcttccagctctttcttttccttttgaaggcccgctttgta

SEQ ID NO: 4295 - DNA, 518 bp, Hordeum vulgare
gggaggatacaggagaggttcgaatgatgacttcatggtttatggacatgacaactcaatggacagggggagctctttggaccccctcgccgaggcacattacaaaagacccactctggaggaaaagaagaatgtgcacactatgagcgacgagtctttcatgatacgtgttagctccaactcacacaataatcttggagcagacggccgtactgcgattgacatagatgccgagcttggctcaagtgttcagaaaacatcagatgccaaggctggaggtcaacttttctatgagccagatgagttgattccagagcgtggatttgaagatgtgtcatttggatatgacccatcaatggactatgatagccacatgcagattcaacatgacgtcagtattgaagatgcaaatgcagaggatttatctgtttgcgtcgagagtgaagaaaagacgcctgggaaagataagaagcttagaggttcacaggagggtttggataaaagaaggaaggatgcca

SEQ ID NO: 4296 - DNA, 496 bp, Hordeum vulgare
tgtaatacaatgtaaagggcagggcagattatacaaacaactccattgtaatacaatgtgtcagattattgtactagcaaatcaacagaccaaaaaatttaatcaatacaaatcgaattgttggcctcatcaacaaaagtaaatacccaaagcacaacgaccttattccggcaagcttctcctccgtgggtggtccgcagtggctggcttcggattcaaagttgaagcattggttttcggttgagcaagctttttcaatcgctcaatcaacgattcaggtgtgctgccactttttcctttttcatctcagccaaggatgaggttgacttgctcactgcgcttgatttagctgttttctgaggatgtgatgcgccgcttcttgcagcaattctcttttgcctctcttgcttaagcctttcgagccgtttcatctgctccgcttccagctctttcttttccttttgaaggcccgctttgtacgcccgtaggttttgcg

SEQ ID NO: 4297 - DNA, 437 bp, Hordeum vulgare
tcaagcttccaggataagcaacagcgatgacaatgtggtggttgagaagaccgttgttatgcttgaaaacgaagtggtctctacgcctcctgttgttctacctcctggaagaactgcagagagcgaagctcgccgcagtgaccgaatggagaatcccagtctggaacatttgttttctgccatcagggctccaccttctccggtggatcttgctgaagatgcaaatcctatcatccatacatctgacaaccagttaaattcatacgaggtggatgtgcccgagtaccagaaggatgagcttgagaagccaaccttacctcccatggagaaaccttatgaggcccctttcgccagggtaacatcattggaggatgcttcaagcaaggctcccgcttacaaccaccacccattacccgcgcaggaacccgaaacatttg

SEQ ID NO: 4298 - DNA, 551 bp, Hordeum vulgare
atcaatgtaaaggattacacatacctgattacaaacaacacaacacaagcgtagagtgcaagtatatatatatatataatatgcacgtatgtatgtatgtatgtatgtactagaaatcatcaaactaaattatctcaatcgacacccaatcaagccagcctcatcaacaacaaaaatagtaccaagaaaatcctcacatcacatcacagcacgatgaccttgttcttgcggaacggcgccagcagggagaaggaccgagaagctttgtaagaagagcccgcggagtcgtcttgtgaaatgaggtttttcagcatcgaaccatctcctgcaggggcttcgtcgaccgatgacgcatcggaatccattgttgaagtatggctcttcttcccaaatttcagcagtttcctgaagcctttcggttctttgcttcgaggcttgtcgttttcttcatgtgtctcctcggctgagactgcatacgcagtaggctccggtacgcgtgccctcacgctctctgcacgggcaaatgtttcgggttcctgcgcgggtaatgg

SEQ ID NO: 4299 - DNA, 517 bp, Hordeum vulgare
cagggttatgcaactcaagggtcacaagagtgctgttactagtttgtgtttcactccggattctgagaagattattactgcatcaaaagatggtaccgttcgagtatggaatatcaatgtaaggtatcaccttgatgaggatcccaaaaccttgagagttttgccagtccctctgcatgattcgaaaggctctacttgcctgtatgaacacatgggcatctccccagatggtaaaattctggctgtgacaagtggatcgacgttgcaatggctatgtgcagaaactggtgtggttttggatacagccgagaaggctcatgaaggtgctatttctggcattgcttgggctccacggactattccaaatggtggtgctcctgcttttgtgttagcaagttgtggggacgacaaaaaggtgaaactgtggttagctcctgaggtcagttcgacataagcatctcgatggtgtcctgctcatcctctacaagatagggaacaaaaagaaacaagggcagag

SEQ ID NO: 4300 - DNA, 556 bp, Hordeum vulgare
gagaaactatggggtttgagcattagcacatagtcgcacggattcaaaaccatccccagaaaaacttttaagttacttccagaaaacaacagattcacagagaaactatagtacaatgctatctctttttctgtaactctcgctatgtttgacaactctcgccagtaagagctcacggctactctcaagggaaccaaaccgcgataacctctgcccttgtttctttttgttccctatcttgtagaggatgagcaggacaccatcgagatgcttatgtcgaactgacctcaggagctaaccacagtttcacctttttgtcgtccccacaacttgctaacacaaaagcaggagcaccaccatttggaatagtccgtggagcccaagcaatgccagaaatagcaccttcatgagccttctcggctgtatccaaaaccacaccagtttctgcacatagccattgcaacgtcgatccacttgtcacagccagaattttaccatctggggagatgcccatgtgttcatacaggcaagtagagcctttcgaatcatgcagagg

SEQ ID NO: 4301 - DNA, 501 bp, Hordeum vulgare
taaacgattaccgccttggccttcgggctggcgtgcaaggagatccacgtcggcgggtaccgggggtggcgcctcagggtgctggaggcgttcgtcatcatcctcgccttcacgcagctcctgtacgtgcttgctctccactctgggctcttcgggaaccagtttggtaataacaatggtgggtatccggcggagcacgcttacggcgccggcgtcggtgaccaccacaacaagggcatgggcaccggcggcgtcgcaagggtctaaataggataagacttggccgtggcaagcgacgggtggataatacgttgtactgtactagtacgtatttgtgttagttgtgtcacgtacggttagagagcagaagagtaggttgtatgcatcgtcgatccatggcatggcagtggggtatgtgtgtgagcatggcacgcatgtactactcatggttcccttctttttttagggggacctggtattacataccgcacgtacatgcat

SEQ ID NO: 4302 - DNA, 550 bp, Hordeum vulgare
  UNSURE (20): n stands for any base
tttataaaacactagcaagnaaccccggtagtacaacatgcatgtacgtgcgtatgtaataccaggtccccctaaaaaaagaagggaaccatgagtagtacatgcgtgccatgctcacacacataccccactgccatgccatggatcgacgatgcatacaacctactcttctgctctctaaccgtacgtgacacaactaacacaaatacgtactagtacagtacaacgtattatccacccgtcgcttgccacggccaagtcttatcctatttagacccttgcgacgccgccggtgcccatgcccttgttgtggtggtcaccgacgccggcgccgtaagcgtgctccgccggatacccaccattgttattaccaaactggttcccgaagagcccagagtggagagcaagcacgtacaggagcctgcgtgaaggcgaggatgatgacgaacgcctccagcaccctgaggcgccacccccggtacccgcccgacgtggatctccttgcacgccagcccgaaggccaaggcggtaatcgttttatggttgaggc

SEQ ID NO: 4303 - DNA, 522 bp, Hordeum vulgare
caaacttggagaaggtggctttggcaccgtctacaagggccagctttcagaagggttggagatagcggttaaaagacttgcttcacattctggacagggcttcatagagtttcaaaatgaactccagctcgtagccaaactccagcacttgaatctggttaggctcttgggatgttgttctcaagaggaggagaaaatactggtctatgaatacttgcccaacaaaagcctggattacttcatctttgatgaggataaaaggtctttactggattggtcaaaacttgtagcaataattgagggaatagcacatggacttctttacctgcataagcactcccggttgcttgttatacatcgagatcttaaaccgagcaatattctcctggacagcgaaatgaatccaaaaatttcagatttcgggctagcaaaaatattcaactcaaatgacaccgaaggaaacattacaagaagagtgattggcacatatggctacatggcccctgagtatgcttcgaaggg

SEQ ID NO: 4304 - DNA, 466 bp, Hordeum vulgare
taattttcttgcaaaatttaaaaaggaaaggcgaatcaaaggtatggaaaaaatagctaagtatgtattctaactagtttggaaaccttctttacactctttagggtacacaatctcacatttgaaatgacacttaaacatatgcatcatatgacatctaagttttgtgaataccacaacattacaatgaaaaacataacaccaggggaaacttatcttggagttgtgacagacatggtcatatcattagtactatctgactggggagcagtggactcatcttcatttcccactcttacattgatatatgctggctgcttaggatcatccaagatcatagtctcactgcttagcattgaaacaacatcttccattgttggtcgatcagctggattctcttgtacacacaacaatgctatgttaatccacctcatcatctttgccgagtgactatggggaacaaatg

SEQ ID NO: 4305 - DNA, 548 bp, Hordeum vulgare
  UNSURE (12): n stands for any base
gtcttaccgggnctgcaggcaattcggcacgagggccgacaccaagttcaagatcaagattggcaagacgctgagcgtacggaaatggcacgccgcattcacgcaccacggatccctcaacatctcctctgttctaaccaggatacagagcgggggtgtgcacccagcaatcaggggagaggtctgggagttcctgcttgcctgcttccatcccgacagcaccttcgatgaccgcgaccacatcaggcaagcaagaaggatacagtatgctacatggaagcaacaatgcaaacacatggatcctcacgttggcagcggcaaaatcatcactgcccccatcataaccgaccatggcctgcctatcaacgaccctttggtcttactcgaagccactaccacacaccaccaccagcccagcaccagcagcaatggaagagagctggataaagacaccatccagtggaagcttacgctacaccaaatcggtcttgatgttctacgcactgaccgctccatgctattctacgacaagaaagagaatctctcca

SEQ ID NO: 4306 - DNA, 535 bp, Hordeum vulgare
tgatggagaagcgtgtgtaccaagccagtctacgcatgcagcctctcaaagcaccaaaacgcgtctgcttcgtcactgagaagcactatcatcggtgagcataaatcactcattccttggcagtaaccaacttctttgtcgatccacgcgtatacagctagaatatcccataacttggagagattctctttcttgtcgtagaatagcatggagcggtcagtgcgtagaacatcaagaccgatttggtgtagcgtaagcttccactggatggtgtctttatccagctctcttccattgctgctggtgctgggctggtggtggtgtgtggtagtggcttcgagtaagaccaaagggtcgttgataggcaggccatggtcggttatgatgggggcagtgatgattttgccgctgccaacgtgaggatccatgtgtttgcattgttgcttccatgtagcatactgtatccttcttgcttgcctgatgtggtcgcggtcatcgaaggtgctgtcgggatggaagcaggcaagcaggaact

SEQ ID NO: 4307 - DNA, 41 bp, Hordeum vulgare
ttttttttttttttttttttttttttttgattttttttttt

SEQ ID NO: 4308 - DNA, 368 bp, Hordeum vulgare
  UNSURE (334): n stands for any base
gggtcgttcctcgcggggacggcctggtcctgaattactatctggatccccgtacatgcggcgttccccgcatcgagtcgtcaagggtcgatgggcgcagcaggtggcatggcttggcgtcaaggatctggcattctggcacggcgcgagggataggaggactgaaccagactctcctgagcagactgttcggtggtccgttgcggcttgtggtggtagcggacgaatcggaaggagaggaggatgaggatgatcttccttagaaggaaggaaggaaggaataagctcaagggaggggagggtcttatttgatttgatttgattttctgcacanaagaaacatgtgatagttactggctacatactcc

SEQ ID NO: 4309 - DNA, 523 bp, Hordeum vulgare
  UNSURE (8): n stands for any base
gcctcgtngcgcttccatgctcttctacgacaagaaagagaatctctccagttatgggatattctagctgtatacgcgtggatcgacaaagaagttggttactgccaaggaatgagtgatttatgctcaccgatgatagtgcttctcagtgacgaagcagacgcgttttggtgctttgagaggctcatgcgtagactgatgcacacagcaatctgttggggttgagaaccagcttcagcaccttgcctctatcattcaggtgttggaccgaaagctacatgaccacctagaaacacttggcgggggcgactatctctttgcattccgtatgttcatggtattgtttcggcgtgagttgtcattcggggactccttgtacctttgggagatgatgtgggccctagaatatgatcctgacatgttctcgacgtatgaagagagcgggcctgcaaccgacacaagtactcaaggatataaaccaagagtagtaaaatcaacccgtcagtttggcaagtacgagagg

SEQ ID NO: 4310 - DNA, 416 bp, Hordeum vulgare
  UNSURE (30): n stands for any base
ttttcctttttactttttcctttgatacantgacataattaattacacgcaaatatttttcttcttcttttgatcaaaaacaaagaatcttccttacacttggaaaaccaagacaaatacacttgacttgcttatacacttttttttttggttggttggttggttggctgggtggcgcatatctgaaacttcaaggtttccaagcaacaaagatgccaccgaaaatgctctgcatgcaaatttacatacaattttaagaccgagaccatgtccgtgtccgtgtccaggtgctacaattgtgacaacacaagtgtccttgtctgtgttatgttaggatttctttccctgcatctttctaaggtacttggcgtgaagtttcagtgcaccagcgcaagccttctttgcgtccaagttcc

SEQ ID NO: 4311 - DNA, 257 bp, Hordeum vulgare
ttttttttttttttttttttttttttttttattccatgttgaaatgtataaaagatgcaaactaacaacagcaaggtggtttggtttttgtacagaagatttacagcacaaacatgttcttgttccatgttctttcacaacaatccggtaaatgtgttcagagcttggatggtggtttcaagtgagcatgagcagcagacgacaggcgcgccttcaatttgaagatgagctgatggacttcatcgaaatgagggttg

SEQ ID NO: 4312 - DNA, 397 bp, Hordeum vulgare
gcctgcgcagccgtcttcctcctctcgctccctctcctcttcttctcctgttgtggttgtggttgtaggtaggtcgggaacgggaatcgatggcgctgctcaaggtttacgcggaccgtctttcgcagccgtcgcgcgcggtgatcatcttgtgcaaggccaaccgaatcgatttcgaggaggtcaaagtggatctggcaaagggacaacaccgacgccaagaattcaacaagatcaacccgatgggacaggtcccagcaatcattgatggaagattcaaactattcgaaagccatgccatcctgaggtatctcgccaccgtcttccccggagtcccggaccactggtatccagccgacttatttaccagagctaagctcgagtccgtcttggattg

SEQ ID NO: 4313 - DNA, 1204 bp, Hordeum vulgare
  UNSURE (1089): n stands for any base
aaaacagaaggtcagaagcaggaatatacataataggttcgcgttagtgaagatggttttcccttggagactgtggcgacagatctttccatgcagtggaattatatgaatttctatccattgtccaaatttcgatgcaagttgcgatgggaacagcccgcgagcggatgttggtatagcttgacgcgtgcgtcgcgcgattcgcgcgtcatcatgcttgccgagtaggtgctttttagccttcaagctcacatagcgttgcactttacttcgttcgcattgagcagatataccgattttttgatgttcgatggagactgacacttagacgttctagttattttattcaaggagcaatcctcgtatggggacgagggcgccagcatatgcatcggtcggcatgcattcagaactatttagcaaagaccatgtccattcctgtaggctattttcgtacactcgtcctttttcatggaagattccgtataccactgtgtttgtctagccggactttattgtacttcctagtctaagcttcgtacgtccgtattatggcatttggcattcatctcttaatcttgctgcctgcgggtgtcagtaactcttatgtacgtgtcacacttgggattggcgtttcttgcttctccgggactcgacacctcaatttctcgagtagctgcataaagagtggcgtagtagtatgtctgttcaaaattacttgggaactgctcgcaaacgtgtgtggctttacacggtcgaatgcaaaaattctatgtaattggccaacactccacaccattagtaacggaggactttcaggactttgatgcggcgagtattatgccaagttgatgacgtttgtcgcgcgattgagtagaccgtgacatcagttctcaggtacccttatgatcaaggtcccgcgtctcggtatggagtaatgtgcagataaggccaccaaccctccattttgatggaagtgccattggctttatttcttaaattgtacggcgctgcctatacgttctgttgtttcatgctctacttggaaaccacttatctagcgttttgtgacaatttagctgggcttgnatgcgaaagcaactgtgcccgagaccaagttttgtggttgtaaaaacttttgtataagatgcacaacctctgtgtggttggtaggctgacatttcaatacattgtcacagggcat

SEQ ID NO: 4314 - DNA, 553 bp, Hordeum vulgare
ttgaacacttagtattgcttacttccatgttgaaatgtataaaaatgcaaactaacaacagcaaggtggtttggtttttgtacagaagatttacagcacaaacatgttcttgttccatgttctttcacaacaatccggtaaatgtgttcagagcttggatggtggtttcaagtgagcatgagcagcagacgacaggcgcgccttcaatttgaagatgagctgatggacttcatcgaaatgagggttggtggccttcttcacattctccatccaagcacggaccttctcatgaggtcctagaattgtgtcacgtctctcatcaccgacaacctccagctgcattatctcgcacacgaggctgaggtctgcgatcgatggctgggggttgccattcaagaattttgcatcgcctttgagccacaccgtttcgatcgttcccagtgattttgacagcaacttctcgccctcttttgcggtctcaggattgggtgtgagaccgagagcaggacccaacgcggtgtgcagtacataggttgctgcaccacggcgcaga

SEQ ID NO: 4315 - DNA, 518 bp, Hordeum vulgare
agataacgagcagaatcctcaactttctactcaagatggagctcctgcatccacttttccggattatgtaccatatgacagcactgaccagatgcttccatcgggctcaaatgacttacccactgaagatgctaaccaaggaagggtgaaacaagcctcagcatcagatcaggatcaaggacaaaattacttggataaccaaaatgacctattcaaatctgcagcgcacggcaaatctttctctcctggaattcctgctccctctctgctctctgcagctttacaggtgcctgctggccagattgtggttccagcagcagttgacccaacccagggaaatgcattggccgcgctgcaagttttaaaggtgattgaacctggtgctctacctggtgacttatgtacccgacgcgaatacgctcgatggttggtagttgcaagcaattctctttcaaggaacacttactcgaaagtttatccagccatgtacatcgagaatgtgtctgaacttgcatttg

SEQ ID NO: 4316 - DNA, 542 bp, Hordeum vulgare
tgcccaaaatttattcctcggtttcttgtctctttggctggctataaattgtctggtctcagatacacaaggcatgaaaagctccctaccagcagctagtctgtcttgaatctgtgcacaaacttctccaggccgtctttgcagtcctccactaccttcttcgacttgtccccgacgcttgaacccaacgccttcgcttctgatgacagcttctttgcctttgaggctgcagcagccccaagatctgcgcacccttgcgccgctccctccttcaggcttgagatcaaggacctcacatactgcattactctctccagggcatggctggatcggactttcatctcaccagcaaacgacttgagcttctccagcagggactccgcccggttgattgcctcgtcaactgggtgttctttgccagcattagcccatgtcactccggccgatgcatcctcctcaagccctgcgtcaacgacaactttgatcccttgtcgctcccactggttccgggcctcctcaagggcacgagcatgctccctggc

SEQ ID NO: 4317 - DNA, 542 bp, Hordeum vulgare
ggtctgcaggcaattcggcacgaggatcctgagcaccgcctcaagtttttctctttacttcgtgctatcggcactcattgcttcaaagctttaattcagctttccagccagcaattgaagcttgtgattgattcgattaactgggcatttagacatacagagagaaacattgccgagaccggccttagtctattgttggaaattctgaagaattttcaggcttcagaattcacgaatcagttctacaagacatattttttgaatatagagcaggagatttttgcagttctcacagattcatttcataaacctggattcaaacttcatgttttggtgcttcaacacttgttttgcgtggttgacagcctaactgaacctctatgggatgcatccacggtatcatatccatctaatgccttgtttgtacgggactacacaatcaaacttcttggggcatcatttcctaacatgacggtagctgaggtgaccaagtttgttgatgggctccttggttcgagacatgacctcccaagcttcaaaaa

SEQ ID NO: 4318 - DNA, 533 bp, Hordeum vulgare
taacaagtagtacaagcactaggaggatggattataaggtttcctaccagcccagaccgaattcagtcaattgatacatcataatacagtcatcaaatctatagactaaactaacaattaaggatcaacatccatactatatcatgctcagcacacgcacaaaatgtttcaccgagcacttaaaacacatccatctaaccatccacacagcccacaaaatgctccaggcctgccgagcaaatcttgcggcaaaattgagtccacgcctccctatcatcaactagcacaaatcttggaatcgccgaaccggaaataaaattacagcaggcaccctcctttcaccacaaccaccctggaagaaaactctggctccgggacatggaggcctctggaggcctaatcaaacatcaaactggattagcaatgcagaatcacagagcactatgagtctaccatctcgtcttgcaattcgctaggggcaatcagccctgggatggcaagcatccgttgcctttccttttctctttgtaccg

SEQ ID NO: 4319 - DNA, 426 bp, Hordeum vulgare
cttatactccgtgtcagatgcttctatgccatacaagagcatccaagtctgtctatcttaggggcaacaagtcgtggttctcatgttcctgattttactgtccccattgatactcatggcggattgcccatttatcagtctatggtaccagctgttcctacttataacaccccaaaatgttcaggagagctattgctgcgtgttgtatgctcttttgacaagattgggttggttatcggtaaagctgggaggagggtaaagaatataccgcccgaaagtggtgcaagggtagatgttgatgacgcaaagaatgacaaggaggaaagaataatcacagtttcatcaactgaggccaccgatgatgttaagtctgcagcagtggaagctgttcttctgcttcaagcaaagatcaacgatgaaactgaa

SEQ ID NO: 4320 - DNA, 533 bp, Hordeum vulgare
  UNSURE (5): n stands for any base
cacgnaacaagtacacacaagtaaagcctggttgagagtctgaggaagatagagagataagcatgaggtttattggagagttgaagagacggagaacaacatttttgatctaaggaaactacgggatggcaagagaagtccgatagagctgactgaagcgtccacatatatcctttcaaacaacagcaggaacctccttaagtagacattatgaaagctttgatcaaattctctgccgactgcctctgctcaggggtgccaaatatgtgagcaacatggtcatgacgagatgattttgattcaagaatttcaatgtcagctccagaaatctttctaatgttgtccaagtttgtaccatgcttccccattacttttgaaaggccactagaaggaataaacatttccatatccggtacgcgccttccatatggctttgaagtgtatgaggagcgtactccaaacccatcatctacagcctccctggggctgtatccatgatacaagctgctacgaggaaatacattcgaaccacg

SEQ ID NO: 4321 - DNA, 519 bp, Hordeum vulgare
gtgtcatacctccgccacgagaaagcgttgatcgtgaagctggttgacatagttgacttcaacgggagtttcctggcgcgcatacgcgatttcgccggcgctaatcccatcgtgcttgtgataacaaaggttgatctccttcctagagacacagatttgaactgcattggcgattgggtcgtggagtctgttgttaggaagaaactcaatgtccttagcgtccatttgacaagttcgaagtcgttggtcggcatcactggtgttatatcagagattcagcaggaaaagaaggcccgagatgtgtatatactgggttcagcaaatgttgggaaatctgcatttattagtgcaatgctaaaaacaatggcatataaagatccagtggcagctgcagctcaaaaatacaagccaatacaatctgctgttcctggaacaaccttaggccctattcagatcgaagcatttttaggaggagggaaattatacgacacacctggagtccatcttcaccatagacag

SEQ ID NO: 4322 - DNA, 549 bp, Hordeum vulgare
gggaaaagtttcatatatatgcacaaggtgtaaccacaacatttactagaggtttcctgaatcgttttatcagctgatcctaagctagaactatgaattcatctccctatcagatcatccaagaaacataatgtcggggcgtaactgtaactggatcacgcagagctgctccagcgcgacagcagcatacacaaagaccaaaaataggcatttggcaaccgcaacattagtaatgccacttaggtctcagctcctcttctacctccgtcagctcctggtaccggtaccactgtgatgctgctttaccgacgggcagtggggcacggacaaagacctcgactggtttgggtacatgtactcttaaatgcaactcgccactgccgccgccttcttcctcaatgctgctatcagggtcgctagatggcacaccaagtggttcaaccgcgatccatccgagtccagatatcgcaatgtcactagcaggcctatcaagctcttcatattttatctgcaattcgcgaacgccctgaagcccacaccatccttcag

SEQ ID NO: 4323 - DNA, 486 bp, Hordeum vulgare
tgcctggtggtatggcaaatgcgacattctcggtaccaccagatggggccaataatggaagaactcagccaggccaggcaccacctgggttctcaattctcaaccatcaaattcatgtgacacagcttccaccttccggcgctattcctcgcaacttggttattcctgattccatgacgacccttttggagtatattgatcgcatggaccaagtattgcagaacaatggtattccaccatccatggactcaaacgctcaggaaccaccaacatcaacatcagatgatgcttacttgaaccaaagatttccaagtcccgaggtgctggcttcagttgttgaaagagcccaacaacttctcggcggcagtgcttcttccgctctttctcatcttgcacaacgtattcagagtgatgctgccactggtgatgcatctgtgcgaagccagatacagaatgagtcggcacagttgggggtagcgatacagc

SEQ ID NO: 4324 - DNA, 557 bp, Hordeum vulgare
  UNSURE (76): n stands for any base
gttccccaaagctagctagctatgtgcatgtcactagcaaaatttggtagtaacaacagacaactacatccaaaangtcagggagaaacaattacatccaaaagtcacgagttaggtatatattttcaccacattttcaaccacgccgcctgaaatgtaccaccacccgcttgaccgaccccgcccaggccgtccttcacgactccttcttggccttggattcggactccaccctctcgccgacttgcgccagcagaagcttcatgtactcatcagcaagctctgggtcattggcaagctcttcaagcatgacctcgatgctctcgtcgttgccataagcctgagcagcagtctcaaggacggcaccaaagatatcctcaggggcatcatgttgctcgatgcgttggcatgcttcttgaagatccatctgagagcttctaccgcccacagcgtcgcttacgtccctgtcattctgtcgaggctgaacatctgtaccggcaggacgagctgcaggtccaccaagaacttgcgacacaacaggcatcatctgctgcatc

SEQ ID NO: 4325 - DNA, 516 bp, Hordeum vulgare
gcaagctccggagtggtgctgcatggtctgcggctgaagaagcaccagaggaagcgaagctcgatgaggcatcccctgagccggcgccgccgtctcacagtgagattttctgacaaggaaattggagtgaaggagggcaccgtgacctctcagacggaactgcaaaatccaccattgaccggaggccctgaggtttccgaggaacctgtccagcccaagccagcaatggaaatttctcttgatctgcttgagaacatggatgacagcgatgtctcgacgcccatgggaccaagtgggaagcaaaagaggtcttttttcaaaagtcccgttgaccgcacgagtgaaaggccggccctgtcagaggttaggcagaatatagataccttccgctgcaaagcaaacctcttgattattcaggctgataggtgctggagggaagagggagctgaagttatgctggaactatcaaactccaacgggtggtgcgtggctgtgaagctacacggtgtcactaga

SEQ ID NO: 4326 - DNA, 455 bp, Hordeum vulgare
atgatccattcatccactcgttcattcattcaactgtttccacctcctctatgatctaacaatacctcatcttttttctctgtcaaaacatgggaactacatataacatacagagtcgtcaggcacggatccatccatccatccaccaacatctagctaccaaactatatcatttacacaaacgaattacagtttttttcgtctacgagtccgacccgggacccatcaatttccgcttctgcttcttctgcttcttcttcgcatagttacaaccggaggagaggaggatggggcgaaaaaaaacacagcctcgcagactagccaatgatatcacacatgcggcgggaacaaaagaaagaagcaaggcctagtcgaggctcctccagacgacgtcccggcacctgtcagacacgctcgcggcatcggcgatcctcacggccatcaccgacttgtac

SEQ ID NO: 4327 - DNA, 494 bp, Hordeum vulgare
  UNSURE (470),(471),(473),(474): n stands for any base
gcgtcccctgcgagaaaggaaggagtgccattgcatgcttttccttacgcccgacaacgattttgccggagaggaccaggccatcagcttggaggagatcaaggaggcgacgtccaagtactaaccagacaacgcctgtttttgctcgagagggggctatagtcggtcggtcggtcggtcgtcgttgtcggacctgtatatgtagtatctctgtaacagcagcaggaaaataaaaatgtgtgtctggaatgatgtctggtgtcatccgcctcgagggaaattaaggcctgatggttgcattccccggcttgtcaatgttaccaaatttattgcgtgtttttgggctcgcgtaaaccctactccattgtgataggaaggaagcaaggaaggaaggatgtcgtgtgaaacgtcgtcgtcctgatgcttcatttttcttcctgagtgaatgaatggtgtgtggaagggaagcnnannaaaaaaaaaaaaaaaaaaaa

SEQ ID NO: 4328 - DNA, 467 bp, Hordeum vulgare
  UNSURE (98): n stands for any base
ttccctttccacacaccattcattactcaggaagaaaaatgaagcatcaggacgacgacgtttcacacgacatccttccttccttgcttccttcctanacaatggagtagggtttacgcgagcccaaaaacacgcaataaatttggtaacattgacaagccggggaatgcaaccatcaggccttaatttccctcgaggcggatgacaccagacatcattccagacacacatttttattttcctgctgctgttacagagatactacatatacaggtccgacaacgacgaccgaccgaccgaccgactatagccccctctcgagcaaaaacaggcgttgtctggttagtacttggacgtcgcctccttgatctcctccaagctgatggcctggtcctctccggcaaaatcgttgtcgggcgtaaggaaaagcatgcaatggcactccttcctttctcgcatggggacgc

SEQ ID NO: 4329 - DNA, 277 bp, Hordeum vulgare
cccgcctgctccagatatggcgaagccgatatcgattgaggtgtggaacccaagcggcaagtaccgcgtggtgagcaccaagtccatgcctggcacccgctggatcaagctcctcactgacaacgactgccgccttgagatatgcacggagaagaagaccatcctctccgtcgacgacatcctggctctcatcggcgatcactgccacggtgtcatcggccagctaacagaggactggggggaagtgctcttctctgccctcaagcgcgctggtggg

SEQ ID NO: 4330 - DNA, 549 bp, Hordeum vulgare
gggttaacatataaatgcataattgataaaaaatctcttgcttgatactatatatactcatttcattcattactactaccccatgaagatgagtgcattcatacatatatactggcaaggagctatatacgcatagcatcttagcaagtatatactccgtactccgtagtagcagtagtgattcatcccttcatctccgcctccgcctccgtagtagcagtagtgattcatccgttcatttccgcctaaagcttggaggatggcaggccgagttgcttggcgttaacgatgcttgggcaggcaggaggcggcgtcgcttcctcatcgaggaagggctccaccgcgttcgggttcccccacaccgggtaccccttgatcttaccaagcacgttcagagcagcgagtgttgccatcccttcacgcgtccacttggacgcagatgcaatgtgaggcacgacgacggcattcttcatctcagccagccctggcttcatgtaaggctcatcctcaaaaacatcgaggccgacacggaacatggggttagccttg

SEQ ID NO: 4331 - DNA, 423 bp, Hordeum vulgare
ctgaggacctcaagaactgggacgcagagttcgtcaaggtcgaccaggcaaccctcttcgacctcatcctggctgccaactacctcaacatcaaggggctgctggacctgacctgtcagactgttgccgacatgatcaagggcaaaaccccagaggagatccgcaagacattcaacatcaagaatgactttacacctgaggaggaggaggagatccgcagggagaaccagtgggcctttgagtagaggagcatctaggtggtgccgctgccgctgtgctgaatgaccaactcttagtatttgtcatgtctgcatttcagcgctcttctttatgtcgtcgtaatgggttgtaattatcctcgagtcttatgaggtggtgtcggtgaacatcttcggtcagtgtttatgtttgtgagaacaaaaa

SEQ ID NO: 4332 - DNA, 490 bp, Hordeum vulgare
gcaaaacattcgctcgacgattaagattcagtttgacaagtgataaccactgacccaataggttttttttttgttctcacaaacataaacactgaccgaagatgttcaccgacaccacctcataagactcgaggataattacaacccattacgacgacataaagaagagcgctgaaatgcagacatgacaaatactaagagttggtcattcagcacagcggcagcggcaccacctagatgctcctctactcaaaggcccactggttctccctgcggatctcctcctcctcctcaggtgtaaagtcattcttgatgttgaatgtcttgcggatctcctctggggttttgcccttgatcatgtcggcaacagtctgacaggtcaggtccagcagccccttgatgttgaggtagttggcagccaggatgaggtcgaagagggttgcctggtcgaccttgacgaactctgcgtcccagttcttgaggtcctcag

SEQ ID NO: 4333 - DNA, 551 bp, Hordeum vulgare
gttcttcccgggctgcaggttcttattctacttgagaaattaaggccaaccagccaaccatggcaaccaacaagagtattaagagcgtggttatttgtgttctcatattgggtttagttctggagcaggtccaagtagaaggcaagagttgctgcaagaacacgacgggcagaaactgctacaacgcctgccgtttcgccggtggttcccgaccagtctgcgcaactgcttgtggttgtaaaatcataagcggcccaacatgtcctagggactatcctaagctgaatcttctccctgaatccggtgaaccaaatgcgactgagtactgcacaattggatgcaggacttccgtttgtgacaacatggacaatgtttcccatggccaagagatgaaattcgacatgggactctgcagcaacgcatgtgcccgtttctgtaatgatggtgaagtcattcagtctgttgaagcctaatcatgccttcttgggcatgatttctatggccaaggtcgttttgtcattttctgttcaacaatcttgataccatcacca

SEQ ID NO: 4334 - DNA, 507 bp, Hordeum vulgare
tatacaagaaaaacattaaaaaatttaaaaattgtggtgtatcacataatatatccatggaacttttatctaagatgatacatttgcttcgatctggtgatggtgtcaagattgttgaacagaaaatgacaaaacgaccttggccatagaaatcatgcccaagaaggcatgattaggcttcaacagactgaatgacttcaccatcattacagaaacgggcacatgcgttgctgcagagtcccatgtcgaatttcatctcttggccatgggaaacattgtccatgttgtcacaaacggaagtcctgcatccaattgtgcagtactcagtcgcatttggttcaccggattcagggagaagattcagcttaggatagtccctaggacatgttgggccgcttatgattttacaaccacaagcagttgcgcagactggtcgggaaccaccggcgaaacggcaggcgttgtagcagtttctgcccgtcgtgttcttgcagcaactcttgcctt

SEQ ID NO: 4335 - DNA, 512 bp, Hordeum vulgare
caaaagtccgtggagataatgcgcaagttctcggagcagtacgcccgccgctccagcaccttcttctgctccgacaagtccgtcaccgccgtcgtcatcaaggggcttgctgaccacaaggatcaactcggagctcctctctgcccctgcaggcattacgacgacaaggccgccgaggcggcccaaggcttctggaactgcccgtgcgtccccatgcgagaaaggaaggagtgccattgcatgcttttccttacgcccgacaacgattttgccggagaggaccaggccatcagcttggaggagatcaaggaggcgacgtccaagtactaaccagaaaacgcctgtttttgctcgagagggggctatagtcggtcggtcggtcggcgttgtcggacctgtatatgtagtatctctgtaacagcagcaggaaaataaaaatgtttgtctggaatgatgtctggtgtcatccgtctcgagagaaattaaggcctgatggttgcaaaaaaaaaaaa

SEQ ID NO: 4336 - DNA, 446 bp, Hordeum vulgare
gacaaacatttttattttcctgctgctgttacagagatactacatatacaggtccgacaacgccgaccgaccgaccgactatagccccctctcgagcaaaaacaggcgttttctggttagtacttggacgtcgcctccttgatctcctccaagctgatggcctggtcctctccggcaaaatcgttgtcgggcgtaaggaaaagcatgcaatggcactccttcctttctcgcatggggacgcacgggcagttccagaagccttgggccgcctcggcggccttgtcgtcgtaatgcctgcaggggcagagaggagctccgagttgatccttgtggtcagcaagccccttgatgacgacggcggtgacggacttgtcggagcagaagaaggtgctggagcggcgggcgtactgctccgagaacttgcgcattatctccacggacttttg

SEQ ID NO: 4337 - DNA, 545 bp, Hordeum vulgare
gtcccccggctgcgggattcggcacgaggctcagaaactcaactcatccgaagagcccggaatctgatacaagctcctcttggattatttcctcgcccttggccttctaatgttgatacctcagagggtagcagattcctcaaagtcgtcgaatattttcgcttggtcggtcgagttgtggcgaaagtcttgcaggatggacggcttttagatttgcctttgtcaacagcattttataagctaatactcgggcaggagcttgatttattcgacattatctccttcgatgctgagcttggaaagacactgcaagaattgcaagttcttgttgagcgtaagaggttctttgagtccagctgtggcaaggatcagctaaaagttgcagacttgcgattccgtggagctcctatcgaggacttgtgtttagattttactcttccaggttttcctgattatgttctcaaagaaggcgagcaaaacacaattgttaatattcacaacctagaggagtatgtttctttggtagtcgatgcgacactgaagtc

SEQ ID NO: 4338 - DNA, 542 bp, Hordeum vulgare
gcacgaatttattataaagttacacatgtacagaaagtcgaagcaaacacagcaacattctcaaatcggtacataagacatggtatcgccaacgagcgaacaaatccttacgacaaatatgtttactcctttttatttacaatgtattggaggaaaggtgctcctgatacttgtcggtggtgctcgcgaggctcgccgcttcagcaggttcgactgatctttcaagctttatgcggagcggctggtaacctcaacctatgttattgcaggcaacgaagaagaaaactatttcgggataaaattgacgggcatccaatggtgagccctgtatcgttagtttatcagctcaggatagatcaaaagatccacggccttctaggatggcgtagagcagcttcttgcgcatgacttcttttgtggaatacgggggtagtttgagataattggcacacgtcatgacactgggcagatcgtcatccgcagcgtctgttaccccgcttgtattcaatgcactcaccccactcgaggggtgctttcgaact

SEQ ID NO: 4339 - DNA, 518 bp, Hordeum vulgare
gcatcctgctttaggcaagggtgacaatgtccttgccatatacggatactggactaataagagagataagaaaggcacaccactgcttaggatatttcagggtgcgcctgctgtaaggcgaggacggccgtcgcagaaatcttctgtaaaaaagaagagatccgtgaagagaccacaaagaagccaacctggccgtgggaaacctgggttcttcttgcaaggtggcgaaggtgaggccttgcagagggtggtggaagccgaccgtgctgcgaaacaggccgtagacaaggccatccagctgcgcagcagagcccaggccctcatggagcgggccaacctggcggcgtacaagtcggtgatggccgtgaggatcgccgatgccgcgagcgtgtctgagaggtgccgggacgtcgtctggaggagcctcgactaggccttgcttctttcttttgttcccgccgcatgtgtgatatcattggctagtctgcgaggctgtgttttttttcgccccatcctcc

SEQ ID NO: 4340 - DNA, 557 bp, Hordeum vulgare
ggaaaatcgcatttaagcacctctatcagatcagatgatccattcatccactcattcattcattcaactgttttcacctcgtctatgatctaacaatacctcatcttttttctctgtcaaaacatgggcactacatataacatacagagtcggatccatccatccatccaccaacatctagctaccaaactatatcatttacacaaacgaattacagtttcttcgtctacgagtccgacccgggacccatcaatttccgcttctgcttcttcttcgcatagttacaaccggaggagaggaggatggggcgaaaaaaaacacagcctcgcagactagccaatgatatcacacatgcggcgggaacaaaagaaagaagcaaggcctagtcgaggctcctccagacgacgtcccggcacctctcagacacgctcgcggcatcggcgatcctcacggccatcaccgacttgtacgccgccaggttggcccgctccatgagggcctgggctctgctgcgcagctggatggccttgtctacggcctgtttcgcagcacggtcg

SEQ ID NO: 4341 - DNA, 543 bp, Hordeum vulgare
  UNSURE (4): n stands for any base
gggnctgcagggaattcggcacgagggaccgtgtcgctctgcgtcaagcgcctcgtctacaccaacgacgccggggagctcgtcaagggcgtctgctcaaacttcctctgtgatctgaagccgggttcagaagtgaagatcacggggccggtgggcaaggagatgctcatgcccaaggaccccaacgcaaccatcatcatgctcgccacgggtaccggtatcgcgccgttccgctccttcctgtggaagatgttcttcgagcagcacgacgactacaagttcaatggcttggcatggctcttcttgggtgtccccacaagtgacactctgctctacaaggaggagtttgagaagatggtggagatcggcggggagaacttccggctggacttcgcggtgagcagggagcagacgaacgcggccggggagaagatgtacatccagacgcggatggccgagtacaaggaggagctctgggagatgctcaagaaggacaacacctacgtctacatgtgtgggcttaagggcatggagaagggcatc

SEQ ID NO: 4342 - DNA, 549 bp, Hordeum vulgare
ggcaccaattggtttaacatttgatgatcgcggtgctcacactcatcgctagatacaaggcgtatatatggccgaagcttgagctttgcacaatatccatctggagtaaaaatgaaaactaggtgggaaaaacattagcatgcatgtccttccatggcaatgacacgatgatgatgatcagtagacctccacgttccactgctcagccttcttgagctgcttcttgtagtcaagccagttgatcccgtccttggcggcgaggtcgaccatgatgtcgtcgatgcccttctccatgcccttaagcccacacatgtagacgtaggtgttgtccttcttgagcatctcccagagctcctccttgtactcggccatccgcgtctggatgtacatcttctccccggccgcgttcgtctgctccctgctcaccgcgaagtccagccggaagttctccccgccgatctccaccatcttctcaaactcctccttgtagagcagagtgtcacttgtggggacacccaagaagagccatgccaagccattgaacttgta

SEQ ID NO: 4343 - DNA, 526 bp, Hordeum vulgare
ggcacgagggacgatggctctgcagaactgcaacggcacctggtgctgctccatcccatttttgtttaacttccatggatttcagctgagctttgtccgtcggcccggcgaggacagcagggtcgaccacacaagtcctctgtggaacaaaatcagcgtagcaacggactatgccatcctcatttggaatgtggtggatcagccaagatgcgccgacgctgaggagcacccggcgacctacgcctgcctcagcagcaatagcagatgcaccgatagcgattggacatatagcggctaccggtgctcctgtaacggcggctatgtaggcaatccctatgttcgccgtggctgctcgcgtgacaaaggatataacccaattcaacgggttacaaattgcacacggcaatgtgggaacattgatattcaatatccattcggcctagaagaaggttgttttgccaggttggctttccagctcaattgcactaatgcgacgacctctacgctccaaatgaaagatgatgaa

SEQ ID NO: 4344 - DNA, 548 bp, Hordeum vulgare
gtaatagtttctttacacaggcatgtgaagtaaaaattacactaccgactgcagggctacatggtgcctgaccttaaaatgtacatatgtgcttattattgatacataaaggacgaatgatcggaggtgcactaagcgtagaggctagatttatacatacatctagcgtgaaacaccatcatatgacatgaactcttgctcaaagctataacactgtttgatgttttcagatggaaaattagagttggcacgatcagaagcaaccaactgatcagagctatcctctcctcttggtggagttagcactggttccctctcttgttcattctctggatcaacatggcacagttttaacctttctgtttgcagaaccctcaaagccatctccacgtgtttcatggtcggcctatcctcgcctcggagcctcaagcacatctctgcaagggtagctacgctgctaatctcttcgtcagttgcttcatcaagaacttggggagctactatttctgtaacatgcctctctttcaaccacaaaagaaaatagtttg

SEQ ID NO: 4345 - DNA, 1751 bp, Hordeum vulgare
  UNSURE (1)..(9),(14),(20)..(23),(28)..(31),(430),(1201),(1428),(1464),(1470),(1487),(1496),(1562),(1618),(1641): n stands for any base
nnnnnnnnnggggncccccnnnnccccnnnncgtggggcaaacaacagggggaacccgtggggggggccccacaaaatagggggagggtccccacaataaaaataaaggggaggtgccggatattttatctccccaaggaaagcgtggccggacgcggcgctctttagattcgtacggggcgtaggtcgcgtgtttcgcctccagtacggacatttctgtgcggcgggacacacaacccgacatatagaacgaggtagcaagcataatgaccgtacaccgccacaagggacgaggcgtggtcgtggcgtttcgttcgcgctatgggcctattggaccgaggacgcgaaccgaggaggaagtgagagttaacataaatagcgagagttgtgacgtactccgtcgtggaggattttgcatctcttccagacnggaacgcataaaagtacctgatcgtgatgaggctatttatcgtaacttcggtttcgccggtcgtgtccattgcgccgccagcgttcgggttttgcgtgttcgtctgtcgcgtgcgaccggcgtccggtggtccgttccgcgcgggtggcacgggccgcgcttcgatctgttgtcgctggcgccctttttatcctatatttatttgcctaccggccgagccgactgaaaccggcagtactttggcggttgtgtataacatctccgtgtttgtactgtccttggccgagtcgccctatgtattatttttaccgttcgcagtaggggagacgtgaacggtgccgttgtcggtagagcagattgcacaagcggtcccacattatatttatcgccaccaggtatacgggccgcaccgctgtatccatgccgcagtgagtggtagatatagcgctacacgggtcgcagatacccattgctcggttacgtggtacagtccacgtgatgccgctgccactgaggtcagcacggcagcccgcccgcgctatttgttccgcgcagctttcgccgcgtttttaccacatgacgacagcgagaagaggcgggtgcggttcgattaatgtatgcgggctacagctacacgagcgtctcgatgtaaaataacgccagataatggcgacttaggttacggacgatacgcgcgcgtctcatatagagccgtattacgacctacggagtatagtattgctgcgtgcgcgcggcgtaattattttggantcttgtgtgtcgagcgtccgctgtagggcgcgatgacgtgcgcgggggtttgagaggtgtgtcccgcatggcgcgcatataattagagggacacggtgaggagattcatgccgcggactatagcgtactcacatatattccacctgatacgcagacgcatcgtggtggcgcatggcatgcgtacatagacggcacgtgactggatcccgcgtgaaagcgagtatgangagagatcggtgcttatgacgtggtgtactatccgntgtatntaggattcacgcggtantgaacgacntgggcgacgggttcgggaatgatgttaagtccacactatacaagagatatacacgcgcagcgttanattccgactggcgtatacagtcggtgtaggcgcgtactccgcgagggtgtgagtantataagggcccgagacaccgggntgaccgtgtacgccaagttcgcgctgcgctgttcgatagctagtggtaggaccggtcacgcagcgattatagatgccagcgcgcggcagcgcgaggcagagaggatgagg

SEQ ID NO: 4346 - DNA, 547 bp, Hordeum vulgare
ataagctgcacatatttattattaaaacacttgacaataacaacaaagtgcagacagttcagacatacacatgttgctaacaaaaactcaaccgactatgactcgtacaacgatatacgctgcaaggagcgcataattttattcattacaatacaatacacacaagtacgaaatgcaaatacgtagctgccagcagcactaactccagggcttgttgcatttcttcatgaacggaagcaaggattttggcgctccatcctagccaatgcttcgcgtatctctctgataccttgcatcgcctctcccaggtcgctccttagacgccggatctctgtgctgagataggacatcctctgatccatgttcctactcaaatctgccaggattgcaacctgttcatgggtctcatggccttccaattgctcagaaatttcacgaggcagtcgctttatcagctcttttattttttcaacatctttctctactttgatttgattgatcacctcatcatgatcgctgcctatgtcactgccaagcttgttcagta

SEQ ID NO: 4347 - DNA, 481 bp, Hordeum vulgare
cccccgtggtgaccttcgggttcacgccggacagcaagtgcggcgggagcggcgacgacatgtcggagcagtacgtggccgtcaccaagcaggagaagaggcgccgccggaggcggatggcgtgcaaccggtgtgggaagaggaaatgggagagcaaggaggcctgcatcgtctgtgacgccaggtactgcggctactgcgtgctgaggatgatggggtcgatgcccgaaggccgcaagtgcgtcacctgcatcggggagcccatcgacgagtccaagaggtccaagcttgggaagagctcgaggacactcgcacgtttgctcagcccactggaagtaaggcagattttgaaagctgagaaagagtgccaagcaaaccagcttcgccccgagcaacttatcgtgaacggctgcccgttgaggccagaggagctgaccgacttgcttagttgctcgcggccacctcagaagctcaagcctgg

SEQ ID NO: 4348 - DNA, 506 bp, Hordeum vulgare
  UNSURE (54): n stands for any base
tgcttcgtctctattctaagaacccagacacagacatgaaaaaatcccatcctnacaggaaaaactttttacagaccaacaatcaatgaatgattttttgtacggcacgaaacggaaccgactggcggaaaaaacggagcgtcattggtcggagccggccttcgccagccgtcgacggggcagcggtgctcattcggctctgatgaagggggaggagctcatctcggtggtgctgtagaaggactcctcctggtagtagttgtcgtccttctcttcctcccacttgagcacctcccggatgtacttgaaggcctcgtccaccgtctgccggtcgcggccgcgcgcctgccacacaaacagcttccgccccgtgtggtcgttgtacgcctccttgaacttcatcgccacgtagtagtacgcctgctgggcgagggactggttgttgctctgcgtccgcaccggcgagaagtcgccgaaccactcgcacgccgtcagcggggcgcggc

SEQ ID NO: 4349 - DNA, 545 bp, Hordeum vulgare
  UNSURE (16),(31): n stands for any base
gtcccccggctgcagnaattcgcacgagggnagaagtgactgctgttgtgcttgtttggtggatgttctggaattgtcgtgtaacatgaagaagaatgtggtgacgttatgcagcgaaactcgcctgtatcgagctgaaaattaagttgtgggtggtgttgtgtcaaactgaattatctcgacccaagaaaggaatcacccattcaggtattatatctaccttttggggaggaaaaaagaatgacactctgtctattcttttgaatttaatgttccttgctatttcgtgtcaaagtgttgcttgagacactttaaattttcagatgcaaaatgttccagaaaatcacagcgaacaagacgactttaaattttcagatgcaaaatgttccagaaaatcacagcgaacaagacgacaggaccggagaaaacatccggcggaaaccaaattaggatgaaaacaaactgacttgtgaatatatatattgaaactataggctacttgggcaagttgtggcatttggcttccaaatgaacttcaggaggtt

SEQ ID NO: 4350 - DNA, 551 bp, Hordeum vulgare
atttttaaaacgtgtttaaaatgcatctattgtaaatgggttcatatgcgaatgcgtgcaggacgtgcgctctcataaaagtattcccatgtattgctcatatcccatctcttacaacaactttatgtcaaataaccttacattgcattccgatccaaacttgagtggaatgatagaaatatgtgttcatattttttccctaaaattgagtggaatagttggaacttgtatttttcttaaataactggaataagagtctagtgtatgtgaaataactaattcaaagtgtacttttatgaatttggatgaaataatcaaagtatgtgctcaacttttcaagagttgagtaaaataattgaaatgtgtgttcaattataatgtccatgcaactgatttcaaagattattaaaaataaatttcacaagtttagtttcacaaacgtacaaaaactaatttaagtaatcaaaatatgtgtttggtttcatttgaaacagtataatgtttgagaatccaatttcaaaatttcccctttggaaccacgaggccttatt

SEQ ID NO: 4351 - DNA, 486 bp, Hordeum vulgare
acaggtgaggtgacggctcagcataatgcccacacaaccttggttaaccgcgtctcttccagcaaaccccaactaagttaaaaggtgaaaggagctgttcacagcgaatcagctgatgatcgccagggacagagatgaacaggcctcgcctccaattttgaatgaaaccttgggggaaaccgcaccgaaactgaggtgcgccagacgcgtactacacaagttcagtcttggttttttgagtatttagtagctatatgttgtttgttattatgtatttactagagcgcgggagaaaagagccgggcatccttttttttcgttgcgtgcgaggaaaagcaacatctggatgccattgtacagataatccgcctctaccccgattcattgttcgaaggcgcaaaccagttcaccccctcattctttttttgattttgatgagaatagaagatagagataatctgtctatcattctagtgtaagaaagga

SEQ ID NO: 4352 - DNA, 541 bp, Hordeum vulgare
cacacatagttttaaatttgggtcaagcaacaacgagcacatagacgaaattgttccaaaccacaccagccaagatcaagaaaaaaacaaagaacttgctgaatacaacagctatcaactcacaaggggcaatgagctcttttatgcgtttaaccgaggcaaaagaattgaatcatctccaaagaataatacaatacaacacaatataccatggtatgggagcaagtacagacaagtataacaacaacaacactttctacaacgtggctgggctttcctttcttacactagaatgatagacagattatctctatcttctattctcatcaaaatcaaaaaaagaatgagggggtgaactggtttgcgccttcgaacaatgaatcggggtagaggcggattatctgtacaatggcatccagatgttgcttttcctcgcacgcaacgaaaaaaaaggatgcccggctcttttctcccgcgctctagtaaatacataataacaaacaacatatagctactaaatactcaaaaaaccaagactgta

SEQ ID NO: 4353 - DNA, 519 bp, Hordeum vulgare
ggcaatccgtatattccttgaagatggacaccaaattggatgtgctcagtcatatgcaaagaacatgggtctttatggacagagagcgggatgcctgagtattctctgcgaggatgagatgcaagcagttgctgttaagagccaattgcaacagattgcgagaccaatgtacagcaacccacctgttcatggtgcgctggttgtttctattatccttaatgatccagaattgaagaacttatggttgggagaggtcaagggtatggctgatcgtatcattggaatgcggaaggcacttcgggagaatcttgaaaagttaggttcacctttatcatgggagcatgtcaccaatcagattggaatgttttgctacagtgggatgacgcctgaacaagtcgaccgcttgacaagtgaataccatatctacatgacacgcaacgggagaataagcatggccggcgtaacgacgggcaacgtctcctacttggctaatgccattcatgatgttaccaagtgaaa

SEQ ID NO: 4354 - DNA, 545 bp, Hordeum vulgare
acatccaaatgtttgatttcgtcgagtttgaagtcctccagcatcttgttaaaatcaaggtataaccaagcattttccactggcgtttcattcgaatgtgactagaatcacaataagataatctggcaaaaataagtcgggacgtctctgcttctccatacatacaggtagaattttccgttgttggacagccgcaacaggtttacttcctagaacttatttctctagcatgacagtatagaatgaatagccccagtaacaaagggaaaacccctttcgctccattcgctgaagatggtcctcgatttcacttggtaacatcatgaatggcattagccaagtaggagacgttgcccgtcgttacgccggccatgcttattctcccgttgcgtgtcatgtagatatggtattcacttgtcaagcggtcgacttgttcaggcgtcatcccactgtagcaaaacattccaatctgattggtgacatgctcccatgataaaggtgaacctaacttttcaagattctcccgaagtgccttccgcattcca

SEQ ID NO: 4355 - DNA, 518 bp, Hordeum vulgare
gaagcggcgcgtgctgtgggggtgggtcggtgagaccgactccgagcacgctgacgttgctaagggatgggcctccctccagtcgacccctcggacggtggtgctagataacaagacagggagcaacctcctgcagtggccggtggaggaggtggagacgctccggaccaactccaccgacctcggccgggtcaccatcgaccacggcttcgtaatccctctcagccttcaccgcgccacacaacttgacatcgaagcctcattccgtcttgacccgctcgacctcgccgctgccaaggaagcggatgtcggctacaactgcagcaccagcggcggcgcggctggacggggcacgctcggtcccttcggcctcctcgtggtggctgatgccaggcaccacggtggtgaaatggagcggaccgctgtctacttctacgtcgcgagaggcctcgatggaggcttgcacacacacttctgccatgacgagacgcgctcatctcatgccaacgatattgtta

SEQ ID NO: 4356 - DNA, 531 bp, Hordeum vulgare
cccttcttggtcaaaaaatagtacaaagagctatctatcacatttttttctaaacaaaaataaaatttccattttgtttttacagtgaggcagtgtaggcctggttgtaggaggagtccatctcgtggatgacgaggcttgtggtggtgacccgggcgccggtggcgttgttgaagaggtataccccagcgttggcgtagatggcctcagtcgggtacacacgtgacgtcgcggtcaacctcccgcccattgcaaagctctcaacgattgaatgatccactagcaccctcaccgaaaacatctcgccattgagcacgggaacaatattgcctacgaccctcttaacaatatcgttggcatgagatgagcgcgtctcgtcatggcagaagtgtgtgtgcaagcctccatcgaggcctctcgcgacgtagaagtagacagcggtccgctccatttcaccaccgtggtgcctggcatcagccaccacgaggaggccgaagggaccgagcgtgccccgtccagccgcgccgccgc

SEQ ID NO: 4357 - DNA, 318 bp, Hordeum vulgare
gtgacatcgagaagtttaaagattacaaaccctcggctgcagatgcgcctgcagctccttcagaatcgaaggctacaccggaacctgcagagccaaaagtggaggagaaagtacctgccaaggcttctgagccgaaggccccaaaggctgaagaatcttctcgatctggtgatagaatattcgccagcccccttgcaagaaaattagcagaggataacaatgtccaactgtcaagtgtaaagggtactggtcctgatggtcgtattctgaaggcagatattgaagattacttggcttctggagccaagggtggcaaga

SEQ ID NO: 4358 - DNA, 535 bp, Hordeum vulgare
  UNSURE (33): n stands for any base
gagacctcctcgttaaatttgcgtgtatatagngaaaaacgcaaatcctataatcgggagtttctcggtggcacagaacccgcaaaaaaatgagctcaacaggtcatgcaagtcaaacctacatcaatctggtcattcctgggaagaaaccgaacagaatacattccaatccaaaaaaacaggtcatcctgtgtgttcgcttgcaggctctgtgctcttggttccaggtcccacgagaccccgcaccgaggttatgtaaaacgggacagcgccgttctgtgcattattcaagaactcgacaagaataggtttcatcctcctaactttacagcagcattgtggtcgggttctcgatgtagcccttgaacgctttcaggaattccgccccaattgcaccatcaataaccctgtgatcgcagctcattgttactgacatgtaggaaccaaactcgtactgaccatcggcgctgcctggtatcaccctcttctcagcagaaccaatggccaagattgctgactgaggaggatttatgat

SEQ ID NO: 4359 - DNA, 518 bp, Hordeum vulgare
cgatgttggtgtcgggctgaggtatgactggggaaagttctacgcgtctaagacgttctatgatccagcaaagaagcggcgggtgctatgggggtgggtcggcgagaccgactctgagcgcgccgacgtcgccaagggatgggcgtcgctccagtcgatccctcggacggtggtgctggacaccaagacgggaagcaacctcctacagtggccggtgcgggaggtggaaacgctccggaccaactccaccaacctcggccgggtcaccatcgaccacggctccgtcttcccgctcagccttcaccgtgccactcaactcgacatcgaggcctcattccacatcgacccgctagatgtcgccgcagccaacgaggccgacgtccgctacaattgtagcaccagtggcggggcggcgggacgaggcgccctcggacccttcggcctgctcgtgctcgccgataccaggcaccacggtggtgatgcggagcggacctccgtctatttctatgtatcgaggg

SEQ ID NO: 4360 - DNA, 551 bp, Hordeum vulgare
gtaaaattgatttgattgatgtagtacatatacagctctagctttgcatatcatggcatcttccactagctcaactacaactttttggaagaccttgacaatgaatagacataataaaaatgaaaagggaaacaaagatagcgggagtgaggagaaaatcagaaaggaaattacacatatatgtatatgctatcaaaaaaatgatctttctgttttcattctacatcgaggcgacgtaggcctggttataggaggagtccatctcgtgggcgacgaggctggttacagtgacccgggcgccggtggcgttgttgaagaggtacaccccagcgttggcatagatggcctcggtcggatacacccgtgacgtcaccgtggacctcccgcccattgcaaagctctctacgatggagtggtccaccagcaccctcactgacaggtcctcaccgttcagcaccggcacagtgttgccaacgaccctcttgacaatgtcattggcacgagacgaacgcgtctcgtcgtggcagaagtgtgtgcgcatgcctccgtcg

SEQ ID NO: 4361 - DNA, 522 bp, Hordeum vulgare
gtccttccgggcctgcagggaattcggcacgaggatacagatgtaacatgtgaacctactggtcatcaaacacgacccagacgaagtgccactcgttattctaatttatcagagagaaaaaagaaaggaagcacagggagaaaaaagaaagagagaaaaaagaaaggaagcacagaagatgagatgtctgaacttcccatatatcttgagccaaaagacgatggtctcccatttgcagacgaaaatcaaccagagggtggtgcattgtgggatatattccgccgggaagacgccagtaaactgcatgagtatctaacaaagcattcagaggagtttaggcattacaactatgaatcagtaaagcaggttattcatcctatacatgaccagtgcttttacctaacaaatgagcacaagagaaagcttaaggaagaatatggagttgagccttggacatttgaacagaagcttggtgatgcagtctttattcctgcaggatgtccccaccaagtcagaaatttg

SEQ ID NO: 4362 - DNA, 541 bp, Hordeum vulgare
  UNSURE (15): n stands for any base
tatacggtcactggnggttgatatgcaagtcccagcttacaaggttaattatacagcaaccctgctgtcagcactactaaaaacaccaccaaaataattatggctgttcatccagtcttccacagcccacagatagacaactaccaagcggcgctccacaaccaaggttctcacggagcgcctccggttcccctccccagcccgccctacaggcgctcgaacacctgctgagcggcaagttcgggggtcagggagctcgacggtctctcatcgatgcgctcccgcaaaatgctactacaacggatatagtcatggtcatacgggtggaacacggtctctacagagcggcgggcgcaaagcgttgcccctcatgccgttctaggcatggtggtagcctcagcctcctgggccactgcaggaccttcttctttagcttcagagatgccatcagatggttgctcgtggcgctcctctgtttctgatggctcgccttctttggcagcttcaactttagcttcaggcatgtcctccatttttgcag

SEQ ID NO: 4363 - DNA, 546 bp, Hordeum vulgare
gtcccccggctgcagtctaccagttttgctttgcgggaaatgtgttgcttgtaaatggaagtgatattcgtccttggtggatataccaccactatttagcaatgctaatggctcttgttagccttacttgggagataaagggacagcctgattgctcgagtaagcagagaggggtacaacttttcctgcgttgggcaatcatgcaaggaattgcaatgcatctacagaataggtaccagcgtcaaagattacgcacccgaattgctctgggaaaggctaaaagaatggatgtcgtcgctggagaaacagctggtgtggaagggcagctattgctactatatcctgttctttttgtattacaggggtttgaaggatatgttggagtgttgcttcttcagacggcgtggcacgggctcacctctgaatggcaggtcatagtttgtgggatcttgctggtggtgatggcggttggcaacttcgtcaacacggtggagactctggccctgaaactgaggttcaaagcaaagatgaagaggacgcggcaca

SEQ ID NO: 4364 - DNA, 542 bp, Hordeum vulgare
  UNSURE (20),(27): n stands for any base
ccatgctcaaagatgctggnaccagtncaataatacacaatgattgtaccaactcgaacggcgattattgcgcgtcgagtcgccgtaacgtgcgttgaacagagcgtaaggcttggttgccacggaaccaaatttaccgatataagaggaaaaaaaggggaaaaacccacgagaacaaaaaatggtgtaccgattaaaggatatacataagagatggttttgtcagcattgatgtttccaggcatggatggaggagtggcaccatactggattactatcaattttgatggaggcgactcggaccgccctggccaggttcctgcctgtgccgcgtcctcttcatctttgctttgaacctcagtttcagggccagagtctccaccgtgttgacgaagttgccaaccgccatcaccaccagcaagatcccacaaactatgacctgccattcagaggtgagcccgtgccacgccgtctgaagaagcaacactccaacatatccttcaaacccctgtaatacaaaaagaacaggatatagtagcaat

SEQ ID NO: 4365 - DNA, 10 bp, Hordeum vulgare
  UNSURE (1)..(10): n stands for any base
nnnnnnnnnn

SEQ ID NO: 4366 - DNA, 948 bp, Hordeum vulgare
  UNSURE (864),(948): n stands for any base
actcccacagtgtatatatatatgtcttaaattatcagatacaacagcagcagaagagccagttaacttactgtaaaacaaaagaactcccaacataacacttccagtaacaagtacacagcaaccaagacatgtagaacatgtagaaacctcaagcaaactgcaaccacaatcatctcatcttccttcctactctaccagcaacacctttctttctttacacatgcttctctctcctcccttccttttctccctttctctcttctcttatgttacaagggcccgcggcactgttttctcctcggctcagctcctgaacccgaagttggtccaccgcctgcccccggagccatccttcttggcgccccgcgcagcaccgccggacccgaacaggttctccagcgacttctgcttccggttccgggaccgccctgcctccttcagcagctccgcaagccgcttcttctcgtcctccacgtccgggttcgccgtgcccagcttctcctcacgcactttcagcacgtgctccaggatctcgatcgcgtcttccacccttcccatggcatcatagatcgcagccaggttgctgtacacaccaagagtatccggatgagaggcgccacactcctgctctagaactgcccgtgcttcttaaacagctgtgcagcctcatcaatcttgaacagctgtacgcaagctagccccatctggttcagcagaaacgccgaaaatgcgggacttcctctccccgctagccctctaatttggaaaccgcactctcgaacaagttccttgaatcggcatatctccctatcatgtagtacaacacccccatttgagccttatacagcaacggtgctcaancctcgtgccgaattctgcagccgggggatccactagttctagagcggcgcacccgggggactcacttgtcatgaaaggaaaaan

SEQ ID NO: 4367 - DNA, 531 bp, Hordeum vulgare
ggaattcggcacgagggctccaggatgaccgtcatgccggcatggtcatgacctacaagaccaaggatttcatggactatgagcttgtccctggggtgcttcaccgggtgccggggacggggatgtgggagtgcatcgacctatacccggtcggaggcgtgaggggcatcgacatgacggacgcggtgacggcagcctccaacaatggtggcggcgatgtgttgcacgtgatgaaggagagctctgacgatgacagacacgactactatgcgttggggaggtatgacgcgaccaagaacacatggacgccgctggacgtcgacgccgatctcggcatcgggctgaggtacgactggggaaagttctacgcatccaagaccttctatgatccggcaaagaagaggcgtgtgttatgggggtgggtcggcgagactgactccgagcgcgccgacgtcgccaagggatgggcctcgcttcaggtacttaacgtcttcatcatattcgtcttgtacaacatgtcaaagtcaattg

SEQ ID NO: 4368 - DNA, 554 bp, Hordeum vulgare
gagaccttcctttgtataaaaacatgcgtacaatgtgctatctatcacctttttttctgaacaaaatacgttttcccattttgtttttacagtgccatgtaggcttggttgtaggaagaatccatctcgtggaccacgagtctagtggtggtgacccgaattccagtggcattgttgaagaggtacaccccagcgttggcgtagatggcctccgtcgggtacactcgtgatgttgcggtcaacctaccacccatcgcaaagctctcaacgatcgaatgatccaccagcaccctcactgacagctcttcggcatcaagcaccggcacggtattgcctacaaccctcttgacaatgtcgttggcatgagatgagcgcgtctcatcatggcagaagtgtgtatgcaagccaccgtcaaggcccctggcgacatagaagtagacggcggtgcgctccgcgtcacctccatggcgcctggcatcggcaagcacaaggaggccaaatgggccgagcatgccccgccctgtggcgccaccgctggtgctgcaattgtagcc

SEQ ID NO: 4369 - DNA, 293 bp, Hordeum vulgare
tcatcgattatgagcttgtccccgggttgcttcaccgtgtaccggggacgggcatgtgggagtgcatcgatttatacccggttggcggtgcaaggggcatcgatatgacagaggcagtggcggccgcgtccatgaatgcgggcgacggtgttttgcacgtgatgaaggagagctcggacgatgaccggcacgactactatgcgttggggcaatacgacgcggcaaagaacatgtggaccccactggacaccgacgccgatgttggtgtcgggctgaggtatgactggggaaag

SEQ ID NO: 4370 - DNA, 246 bp, Hordeum vulgare
tttttttttttttttttggaaattacacatatatgtatatgctatcaaaaaaatgatctttctgttttcattctacatcgaggcgacgtaggcctggttataggaggagtccatctcgtgggcgacgaggctggttacagtgacccgggcgccggtggcgttgttgaagaggtacaccccagcgttggcatagatggcctcggtcggatacacccgtgacgtcaccgtggacctcccgcccattgc

SEQ ID NO: 4371 - DNA, 518 bp, Hordeum vulgare
cttgcttttggttgggctgttgcttcattggtcagaaaaaaggaaattcgtaagatgaggcgcaaaatggcatctggacatagttttgcctttctttgtgatgacgtagatgagcttgagcactccgtgcagcagaaattacctatggtctctgtagtcatgcctttgaagggctttggggagcacaatttgcaaaattggagaactcagattacttctctttatgggggaccattggaattcttgtttgtagtagaaagcaaagatgatccagcttatcgtgccgtctcccgattgattgtagagtacaaggacaaattggacgcaaaggtggttgtagctgggttttcaacaacttgtagccagaaaattcataatcagttaattggtgttgaaaagatgcacaaggacagcaaatatgttctatttctggacgatgatgtcagactgcatcctgggacagtcggagctctcacaaaagaaatggagaagaaccctgagatatttatccaaacggg

SEQ ID NO: 4372 - DNA, 527 bp, Hordeum vulgare
  UNSURE (4): n stands for any base
aatnctgccagttacatatctgtaatgttacaagaactactatgagttgcaattttaattaacgcctgaacaactgaatccagtaagaatgagagaccctaccattaccaaccaataaacaatcaataaaccaaaagaaaagaagaacaaaacacaggtgtacaacacgacgccccacaaaattgaggacaggattccactaggcattctcagacatcatacttcttcggctggtgccattgggctaggcttatggacaggtagccgagcaacgactttccagcagggtatgtcctcttgccatagagatgcttcccaccgagatcggtgtacttcgaactgttctccctttcaatcttgcttattttcccatctctcaggtagtacctgataccagaccaattgattgattgggagaaatgggaccggatggcagatatcgggtagaggaaattgtctactaacacggcaacgaacacaagcccccagttatatgaacgaagggagtcttgtggtccttctggaga

SEQ ID NO: 4373 - DNA, 417 bp, Hordeum vulgare
cgcagagcctccacgcgcagctcctcacctccggcctccgccccaccgcgggcctctccgtcaagatcctcatcctgcacctgcgttgcggctcccaccgcaacgcccgcgcggtgttcgacgggatgccccgcccgaccaacgccgcccacaactacctcgtcgccggctacttccgcctgggcctccccggggacgcgctggggatcgtgcggcggctcgcgggctccacggggcggctcgacgtgttcgcgctctccatggcgctcaagctgtcggcggcgctggcgctgccccgcgccgcgagggaggtccacgcgcgcgtcgtgaggtccctcgcggcgctcgacgagatcctcttcgcggcgttggttgacgcctacgtgaagaacgcgtcgctgggatacgcccggcggg

SEQ ID NO: 4374 - DNA, 407 bp, Hordeum vulgare
ttttttttttttttttaactaaccatagacagttttccaacataaataccaatgaccagtattagtatgtttttccaacataaatatcatgaggaaaacatcattcatttgcgtcaatccacaggtggacagttgtcagacccaacccagctgcatgctgcgtctttgagcacaccacgctgtttcatcatctctctaacttggtgcacaccgtcccattttccggcggccgcaagggtgttggagaaggccatgtaggcacccggtctcccggcccggctcaactcgaatacctcccttgacgcgacattggcaatgtccacgtcgccgtgcagggtggccgccccgaggagggccgcccacacgtcagagtttggcctcgccggtatccccctgacaaaatcgta

SEQ ID NO: 4375 - DNA, 335 bp, Hordeum vulgare
gtcctcttctccatctgcgcccaggctgcgtgtggtgctatctttggtgtcgcacccttcgtctccagacgttcccttggcatcatttctgggttgaccggtgctggtggaaacgtgggcgcagggctcacacagcttctcttcttcacgtcatcgcaatactccactggtaggggtctcgagtacatgggcatcatgatcatggcatgcacgctgcctgtcgctcttgtgcacttcccacaatggggatccatgttcttccctgccagcgccgacgccacggaggaggagtactacgcctcggagtggtccgaagaggagaaagccaagggtct

SEQ ID NO: 4376 - DNA, 293 bp, Hordeum vulgare
ttttttttttttttttttttttttttttttagtacaagagacagaatctcaaagctgttgtaaattcagagcacaggtaccctcgcatgcgtgcatgcacagaccaaacatttcgtgcgtaagaaacgctttacataggcctacactacaaatgtaaattcatacgccttattacagccgatgttgcaggcgtatatatatacgaacgtgcactgtagttcagtacttgtacataggtatgaaaaacaatccagtctcatacgtgctggggcgtattgttgggtggtgtggcg

SEQ ID NO: 4377 - DNA, 519 bp, Hordeum vulgare
gcctacttgaagccattgtgaagcatgctaatatggagcaccggctgggagataaggaatctgcttgtttagtttatgagaaagccattgctgccgaaaaggaaaaggagcagagccagtttttaccaatgctactgattcagtactcacgtttcttatatatgatctgtgacttggaaaaggcaagggaggtctcaggtggattacacgggctagttaacatgactaaaccagttcttgaggctgtcatctttctcgagtcgatctttcaatctgagaagcgaattgatttgttagaatcactggtggagaagtttcttacaactgagcagactcaaggggagctggcaagcttaaacgacaaagaggaattatcttccatatatttagagtttttggatacctttggggatatacagttgatcaagaaggctacaactcgacatactattctattttcacgtaaaaggagcattctgccatcaaagaaacgaagagccgatgatgctgttatgtctg

SEQ ID NO: 4378 - DNA, 550 bp, Hordeum vulgare
gttttttttcctttttattaatttaaaacatttatggaagattcctagaaacacaaaagatgattcctagtaacatgcatgcatgagtaaaggaagatcctatacagatcttagatctgggacgcattacaactgcagctgctgcaaatagcatctgaccgaatactctagttacacctcgaccggacaaacaaaaaagggtctcgcaatccaggtcttccttctttggcctgctgctgccaaaaaacctgcctgccaatgcaaacgataacacaggggtttacaagctatgtggatgcctttcgcgatggaaggcagctgcgtaggtacacatgcccatgcgttgacaacaccaatctagaaatcagtagtacgtggcggcgctgccatagtaagcttggggggcggcagccacagcaggttgctgagggtaagctgctgcaggtgccggcgcctgtgctggggtgggcactggtgctgccacgggcatcgctgcaggttgtgcgtagctctgctgcgggtaggcctgggcagggtatgtgggaggata

SEQ ID NO: 4379 - DNA, 548 bp, Hordeum vulgare
tcccccgggctgaggaattcggacgagggtgggcttggaaccctggtacattgctcatcggccggtgatcctctattatagcctggagggccggctcagacctcgatactatgttttgaagtttctcaaggaagctggattggtcgattgcaacatgagcttctatactgtggtcacgaggaccgacaagtatttcgtggacaagttcatatgccctcacaagaaagctgcgccacaccttgctcaagactatgcagccgcttgcaaaggggaggtgccaagtaattttagatttacttgaaccaaaagtgagccaaggaaatttgttattatgtagtatcacgcaacaaagttttcactctgcattagtaagctggtagttcctgttctggtgttctttgccaaactagatttttagttattttctgtagcatgcgtgttacatgccggtttggtcattgctaaatgctaactcgtattctattcctggaccctgatatgttgatgttgtcattccttagagaaaatctttgtgtcttcctgataat

SEQ ID NO: 4380 - DNA, 485 bp, Hordeum vulgare
ataacagacagcgccaatctgacaacaaacgcacatgattgcaatgcaaaggagcactaacaaagaatccgtaaactagaaaaagaggaccacattaaagagaggtaaaatataaccaggacactgatttttccacatgatattttccctacagttctgcagctatggacaactaactgtaaggcatgaattcaactaatgacatgaagcaatgatacaacgagaagcaagtgaagatttcagtaatgaaatcaaccaatgaccagaagaagcatatcttaatcggattaaaacagatggatttcttactaagaaaaggatatgtaccagataaattgaggagtaattctcaaaaaaagaaaagaaaaaaaaagcagagtttatgccacatgctcttatgtgtaaggagtttgatctcactgagcaccatcttggcaggctgcattggctcatgtccacgtatctgaaggaggaatgccggcaaa

SEQ ID NO: 4381 - DNA, 519 bp, Hordeum vulgare
agacagcagtgcgcattccgatccccgcatctcgcgcagcttccagttcgccggagaagtagcaagcaagaagatggccgggaggaagggcggcgacaggaagaaggcggtgaccaggtccgtcaaggccgggctccagttccccgtcggccgcatcgggcgttacctcaagaagggccgttacgcccagcgcgtcggctccggcgcccccgtctacctcgccgccgtcctcgagtacctcgctgccgagctgctggagcttgccggcaacgcggccaaggacaacaagaagagccgcatcatcccgcgccacctgctgctcgccgtccgcaacgaccaggagctcggaaggctgctcgccggcgtcaccatcgcccacggcggtgtcatccccaacatcaactctgttcttctcccgaagaagtccaccgccgccgccgagaaggagaccaagtcgcccaagaagaagacggccaccaagtcccccaagaagaaggcccccgccgccaaggagtagcc

SEQ ID NO: 4382 - DNA, 560 bp, Hordeum vulgare
gattgtaactaaccgattgcattatttagtcactccctacagaaatcacagatacaatgtcacccttgctgcgccaatctaagaacagaagcactgctcatctaactaaccaaaagactgctcatcttgtccatgagaaatggaacgaagcaacacaggctaggctatgggtgcgggcggctactccttggcggcgggggccttcttcttgggggacttggtggccgtcttcttcttgggcgacttggtctccttctcggcggcggcggtggacttcttcgggagaagaacagagttgatgttggggatgacaccgccgtgggcgatggtgacgccggcgagcagccttccgagctcctggtcgttgcggacggcgagcagcaggtggcgcgggatgatgcggctcttcttgttgtccttggccgcgttgccggcaagctccagcagctcggcagcgaggtactcgaggacggcggcgaggtagacgggggcgccggagccgacgcgctgggcgtaacggcccttcttgaggtaacgcccgatgcggccgacggggaact

SEQ ID NO: 4383 - DNA, 552 bp, Hordeum vulgare
gtacccccgggcctgcagggaattcggcacgaggaccaccgccgccaacaccacaccttgaaggacctcgtcgccggagcagcagcaagcaagatggccggaaggaagggcggcgacaggaagaaggcggtgacccggtccgttaaggccgggctccagttccccgtcggccgcatcgggcgctacctcaagaagggccgctacgcccagcgcgtcggctccggcgcccccgtctacctcgccgccgtcctcgagtacctcgccgcagaggtgcttgagctcgccggcaacgcggccaaggacaacaagaagtcccgcatcatcccgcgccacctgcttctcgccgtccgcaacgaccaggagctcggcaggctgctcgccggcgtcaccatcgcccacggcggcgtgatccccaacatcaactccgtgctgctccccaagaagtccgccgccgcagccgagaaggaggccaccaagtcgcccaagaagaagaccgctaccaagtcccccaagaagaaggccgccgccaaggagtagcctagctgacactta

SEQ ID NO: 4384 - DNA, 547 bp, Hordeum vulgare
gaagggtggctcttagtcttgatacaatctaatcacaggtaaaacagtcctgactggcctgttcatcgaacaaatgaaagagccatacagactggcatttacatacatgatccaatcaaccaaaagtctgctcatcttctccctgataccgaactaagtgtcagctaggctactccttggcggcggccttcttcttgggggacttggtagcggtcttcttcttgggcgacttggtggcctccttctcggctgcggcggcggacttcttggggagcagcacggagttgatgttggggatcacgccgccgtgggcgatggtgacgccggcgagcagcctgccgagctcctggtcgttgcggacggcgagaagcaggtggcgcgggatgatgcgggacttcttgttgtccttggccgcgttgccggcgagctcaagcacctctgcggcgaggtactcgaggacggcggcgaggtagacgggggcgccggagccgacgcgctgggcgtagcggcccttcttgaggtagcgcccgatgcggccgacggggaa

SEQ ID NO: 4385 - DNA, 350 bp, Hordeum vulgare
cagcaccagcaccagcagcattccatggcgcccaaggctgccgagaagaagccggtggagaagaccccggcgggcaagaagcccaaggcggagaagaaggtgccggcgtccaaggagggcgccggaggcgagaagaagggcaagaagaagtccaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgagtccgccaagctcgccaggtacaacaagaagcccaccatcacgtcccgggagatccagac

SEQ ID NO: 4386 - DNA, 343 bp, Hordeum vulgare
agacaacaagcagcacaattcttacagagggtgtaacatcgtacttcaaactacatacataatgccaccatcaattcgtccatgcgatgcaaggcagacgcctaggaggaggtgaacttggtgacggccttggtgccctcggagacggcgtgcttggccagctcgccggggaggacgaggcggacggaggtctggatctcccgggacgtgatggtgggcttcttgttgtacctggcgagcttggcggactcgccggcgagcttctcgaagatgtcgttgatgaaggagttcatgatggacatggccttggaggagatgccgatgtcggggtgcacctgcttga

SEQ ID NO: 4387 - DNA, 551 bp, Hordeum vulgare
  UNSURE (21): n stands for any base
gtacccccgggcctggcgggnaattcggcacgggggagcaagtttttttctgggctggactagtggactgcctcctggtccacagatgggcgcttctctggcgaggcctttgttgtcttcccttcgtccatgcaagcagagtttgcgctgcaccgcaacaggcagaacatgggcaggaggtacgtggaggttttcagatgcaagaagcaggaatactacagcgcaatagccgctgaggtgaaccagggtggtgctctcctcgagcctgagcaccggcactcctcgcctcctctacggcccaggaggctgtctgaagacaagagcagcatggagtacactgaggtgctgaagctgcgtgggctcccttactccgccaccatagaggacatcatcaagttctttgtggagtacgagctgacggaggacaatgtgcacatcgcgtaccgctcggatgggaaggccactggcgaggcctttgtggagttcccgacggccgaggttgcaaagactgccatgtgcaaggataagatgaccatcggtaccaggtacgt

SEQ ID NO: 4388 - DNA, 546 bp, Hordeum vulgare
  UNSURE (8),(17): n stands for any base
cgagatgncattttttncaaaaagggtggtaacagttacaatctcagcaaagtatctcatacacagttttttaccctgaagacgcagtacgagacgtctcatcagaaacaggagcgcgaactaacacaatccaacagagatacaatttttaagcatgatgagagcacaaaggctaaaccggaacaagattatgcccttctgacacccagggttcagcatcttgtggtaagctgcgttcagtgcctgccccgcggcttcgccctgctcgcctcctcgggagtcgaggggaacagctccacgtacctggtaccgatggtcatcttatccttgcacatggcagtctttgcaacctcggccgtcgggaactccacaaaggcctcgccagtggccttcccatccgagcggtacgcgatgtgcacattgtcctccgtcagctcgtactccacaaagaacttgatgatgtcctctatggtggcggagtaagggagcccacgcagcttcagcacctcagtgtactccatgctgctcttgtcttcagacagcctc

SEQ ID NO: 4389 - DNA, 549 bp, Hordeum vulgare
gtcccccgggctgcaggtctgggtctgccgagggatctgctgaacaccccaagcagaattggagcaacaaggtcatcaattctgctggcacaaagatgtctgacagtatgcaaagaaagtgcaagaatgtaataagcaagctttggaggagaattggcaaagagggacaccaaaaaatacccaacatagcttcttggtggcgaaggaatgaaaattcttcatccaaaggtgtggctggaagcaccctcgacctacagaaaatcgaattgcgagttgatggattagagtatagcggtgtagctgagtttatagcggacatgcagcagatgttgaaaagtgtggttcaacatttcggctacagacatgaggtccgggtagaagctgagattctccacaacttattcttcaacataatgaagatcgccttcccagactctgacttccaagaggtcaaggactcgctgtcgttttcgaaccctggaggaggcgcgggcagcacggctgccccatcagcaaagcacctggcttcaggcctgaagcgtcgttccg

SEQ ID NO: 4390 - DNA, 403 bp, Hordeum vulgare
  UNSURE (52): n stands for any base
ggaagtgccgttaattagtttattcaggtcccggtaaccaattttgcttatnggaaacatacaacagatgataattactaactgattattaactaaacaccagctcattcccattatcactgtccctttcacatgagaacacatgcatcctctggttgcaccactaaacaacctaccacataacaaaggctattaaagtgctgttcctctttacagtaaacaaacaaatacccaacatacagaaagaaaatactcctaagccgcacaacattcccttcttctcatggccgtaagtccgcaacacatggcggcgattatgatgcatggagaatgtgtatgccgcgtcacaagtggcttggccgtctcttgccagtgtcggtccgctgccgcttggcgggcttgg

SEQ ID NO: 4391 - DNA, 949 bp, Hordeum vulgare
  UNSURE (841): n stands for any base
gtacccccgggtctgcaggcaattcggcacgagggtgagagagagagagagagagagagagagagagagagagagagagagagagagagagagagagagagagagagagagagagacacagagtctacacactccacagagagagagagacttatatagagagctctctctgtgaggggatacacatatccccccccgtgtgtgtatgcgctctctctctctgacacacatgtgagaacgtctcgtgtgtgtgtatatatggtgtctgcccccctctctccctctctattaagacgcgtggggacacatatatttatcccctctgtgagagagcgcgcgaacacactctctctctccttctcacacacagagagactctctctcgacacaacacacacacacgcgcgaggggagtgagatatattgtatgtctcacgcgccactctttaacacaccaagccgctctcacagtgtgtgtgacgctcttgggtgtcccccccctctctattcgggggggggatatacgcgcgcatatatgcgcgggagtatatcctcatatacgcatgtctctcacacactgagggcgcgctctctctgtggagtggtggggacagagactctctcccaacgcgtgtgttatcttttttataacactacacgcacgctcgtgatctctagagaccccgcgcgctctctattctctgaagacacacagcgcgacacacatggttacagatagcccacgcgggccgctctctttgatcggtggagacactcccgcgggacacactcagggggcgccccctctgaaaaataatatcacctctctttttctgcgccngtgtgtgttcgcccaccccccacaaggagagagaaaatctcggggggcccccgcgctcttctcccttctctcaaaggagccccgggggatctccctgtttaccatttt

SEQ ID NO: 4392 - DNA, 425 bp, Hordeum vulgare
  UNSURE (6): n stands for any base
cacttnatcaagcatacatcgtgcagttacatttcggggccaacgttcttgttattagggactatacatatccagttgaaacatcggagaaaaagatacatggaaaacaggaagctacagcaggcactccttgagaccgcaagggcgaagcgtgcaggctacctagcaagtttcttctccttttttggtcggtgttgacaatcacattgcggcgtaaaacgaggtcgtcgatgactcttcttcaggaaccgcctccttgagtttcccctgggtgaatctcctcagcatttcaagggcggccttcggctggtccatcggaaccatgtggccagcattgtgaaccttgaggaaactgagtgccccgtggctcttcagaactccagcttgggcatcgtctactaaaaacgatgattcagccgttttgg

SEQ ID NO: 4393 - DNA, 383 bp, Hordeum vulgare
catctgaacaagctttgatacaagttctgttgctccaacagtcgatgaggataatgacttgtctgaaaatggtttggattccgtggatggcccttctgttgttccagagaaaacaaggtcaaatactgacaacttggaatctcaggaagaggatgaacccaaatttgctggagatcaacaatctaatggggagaatggggttggcaatgcttatactattgagggtagagatgttactgatgcatgcactgaacaattggataatttggatataaaaagcgagaccgaggaaggtgtcagtgtcagtgcatcttttgtagatgatgagagcagtgagcaaagttgggccctgaggtccttgtccgaatcaactgtagcatgtg

SEQ ID NO: 4394 - DNA, 547 bp, Hordeum vulgare
gtaaaccttcatagatgttgcaaaactgtatagatagcagtggtatagataacactctggttttctcgttacatataatgtgagactacaatgccatggatgacaaaggaacaaaagggcaaacgggaacttagttcttcttgcgagaaaagtggttgtcattcggattccgcttcccgctgaacattgccagcgccttccttaccggaggtttcagctccaccttcttctcaccactgtgtgtgaatatgtcctcagcgcccaagaaatcatcccccagcttgcttgacttcttcgatttaggatgcagaaccttctgtggaagttggtcttcacgtaaaatggggttcttaatgacggcatctcttccaccttgaggcatcggaagtgaaaattttgtgcctcggagtgtaacacgcgggcgtcgtgaagccatagtaatcccattttcaccaactgttactgaaaccttacgcaaggtgccgccattgccacattttggacagaatattttaccaatctcttgggtcaccttgtagcaagcatg

SEQ ID NO: 4395 - DNA, 936 bp, Hordeum vulgare
  UNSURE (576),(583),(589)..(592),(657)..(660),(700),(750),(758),(761),(763),(766),(767),(847),(848),(856),(858),(860),(863),(882),(887),(898),(901),(902),(912)..(914): n stands for any base
gtcctcccgggcctgcaggcaattcggcacgagggcttcgagggacaatcaaggaccttaaggtggaaaagaatgagctccgagatgaaaagctgagcctgaaggcataaaaggaaaggctggaacaacaaatcaaagcagcaagcgctgctcctgtacgatttgctcctcacatgccttatccagctgcattccaccccgccgtcttccctacatttgcaccaccttatcaagttccagccaacaaaggcgctccggtccctgctgcattccctggaatggcgatgtggtactggatgcctccaaccgccatggacacaactcaagatccaaagctttggccgacaaatgcctaagcgtgccatctgcgggatgcatgctgacttacactgccattcgcccattggcaagtcagaaaggtagtcaggtccctgagatgaaaaggaagcacgcgactgcaggtactgagtttagcttgctgtgcggtcacttgtcccatagagaggtgatacctgtaattaatctggatcttgaccctcttgcttggaaaatatattcagtgctaccaaaaacaanaaaaggnaaaaannnnccctcggggggggccccggcccccaattccccttatgggggggcgatcaaaaattccaggggggnnnnccccccccccggggggggcgccaacaaacccgcgggaaanccccccgccccaaaaggcccccccccacaacgaccggggaaaaacccccnaaccaaanggngnccnnaaacccgacggaaaaaaaaacccccaaaaaaaaaccccccacaaaaacaacagcaggaaacccagcagaagagaagcacnnaaaaaaananancanacaccccccccacaacaanagcanaccccaacaanacnnaaaaaaaccnnnacagacaccaccttcccgcccc

SEQ ID NO: 4396 - DNA, 444 bp, Hordeum vulgare
acaagctaaacacagtaactgcaatcgcgtgcttccttttcatctcagggacctgacaaactttctgacttgccaatgggcgaatggcagtgtaagtcagcatgcatcccgcagatggcacgcctaggcatttggcggccaaagctttggatcttgagttgtgtccatggcggttggaggcaaccagtgccacatcgccattccagggaatgcagcagggaccggagcgcctttgttggctggaacttgataaggtggtgcaaatggagggaagacggcggagtggaatgcaactggataaggcatgtgaggagcaaatcctacaggagcagcacttgctgctttgatttgttgttccagcctttccttttctgccttcaggctcaacttttcatctcggagctcattcttttccaccttaaggtccttgattgtctctcgaag

SEQ ID NO: 4397 - DNA, 444 bp, Hordeum vulgare
ctcagccctctcaccatccctcccccctcccctccccagcagccagccagcctcgcccccgcgacgaaccctagccagccagccagccagccagccacggcggcggatccctcggggccacggccgccgagacgatggacggcggcgacccggtagaggaattcctcctcgggggcggcgccggcgacggcggggacggcctctccgccttctgcgacggaggacttgggattgaggatgtcagcggaggtgactctggtcttgggcaatctaatttggggaaaaggggcagagatgaacaatcttcatctggtccaaagtcaaaggcttgccgcgagaaaatgcggagggagaaactgaatgacaggtttcttgaattatgttctgttatgaattctggcaagcacggtggtcttgaagaatgttcggctagcaatcctggga

SEQ ID NO: 4398 - DNA, 425 bp, Hordeum vulgare
  UNSURE (424): n stands for any base
tttttttttttttttttaagaaacagaccagcgcaatgccatacataagactcatgcaagaggtatggtagcactgaatatattttccaagcaagagggtcaagatccagattaattacaggtatcacctctctatgggacaagtgaccccaaaacaacaagctaaacacagtaactgcaatcgcgagcgtgcttccttttcatctcagggacctgacaaactttctgacttgccaatgggcgaatggcagtgtaagtcagcatgcatcccgcagacggcacgcctaggcatttggcggccaaagctttggatcttgagttgtgtccatggcggttgggggcaaccagtgccacatcgccattccagggaatgcagcagggaccggagcgcctttgttggctggaacttgataaggtggtgcana

SEQ ID NO: 4399 - DNA, 550 bp, Hordeum vulgare
  UNSURE (20),(52),(92): n stands for any base
gtacccccgggccttgcagnaattcggcacgaaggcttttgtccgagtcggnggtgagccgccgtggttctgagccaaaatcaaaagcaagnaatatagaggacacagtggacaccgtggtgaagtggaagctctcatacgatagccatggcaatgtggtaagaaaggttcgcgttggtggtgaatttgattcaaattcagacagtggaagggatgacaaattggaacccaaatggagggctcagaataggtttagtccaagtgagaacaggggaggtggagcaggtctgaaatataggcctaatgccaacagtggcgagaggccaggaggatacaccaagggtcataatggtgatgaaaggggccaatttggtaacggctttccctcagacttggaggagccgacatggaaccccagaaaaaagaaggaagctaggaacagcaatggcagcagagattacaacggtgatacgaaaagtaggttcaggagtggtggaagtggggctgcgaggcggctagacagtactcgtcctgtgatgaacgccaacag

SEQ ID NO: 4400 - DNA, 533 bp, Hordeum vulgare
acagtacgttatatttaaacgtttggtcatacagtagttagcatacacgcagactacattagcttcactcttaacaaacagtacattttatctaagttctgatgttggtcggagcgagtatccgtctcctctgaactgccgtcccccattccggtcaaccgagcggtgcaattcggatgttggtcgcagcgagtatccatctcccctcggccgccgccctcctccatcttctctgttggcgttcatcacaggacgagtactgtctagccgcctcgcagccccacttccaccactcctgaacctacttttcgtatcaccgttgtaatctctgctgccattgctgttcctagcttccttcttttttctggggttccatgtcggctcctccaagtctgagggaaagccgttaccaaattggcccctttcatcaccattatgacccttggtgtatcctcctggcctctcgccactgttggcattaggcctatatttcagacctgctccacctcccctgttctcacttggactaaacc

SEQ ID NO: 4401 - DNA, 520 bp, Hordeum vulgare
gccccgacgtcatccacgccttcaagcccaacccaaagtcccacgtgcaggagtactggcgcgtcttcgacttcctctcccaccacccggagagcctccacaccttcttcttcctcttcgacgacgtcggcatccccaccgactaccgccacatggacggcttcggcgtcaacacctacaccttcgtctcccgcgccggcaagtcccactacgtcaagttccactggcgccccacctgcggcgtcagctgcctcatggacgacgaggccaccctcgttggcggcaagaaccacagccacgccacgcaggacctctacgactccatcgacgccggcaacttccccgagtggaagctcttcgtgcaggtcatcgaccccgacgaagaggaccgcttcgacttcgacccgctcgacgacaccaagacgtggccagaggacctcgtccccctccagcccgtgggccgcctcgtgctcgaccgcaacgtcgacaacttcttcaacgagaacgagcagctcgcctt

SEQ ID NO: 4402 - DNA, 557 bp, Hordeum vulgare
  UNSURE (22),(40),(70): n stands for any base
tagggtgataaacaataagggncgacttcgaaacggcagnaagccaaagggaataccagtggttcataangctcaaagcacacactttagtttaagctagagtacatgcagtttactgtaacaaaagatggtaacttattagtagcatggtagctaatcgaccacatgatccacagtagctggcatgcatggtcccttattgctggctggttcatgatatagcacaaagtttacacagaatggtccatccatcatccatggcagatacatccatcacatgcttggcttcacgttgaggcggttcgccaccttcatcccgcacgacttgtcacacttggagaggaagtcgatccagatgacacgcagctcgtggctgaccttggggtgcgcgagcgcgtcggcgaagcggcgcacgaacctgtcctggcggtcgggcgcccagctgcggtacctctccccgggctgcacgaagtcgttctccttcttgatcctcgtcttctccctcctccccaccacgggcctcgtcggcacggggaagctggccggctcggcttgcc

SEQ ID NO: 4403 - DNA, 519 bp, Hordeum vulgare
ggaaatgcatgaggatgaacatgaatgcaaaatggatgacgctaaaagcaaccagcaggttatttgccaggaggagggctgtaaaaaggctttcaagtatccttcacagctgaagaaacacgaggaaatgcatgccaaattggactatgtggaagtagtctgctgtgagcctggctgcttgaagacgttctcaaatgctgggtgcctgaaggctcataaccagtcttgccatctatatactcagtgtgatatttgtggggagaaacacctgaagaagaacattaaaaggcatctaagagctcatgctgaagtccactctactgaaaggttgaaatgcacttttgatggctgtgaatgcaccttctccaataaatcaaatctaaacaagcatatgaaggcgtgccatgaccaagtcagacctttcaagtgtcgagtcgtggggtgtggcaagacattccactacaagcatgtcagggacaatcatgagaagtccagttggcatgtatatgtagagggcga

SEQ ID NO: 4404 - DNA, 548 bp, Hordeum vulgare
gaaaattcctaagctttatttagttttcttggttaaaacgtgcacacatccagcaaattcgacaacaacttcgttccggccgcaacaccaagcaaccatccaaaacacaacacagatttatgatggctattacaacgactcaaatgtctatccccaaactagctactaccatataacacgactgattcacttactagtaccatatatacttgctaaatcagaactctgcatacatacacacaaacgtcgatttccacacaaccacaactgacttgagcagcaaacaccgtagagacccctatctatacatttgacaaccaccaaaacgtactgcaacaacatactaggagagacgcctactcggcgtggttcgaatcatccccgccagagagcaaccagcgcatgtaccccgccccgtcgtccagggaggaggcctcgctggggatggtcacccgcttgcgagtcagcgtctcgaccgtcacggccgccctcttccgcccgcctcttgggcgcgagcgcagctgctcgtccatctcctcatagtcgcc

SEQ ID NO: 4405 - DNA, 517 bp, Hordeum vulgare
cctcgtgccgaattcggcacgaggctgttaatttttcctcgaggccttggcattcagcggaggagactagtaaggcgatggatctcggagggctactccaagcagagtgtggaaagacacgcggaggagaatgctgacaatttcttctctgagctcgttgagctcaacatattccagcaggtacaacgtttgagcagcaccaacacaatacaagtttattatcaggtgaatagtttcattcgtgagtacatctcacggcgggtggaagagaaccttgtgtatgaactcagtagcgattgtgcaataaccacccaaagcagagggcgtcaccttatcatacagcaatgctggcacagagatagaattgtgttcgagagagcagacttctcacggctatggtcactcacagtatttgggaagtgggagcatttcttcatctccaagagtatgaagcttctccgggtacttgatctcgagaatacatttggtgtgaaggacgtcgatctcgagaagatgg

SEQ ID NO: 4406 - DNA, 550 bp, Hordeum vulgare
gatatgatttttttttctccggttggacgcacagtctgttttgctagttgaataaaagtaaagttaacacaaaccccaaaaggaaaaaatgatagaaaaaaggactggatcgagctagtccctcaagcaagcgtcacagtaggtttctctggatggttgagcagctggttctggaggtcggtcctgaacgcttcatcctcggtgccggtaagcaagacttccttgaccccaaacagatgattcaggccagaaaatttgtaccagggcaactggagaagtccagcttgaggtgctcaagactctgcatcgatttcgatccgaaggtcacgtgtaagccggtcgagctgccagatatctcgaggaccttcaccttctcgtaggcgaccgactcctctcctccacaattttcagcacaaaattggaggctggactgcttgacatgaagtcgcagaatacgaagcttcggcaacctagcaaggtgctccatgtcacttggcaacaaagcagccattcccaggtccagcttcgtgagcttgctataaggtccttg

SEQ ID NO: 4407 - DNA, 518 bp, Hordeum vulgare
cctcgtgccgaattcggcacgagggtggatatgtcaaagactacatggaagcaactgaaccatactttgcagtaggagagtactgggactctctcagttatacttatggtgagatggattataaccaggatgctcacaggcagagaattgttgactggataaacgctacaaatggaactgctggtgcatttgatgtcactactaagggaatacttcatatggcactggaaagatctgagtattggcgcttgtctgatgaaaaaggaaacccccctggagtattaggttggtggccttcacgtgcagtcacatttatagaaaatcatgacaccggctctactcagggtcattggagattcccctatggtatggagatgcaaggctatgtctatatcttgacgcatcctggcactcctgcagtcttctatgatcacatcttctcacacttacaacaagatattgccaaattgatttctatcagacagcgcctaaagattcagtgccgcagcaagatcaag

SEQ ID NO: 4408 - DNA, 553 bp, Hordeum vulgare
  UNSURE (29),(30),(56): n stands for any base
tgtaatgtaccttactgtaaatgcactgnntcttacatggatccgacagagtgggngtacctttgcaaataagcaggcaatttgccttcagaggtaacaatggttttgcagtagatacaaaaatgttcgcttgtgtacatataatttgacttcagtgaaagcgttgctgcagggaaaatgcttccactgccattgcaatcgccttttcttggcaccagcagtggctaagttagccactccattctgatgccatctcttcctacctagtatatgctattagcagtgcgacaaagtctagggcgttgcttcccagatcttgtaatcatgtccctctgctgcaacaatccagtttatgggaccgcttggttcaaaatgtccgctgccgatcttcatcattagattctcattaatctgggcggcatacaaattctgttctgccttgattatcttgatcttgctgcggcactgaatctttaggcgctgtctgatagaaatcaatttggcaatatcttgttgtaagtgtgagaagatgtgatcatagaagactgcagga

SEQ ID NO: 4409 - DNA, 545 bp, Hordeum vulgare
  UNSURE (4),(12): n stands for any base
gggnctgcaggnaattcggcacgaggggggcatttcctggcaaccaaggaagaaactttcatagcgtacatcgctgaacagacacctcaaccaaaaccagctttcgacgatatcgggtataggagaggaggctcttctgaagaagactgtaatagctggaggggacagggggattgggaagaggattggggtgaaacttactccagaaaggggagaccctcactgtttgttcttgatattgccagcggagaagtacgtgctgctagaggcattacaaaatcaatcagtgttggtcaggttgtttgggctccgccatcttcaagaggccatcaaaatcttttggtctttgtgggatggttagaacgcaacgggtttcagagcaccgctagaaaactcggcatcaagtactgttctaacaggccatgttctctctatgcgattcattccccttttgaagaagaaccaaatgctgaagacacatccgttagtaaatcatcatctgcttcagtggcaactaacttaaccccaatcataagcagcgcttt

SEQ ID NO: 4410 - DNA, 496 bp, Hordeum vulgare
gttaattcgtagatttcgttgattttgatcctgcaggctagaggcctactactccacaaacagaagccaaactcacattgcccaggctgcgtcaaccaataaccacagactgatgctgttcatttttatcaatctctttacgctcataatttgggagaaatatatactagttgtcgatcctcaaaatgcttcagtcgcctcacagaaagacaaaatcaccaagaagcttcgaagttctgtggctatgtcgaggaagctcccgaaactctctgggtcagatctgcttgagatgtttcctgaaccagactcccatgttgaggaagctctcgaagtccgaccgcggtatatcgatttcgtgcgtgtcctctgggaacatgatggttttgatctcgactcctctttctctcagagcccttgcgtactgtaggccattggaagcgggcacccgaagatccgctcccccgagaagcataagcaaaggcgctttcacttttga

SEQ ID NO: 4411 - DNA, 514 bp, Hordeum vulgare
  UNSURE (13),(514): n stands for any base
cagtccgtgtggntgagccacggcgacgaggtcgtcaggctgcccgaggggttcgaggtcgtcgcgcgcagcgtgcagggcgcaatcgccgccatcgagcaccgggagaagcgcttctatggcctccagtaccacccggaggtgacacattcgccccagggatggaaacgctgcgccactttctgtttgatgtttgtgggattaaagccgactggaagatgcaagatgtgctggatgaggaaatcaagaccatccagagtatggttgggcccgacgaacatgtgatttgcgcgttatcaggaggagttgattcaacagttgcagccactcttgttcataacgcgataggggataggctccactgtgtttttgtggacaacggtctattgagatacaaggagcaggaacgagttatgtcaaccttcaatagcgacctgcaccttcctgtcacatgtattgatgcctcggagaaatttcttagcgagttaaaaggagtcaaagacccagagacgan

SEQ ID NO: 4412 - DNA, 507 bp, Hordeum vulgare
ccatatttttctaagcataacctacagataaataactgaactgcaaatttagcactaatcccactgcagcgttgcaacagcatcagagcatgatttttgcaattcccagcccgttattgcaccatcaaatcaccaccatcctattcccactccaccgtcgctggtggcttcgatgttacgtccaggacaacacggttgacgccccgcacgttattgcagatcttcttcaccacatcaaccaggaactggcgctcaaaatcataccaatttgcagtcatgccatcctcactggtaattgcccttaaagcaaccacatgggagtgagttctctggtcgccctggaccccaactgtttggacaggcaaaaacacagcaaaagcttgccaaatttcatcatacaggcctgcatctttaatggcttgaataaatatctcatccacctgacgaagaacctccaaagcattgcctgctgttacatcgcctatgacacgtacagcaagaccaggc

SEQ ID NO: 4413 - DNA, 544 bp, Hordeum vulgare
  UNSURE (3): n stands for any base
ggnctgcaggcaattcggcacgagggtcaacccctccggcaacttcgacctctccctctccgaccaagacgacgcaccacaagttgagcctcctccaccacctactgaagggcgcatcgagatcgtcatcaacaaggatatcatccgaacacttgacctatcgcctgtccaagaagcccttggcaacctgaattccttaacgacagctcaatcaagaaatctgttggacagaaccgtcggcttcacaataaactacgagagagaggatccatacgacacgcgggagctgtccgagttccccgacgtaaggctgtggtttgtgaggctcgatgcctcctacccctggttcccggttgtgcttgactggagagccggtgagctcgccaggtatgccgcaatgctggtccctcaccagatgagcatgcgtcacggcgtagtcttcaacccagaggcgttggagctgtttgggatgaagaaagtgttcgtcgtctactcgtggctgaagcagcagaaccatgccaagcccaggttgaagacgggcgac

SEQ ID NO: 4414 - DNA, 565 bp, Hordeum vulgare
  UNSURE (8),(9),(32),(33),(41),(43),(44),(62),(63): n stands for any base
tttttggnnaaggggtactactatatatatgnncgcaactnannctgtgccattgtatgggnntatctattcttcaccaaatgtttcggcatgaagatctagagttcatcaacaggatacttctcgatcaaatcgaacaactcgtctccgatgccgaagccaagcatcttggccatgtcgcccgtcttcaacctgggcttggcatggttctgctgcttcagccacgagtagacgacgaacactttcttcatcccaaacagctccaacgcctctgggttgaagactacgccgtgacgcatgctcatctggtgagggaccagcattgcggcatacctggcgagctcaccggctctccagtcaagcacaaccgggaaccaggggtaggaggcatcgagcctcacaaaccacagccttacgtcggggaactcggacagctcccgcgtgtcgtatggatcctctctctcgtagtttattgtgaagccgacggttctgtccaacagatttcttgattgagctgtcgttaaggaattcaggttgccaagggcttcttggacaggcgataggt

SEQ ID NO: 4415 - DNA, 552 bp, Hordeum vulgare
  UNSURE (20): n stands for any base
gtacccccgggcctgcaggnaattcggcacgaggcgagctccttccttgtcgcggcaggaagtttccaggaaaatcaacttcatggatggtggggctgaaggtctactggtcatgccgttcgacttattacgagaagttactaatgatttctctcaggagcggaaacttggtagcggttcgtttgggaaggtttacaagggagtgcatcaagacggtgtaaagattgctgtgaagatgctctatgatatgccagggctcgatgatgagctatttcagaacgagtttaaaaaccttacaaggctcagacaccaaaatattgtgcggttagttggctattgccatgatattcaggtagtacaagtaatgcacgaaggaaaattggttctcgctgaaaagacacatagggcactctgcttggagtatatgtctaatggaagccttgacaagtacctttctggtaatgatctccttactaccgctcaatctggcttcggatggaggtagaattcgtggtcaaaaggcactaggcctgcacctgggtggcgaggtac

SEQ ID NO: 4416 - DNA, 545 bp, Hordeum vulgare
gttagaacacaataataagatcttattttctggaaaatatactctctcaaacccatagactactcccaaacccaaagtagaaaagacctacaaaagaggcatatctactacaaaacatccgaccttcatgtcaattctcatgaaagttttcctatatccgtcaaatgacttgggagaagctcgccagtagcatattccgttcaagaacttctctttgatgtatcaccttgatttcaagaatgtcctcttcgcccccaagagggaccatttgacctccttgagagtggaaagaagttttggtgttgtaatttccatgcaataaaagcctcactccaatatgaggaaccataaacttatggttttctctctcaaggtaaagatgaaggtttcggcgcatggattcaagaagatgtatacttaaactggaagcacttgcaaaacctccttcagtatcttccttgtatcgttatgtagcatgactctctactttattagccaaacataactgctggaattggctgaaaagcgagcgaaaaaatagacca

SEQ ID NO: 4417 - DNA, 329 bp, Hordeum vulgare
gggcctgcaggcaattcggcacgagggcatgtcgggggagatgcagctgtgcgacatggacgcgcggttcatcagctgggacggcgtccacttcacggagttcgccaacgccatcgtcgcgtccaagctgctcaccggcgaatactccaagcccagggtcaggatcgccagcctcgtcaactccaccgcgcctcacgatggctagccctccatcgatcgtcgtctatctggatctgccggtgccattgatttgatttggttggcctaccactgccagagatgatgagaatgtgtgcatgctgcagcaaatcagtgagtgggctgagagc

SEQ ID NO: 4418 - DNA, 387 bp, Hordeum vulgare
gtatcttagttggcaactcggataaacatatacaagaagagaactgtgcaccccatcaattccttgatcaaatttcaaagcgaattacacacacgtcagtcaaatgtgccttgctttaggtcgtccatgaattttccctcttggtcaactcactactttctctccttcactcatctgagccttgagaaaagagacactcctagatgtttgctctcagcccactcactgatttgctgcagcatgcacacattctcatcatctctggcagtggtaggccaaccaaatcaaatcaatggcaccggcagatccagatagacgacgatcgatggagggctagccatcgtgaggcgcggtggagttgacgaggctggcgatcctgaccctggg

SEQ ID NO: 4419 - DNA, 527 bp, Hordeum vulgare
gccgacgggcgacttcgccatcaccgacgccaacggcgccgtggtgctcaaggtcaagggcgccatcttcagcatccggagccgccgcaccatcctcgacggcgccgggatgcccctcctcaccatgcaagaaaaggcgttcagtatgcaccaccgttggcaagtgttcagaggggacagcacgaacgcaggcgacctgctcttcaccgtgaagacaacttcgctgatccaattcaagaccgagatggatgtcttcttggccgggaacaccgcgcagcaagtctgtgacttcaagatcaagggcagctacttcgacaggtcctgcgtcttctaccttggcgactccaacaacatggtagcccaaatgagccgtaagctgactgtttcaaatgtgctgctcgggagggacacgttcagtgtcaccgtgttcccgcacgtcgactacgtgttcatcgcgagccttgttgtgatcctggatgaggttcacagggacaagcgcgacgaatgatgagtcggtttgataagct

SEQ ID NO: 4420 - DNA, 559 bp, Hordeum vulgare
ggtgcgtaaacatttattcaccaatataccaattcggcatggattaccatgctagcatacaagaaatgcagataacaccagtaacaagcagtgacaacacatcagctttagatgacacgacccctgtacgtagtactgcgagaacactcaggatccaggagcttatcaaaccgactcatcattcgtcgcgcttgtccctgtgaacctcatccaggatcacaacaaggctcgcgatgaacacgtagtcgacgtgcgggaacacggtgacactgaacgtgtccctcccgagcagcacatttgaaacagtcagcttacggctcatttgggctaccatgttgttggagtcgccaaggtagaagacgcaggacctgtcgaagtagctgcccttgatcttgaagtcacagacttgctgcgcggtgttcccggccaagaagacatccatctcggtcttgaattggatcagcgaagttgtcttcacggtgaagagcaggtcgcctgcgttcgtgctgtcccctctgaacacttgccaacggtggtgcatactgaacgccttttcttg

SEQ ID NO: 4421 - DNA, 530 bp, Hordeum vulgare
  UNSURE (7),(17),(27): n stands for any base
ggcacgnagggttttgnatttccaggnaaagcctaacgaatgttcaagcattgctgcatcagcatccgacaagtagacgaggcttattgaccactgttgatcacctcaagcgcctctgcatcgatcactatttccaagacgagatcgacaccatcatgggctcgtgtacagacctcatccatagcaatgatctgcttgacgcaaccctttccctgaggctgatgcgagaagctggatattatgtttcggcagacgatgtgcttcggaagttcaaaaatgataatggtgaattcaacattgggctcagcaaagacattagagggttgctcagcttgcaagacatgtcgcacctcaatgtgggagaatcatcactctacaaggcaaatgaattctcaagcaagcatcttagaaacgcaattaaatacttggagccgaaccttggaagatatgtgaggcgctcacttgaccacccctatcatgtgagccagatgcaatacaaagcaaggcaccatctaagctacctccagaac

SEQ ID NO: 4422 - DNA, 555 bp, Hordeum vulgare
tggagcagcaggcaattcctgactttttcatgtatgtttatcatcttatcacgtgaagcacatatgctaattgcgcacgatgtaagtcaacatcgtacgtgaaaaccctaccaaaaactaatgcactgcattttatatacaatattatatgatagaatgcatgatttagaagagcaacatctttgtatagtcctcaaggacggggagcttctgctcgttgtcgtagccatacatgacgcggaccattctcgcaaagtttagtgatgctgtgatgaagctatgcgatagtgttgactttgtcccacagaagcataccctgttaagaccctcccattcactcccgatcatctcaagcatgtgcttctttgcatcaccacgaggattttctctttggtacaactccttgtatgatccatctagcccattttgtgattcatcctttgcagtacccatgtcgtcccaaagcctcatgatttttgcagggtaggagatgactcgatggatgtcgtcattcttgccctcgtttaattcatgtcccaacatgaagaaaagatg

SEQ ID NO: 4423 - DNA, 502 bp, Hordeum vulgare
ctcctcgccaccggcaagctctccggcatcgtcggcgtgcccacctccaagcgcaccttcgagcaggccatgtcgctcggcatccccctctccaccctcgacgaccaccccgtcatcgacctcgccatcgacggcgccgacgaggtcgacccagatcttaacctcgtcaaagggcggggaggagcccttctccgggagaagatggtggaagcagcatcaggaaaattcgtcgtcgtcgtcgacgagacgaagctagttaccggcctgggcggcagcggtctcgccatgccggtggaggttgtgcagttctgctggaagcacaatcaagtaaggctgcagggcctgttcaacgaggaaggttgcgaggcgaagctgaggctgaatgaggacggcaagccctacgttaccgacaactcgaactacattgtcgatttgtactttaagacgccgatcagggacgcggtgggcgcgggcatggagattgcggccttggagggagttg

SEQ ID NO: 4424 - DNA, 460 bp, Hordeum vulgare
tccttttttcacgatgcctgtattgaaaatgaacttactttaccaacacatgacacaggtagctgacccccccaaaaaaaaactcactttgttttgacactgacaccgtccgatccagcaatgatgactgaagttgccatgttcaagaacaagccatgctcgacaactccctccaaggccgcaatctccatgcccgcgcccaccgcgtccctgatcggcgtcttaaagtacaaatcgacaatgtagttcgagttgtcggtaacgtagggcttgccgtcctcattcagcctcagcttcgcctcgcaaccttcctcgttgaacaggccctgcagccttacttgattgtgcttccagcagaactgcacaacctccaccggcatggcgagaccgctgccgcccaggccggtaactagcttcgtctcgtcgacgacgacgacgaattttcctgatgctgcttcca

SEQ ID NO: 4425 - DNA, 521 bp, Hordeum vulgare
catttgcaaaccatcatccatcctagggtcccggtagctatagctgcttactttaaacaaggaagaagaagcagcggcagctcaacaagagttcaggagagggacatggcgtcgatgatgggaggagacttcgtggaggcctacgtgctcaagaacgcatacaaggagaagatgaggcgcatggaccaagccgaagcgggggcgctcgacggcgcgaagaacggcaaggaggccgccggcgccgccggagagaagaaggctgctggtggtggtggtgcgagcagcaggggaggcttctttggcctcatgaagaagaaggtgcaccccaaacccaaagaaccggcggcggcggctacttcctcttgattgtattacagtactgtatttgccatgccacgaagttgtaagacgcagcttttctttctagctaggagcgtgtgtgtgtgtgtgtgtgttcttccgaatcggaggagtgtgtaaagcaacttcttttgttgattggtcaaacaaagttgacgaaa

SEQ ID NO: 4426 - DNA, 530 bp, Hordeum vulgare
  UNSURE (14): n stands for any base
ttaaatttttcgtncaacttttgtttgacaccatcacaaaagaagttgctttacacactcctccgattcggaagaacacacacacacacacacacgctcctagctagaaagaaaagctgcgtcttacaacttcgtggcatggcaaatacagtactgtaatacaatcaagaggaagtagccgccgccgccggttctttgggtttggggtgcaccttcttcttcatgaggccaaagaagcctcccctgctgctcgcaccaccaccaccagcagccttcttctctccggcggcgccggcggcctccttgccgttcttcgcgccgtcgagcgcccccgcttcggcttggtccatgcgcctcatcttctccttgtatgcgttcttgagcacgtaggcctccacgaagtctcctcccatcatcgacgccatgtccctctcctgaactcttgttgagctgccgctgcttcttcttccttgtttaaagtaagcagctatagctaccgggaccctaggatggatgatggtttgcaaatg

SEQ ID NO: 4427 - DNA, 518 bp, Hordeum vulgare
  UNSURE (4),(10),(11),(35),(77): n stands for any base
tggnacttgnnttattctggcctccgacaacatgnacgagcacactgaggtgtatttcagagtctacaagtcacagngaaaagtacatggcactcatgtgctctgacctaagaaggtcttccctgagaccaggactggagaaaccagcctatggaggcttctttgaatttgatcttgcaaaggaaaggaagatatcactcagaaccctgattgaccggtcggcggtggagagcttcggcggcgggggtagggtttgcatcacatccagagtttatccggcggtgctcgccgacgtcggcagggcccacatttacgccttcaacaacggaagtgccatggtcagggtgccacagctcagcgcatggaccatgaggaaggcacaagtgaatgtggagaagggttggagtgctatttaaagcagaggagcaattcgattttctcgattcttttactatcattcatgagcattgcctggcagaaataaggacattcagcaggaaaaaatagcctgtcatttc

SEQ ID NO: 4428 - DNA, 524 bp, Hordeum vulgare
attcttatgtgtgactaaagtactcatcccgtgaattttatgactagtgtgcgtttctataaaaattggtacaagtaattgaattggtacaagtaattgagatgggaagggcttactaagtagtaactacaatatatgaatactagagatcatcaaagaaatgacaggctattttttcctgctgaatgtccttatttctgccaggcaatgctcatgaatgatagtaaaagaatcgagaaaatcgaattgctcctctgctttaaatagcactccaacccttctccacattcacttgtgccttcctcatggtccatgcgctgagctgtggcaccctgaccatggcacttccgttgttgaaggcgtaaatgtgggccctgccgacgtcggcgagcaccgccggataaactctggatgtgatgcaaaccctacccccgccgccgaagctctccaccgccgaccggtcaatcagggttctgagtgatatcttcctttcctttgcaagatcaaattcaaagaagcctcca

SEQ ID NO: 4429 - DNA, 550 bp, Hordeum vulgare
  UNSURE (20): n stands for any base
gtacccccgggtctgcaggnaattcggcacgagggcctgcctttactcttcggagaccgacttatggggtgatctcgtctcaacaccggttcctaccaaggtgtccacctcggacattttgagtgatgaagttgatgccaccttggtgacatcgggaaagcccgctgtgatggttaaggattctctttactggattcttgttgggaattttgttggaattcttgagtttgatttggagaagcaaagcctagctgtgatatggctgccagtgcatattcttgaaaatgggtattattaccagttctggattatgcgggcagagggtggtggtcttggtttactattgcagaaagatcagagcttccagttatggaagaggaagactgattgtgatgatgttgcttcatgggttcttggaagaactattgaactgaacaatctactttccctgaatggaaatcgtatccaattcatactagggttcgctgaggagaataatgtggtgtttgtgtggacacacggcgtcgtctttatggtccatcttcagtct

SEQ ID NO: 4430 - DNA, 549 bp, Hordeum vulgare
ccgtaaatcccgtgttttagaattatcggaaagggccccaaggccttggaatctgcattacataatgatggtggtgatacaagttacatagaggtgttaaaaaaattacagtacatccccatagaatttactagaaggcctgtaacataaaaagtgagaaaagcaatcagatcctgcaccaccagtcttgcattgaagctcgacaacacggacgacctcattgctccgataaacagcaccccgcgggcctgcagtgtagacaccttcgaatggatgatagcaagaaaggcttctggtctcaccaagtttcttgaactgcaaagactgaagatggaccataaagacgacgccgtgtgtccacacaaacaccacattattctcctcagcgaaccctagtatgaattggatacgatttccattcagggaaagtagattgttcagttcaatagttcttccaagaacccatgaagcaacatcatcacaatcagtcttcctcttccataactggaagctctgatctttctgcaatagtaaaccaagaccaccacc

SEQ ID NO: 4431 - DNA, 549 bp, Hordeum vulgare
gtacccccgggcctgcaggaaattcggcacgaggcgaaaggttgtctgctaataggttccttccctagacgactacctatcgaacggcgtggtcactacaggaggaccacttgcacttgtgcatctcttttccatgctaggacatgatccaacaagggatgctacaaacctcacggccggctgcatccctccgataatctcctgcccgtcaaagatcttgagactttgggatgacatgggcagtgccaaggacgaagcgcaagatggcctggacggatcatacaaggagttgtacctaaaagagaaccccggtggcaacgcggaggggcacatgcgggcgctgatcgggagtgagtgggaggagctcaacagagagtgcttctccaggcgggccttcccgcccagcatgacccggatctctctgaacctcgcgaggatggtgagggtcctgtttgactacggagaagggcagacgctccccgtccttgaggagtacataaggatgctcctgttatgaatcatgcccacacaccgaggaatctagaggat

SEQ ID NO: 4432 - DNA, 549 bp, Hordeum vulgare
gtttaatctgatgtccttcctatccgtgagagtaggcactagttgggaagatcataaaatttccacttcaccactatttaaaaaaaaaatgtagtcaatgttagaaaagtttgactgcgccattctacgaagcatattctgcagaatcctcaagcaggattttcgtgggaaaaccccagctttgctctggttctgtcatcctctagattcctcggtgtgtgggcatgattcataacaggagcatccttatgtactcctcaaggacggggagcgtctgcccttctccgtagtcaaacaggaccctcaccatcctcgcgaggttcagagagatccgggtcatgctgggcgggaaggcccgcctggagaagcactctctgttgagctcctcccactcactcccgatcagcgcccgcatgtgcccctccgcgttgccaccggggttctcttttaggtacaactccttgtatgatccgtccaggccatcttgcgcttcgtccttggcactgcccatgtcatcccaaagtctcaagatctttgacgggcaggaga

SEQ ID NO: 4433 - DNA, 518 bp, Hordeum vulgare
gaaccagccgcgccccccgtcgaaaacctagggttccgccctcccccgccccctccgaagtttggggaagatctgtttatacagcaacaccaacatgaggccaattttctgcgggaaccttgactatgatgcccgccaatctgaagtcgagcgtctttttggcaaatatggaagagtggagcgagttgacatgaagacaggtatgaactctttgtgtccattctctagatttaagttgtcctttttaccatctgattttatgttgcacctatttggtggtgtcggtcattaaggcaacaaactcttctaagaaataaacttacaagtgtaatgcttgagtaaactgctatttactcaaaagggatattaatgtgcacaaatacattagctccatacaagtcttccaagggaatggagtgaatggtgtgctcagttagctttaacaagattgggtgggtgccaagtggaaacagccgtcctcgttgctgcaaagactgccatcgcttcttcaaccatcc

SEQ ID NO: 4434 - DNA, 532 bp, Hordeum vulgare
aaagctagaatactgctgtcggtcgatacacggtacatctcatcgctccgcaaatggtctcaccggaagaatccctttgcacaaagttcaagctaacaatcacagttcaaactaaatcgacaaagcattcagctagagctagctaatagagagatattacagaagttcctggctgcctaacataaccaacttgagcgaacatcgcactaggacggtgcatccatttggtccgaagcacccaggattgagcgcagccatccatggtacagcttcagtccctatcttcccttgcaggcgagcggctgcggcgcctgtcataggcaggactggcttcacggcgttcacggtcatacttggggctagccctgtcatcccctttgccgccgtacgggcttccaccacggacatagtcaggactatctctggcaccgcccttgccatagtccgggctgcccctctccctgcccctgccatagtctgggctgcccctttcccgccctctgccataaggacttgccgacctaccacgatt

SEQ ID NO: 4435 - DNA, 518 bp, Hordeum vulgare
gaagaagtagcgtaagatcaccttgaggttagggtacaagttccttccatctcacccaagaacaacaggttaagaaatcagcctctttctcggatttttttgctgattcctaggggaaatggccttgaggaggatcgtcaaggagctcaaggacctgcagagggaccccccgacctcctgtagcgcagggccggtgtcgtcgaacgacatgttccactggcaggcgacgatcatggggccgagcgacagcccctactcgggcggcgtgttcctggtgaccatccacttcccgccggactacccgttcaagccacccaaggtggccttcaagaccaaggttttccaccccaacatcaacagcaacggcaacatctgcctcgacatcctcaaggaccagtggagccccgccctcaccatatccaaggttctgctgtcgatatgctcgctgctgacggacccgaacccggacgacccgctggtgccggagatcgcgcacatgtgcaaggccgaccggacca

SEQ ID NO: 4436 - DNA, 545 bp, Hordeum vulgare
aagtttcattgattatttattcgtccgcacatcataagcactttccacatctttgagctcgatcgagctgcagctcttatttagttatatctaccccatggcgtacttgtgcgtccagcccctggccgtggactcgtacctggtccggtcggccttgcacatgtgcgcgatctccggcaccagcgggtcgtccgggttcgggtccgtcagcagcgagcatatcgacagcagaaccttggatatggtgagggcggggctccactggtccttgaggatgtcgaggcagatgttgccgttgctgttgatgttggggtggaaaaccttggtcttgaaggccaccttgggtggcttgaacgggtagtccggcgggaagtggatggtcaccaggaacacgccgcccgagtaggggctgtcgctcggccccatgatcgtcgcctgccagtggaacatgtcgttcgacgacaccggccctgcgctacaggaggtcggggggtccctctgcaggtccttgagctccttgacgatcctcctcaaggccatttccc

SEQ ID NO: 4437 - DNA, 494 bp, Hordeum vulgare
aaacaaccgttagtgacgaagacatggaatctcctaaatgggagtatggtgtatcatgcccatactgcttttccacgagatctgaggaggagaaggaaagggcaagggctcggcaccggcagtttaagacatggggagttattggcggtcctgataaaggcaggagtccaaaaaggctcgaagcgagcaatggagttaaggaggacaaacagccgcacaacttagtataacttaaactggcaattgtattttgttatacttctggattattgaaatgccctcgacgaactgacattgtatcgatctgtagtgtttttgtctggctactactttgatcaggctgttacttcttggtcgctgatctagactgcaggtacatcactatcactagtgtcttactcagagcttagaagttgatttatagggggctgatgtttgtactccatctatccgtaaattgtaacatcggttactcgtacgaaaaaaaaaaaaaa

SEQ ID NO: 4438 - DNA, 482 bp, Hordeum vulgare
gtacgagtaacccgatgttacaatttacggatagatggagtacaaacattcagccccctataaatcaacttctaagctctgagtaagacactagtgatagtgatgtacctgcagtctagatcagcgaccaagaagtaacagcctgatcaaagtagtagccagacaaaaacactacagatcgatacaatgtcagttcgtcgagggcatttcaataatccagaagtataacaaaatacaattgccagtttaagttatactaagttgtgcggctgtttgtcctccttaactccattgctcgcttcgagcctttttggactcctgcctttatcaggaccgccaataactccccatgtcttaaactgccggtgccgagcccttgccctttccttctcctcctcagatctcgtggaaaagcagtatgggcatgatacaccatactcccatttaggagattccatgtcttcgtcactaactggttgttt

SEQ ID NO: 4439 - DNA, 370 bp, Hordeum vulgare
cgtcgacccgcacttcgacgtgatcgcgaggcagtaccatgagatcgtgaagaaactggagggcatgcagtggacgatccaccaggtggagatggatctgaagccagcctcatcatgatcacgcgcacgaaggcaggtgcctgaagcacgccgtccgcctccgcctcttgtttttttcccctttttcttcacttgtgtatgtgtatgtatatgcttggcgtttttttcttgtcttccggacgttgaggaaacctgatgcatgcatggatcgaggggcatggtcttgtcaccagagcttcgtatcgagcttccgtcagggaagcatctctgtacgtaccatgcgtatgctggcagttgagtcgagtacagt

SEQ ID NO: 4440 - DNA, 43 bp, Hordeum vulgare
ttttttttttttttttttttttttttttttttttttttttttt

SEQ ID NO: 4441 - DNA, 568 bp, Hordeum vulgare
gcctcgtgccgaattcggcacgagggcaggatattgcctcacatggatgttttagccttgggatgattgctcgatttgaacctgtgctggatgacaaaggtgaatggatgtatcctcgtttattctgggagactggtgttcttggtcaagttctctaccttgaggcgcatgctgtagggatatctgccacggggattggttgctactttgatgatgctgttcatgaggtgcttggtttgaaagacctggagttccaaagcttgtaccattttacggtgggcgcccctgtggttgacaaccggatcatgagtctccctgcatacccagggccagggattgatgcatgattcctatttcctgggtccagcctggagcgactgacgatatatgccaacatctgaattcctgacctggatgaaaccaggagtactgtacagttcgtgttcttgtatgacaaagcaacggggtgaaggaaccttatgacggcaacacaagtctatttggatatttgtgcatgatcagatcgtgggtatgttatctatagtcatgcgagaatatatgagaaaca

SEQ ID NO: 4442 - DNA, 641 bp, Hordeum vulgare
cagttgttgcaaccctggctttacaattcggaaataaaccttctttccttccctactgggattctcacacaagacttacatcagaaaggtcataaacattacacttctatgaatatcatcccaatgggcaagcaggtgacctgaaatcttgaatttagatatcaatatggatttgccctgtgcatcaatatccacatctactttgagtttccagagccaaaatcgtgttgcccgtcccaggagaagcccacccttgttacctacgagccaaaaatcggctgccaaccaagcacgccttctatatatctccgagcaccccttttgtttctcatatattctcgcatgactatagataacataccacgatctgatcatgcacaaatatccaaatagacttgtgttgccgtcataaggttccttcaccccgttgctttgtcatacaagaacacgaactgtacagtactcctggtttcatccaggtcaggaattcagatgttggcatatatcgtcagtcgctccaggctggacccaggaaataggaatcatgcatcaatccctggccctgggtatgcagggagactcatgatcccggttgtcaaccacaggggcgcccaccgtaaaatggtacaagctttggactc

SEQ ID NO: 4443 - DNA, 541 bp, Hordeum vulgare
  UNSURE (4): n stands for any base
gggnctgcaggcaattcggcacgaggcctcgtgccgaattcggcacgaggccgcaaggaacaccaatggcgccgccgtccctcttcctcctcctgctgccgctcctcgccgtggcggccgaggccgtccctcacacgctgacgcagccgtccaactccaaccccgcggcagcaggcggcggtgctcccccgaccccgacgccgtggccggagcagttccacgcggtgatgttcaccaacctgaccgagagcggcggccgcctgcagctcatcgacctctactacgactggccccgcggccgtaacctgaacctcatccgcagccagctctccggcgacccgacctacgacgtggagtggaccaacggcacctcctacatcttcgactccgcgtcctgccgcaccatacggttacccgtcggcgtcctgcccccggactggctccacggcgccgtctacctcggccgcgagaccaccgacggcttcgactgccacctctggaccaaggtcgatttcgtctggtactacgaggacgtcctcac

SEQ ID NO: 4444 - DNA, 548 bp, Hordeum vulgare
tttttgtattgttacactgcacactatggaaaccgctccacgcttgatttgttacacaatacaagagtagcatgaaatggaaagaccaccggtgtgaatccaactctactttttaagctgcagatgttacagccgctgcaggcgtccgtgcgaacctgaggaggctgctcgtcgcatcggttccggtggcggcgtcgtcgtcgtcgtcgtcgtcagcgaagcagtgcgagggtgcctgccactgggagtcctctagcacccctcccacctcgaagctcatcacatgctgctgcatcccattgaagaagttccagcggacggggcggtgggtgaggacgtcctcgtagtaccagacgaaatcgaccttggtccagaggtggcagtcgaagccgtcggtggtctcgcggccgaggtagacggcgccgtggagccagtccgggggcaggacgccgacgggtaaccgtatggtgcggcaggacgcggagtcgaagatgtaggaggtgccgttggtccactccacgtcgtaggtcgggtcgccggagagctgg

SEQ ID NO: 4445 - DNA, 530 bp, Hordeum vulgare
gggactgcaggcaattcggcacgagggggaaatcccaatccgcgcacccgaattcccaatcccccccaaaaccctagccccgatcccgatcccgatcccggcgagtgagatggccaacccgaaggtgttcttcgacatgacggtgggcggcgccccggccggccgcatcgtgatggagctgtacaaggacgcggtgccgaggacggtggagaacttccgcgcgctctgcaccggcgagaagggcgtcggcaagagcggcaagccgctgcactacaagggcagctcgttccaccgcgtcatccccgacttcatgtgccagggcggcgacttcaccaggggcaacggcaccggcggcgagtccatctacggcgagaagttcgccgacgagaagttcgtccacaagcacaccaagccagggatcctctccatggccaacgccgggcccaacaccaacggctcccagttcttcatctgcaccgtcccctgcaattggctcgacggcaagcacgtggtcttcggcgaggtcgtcg

SEQ ID NO: 4446 - DNA, 567 bp, Hordeum vulgare
  UNSURE (17),(21),(24),(33),(38),(43),(49),(50): n stands for any base
ggcataattatactagncggnagnttcattctncattncattncaaacnnggtaacagacaaggggaagataaccatggcggccggacgcagatccagcagcctaaagagtccacctaaaaccctcctaaaccaaccacggagatctcatcggacggacaggggcaagacacgacacgacttcttatttagaccgacgacacgacaggggacacatggcacgacgacgacgacgacgggcgagcgcgacgggcggacggacctagagctggccgcagtcggcgatgacgacctgcttggagcagatgccgctgcgggagcccaccttctcgatgttcttgacgacgtccatgccctcgacgacctcgccgaagaccacgtgcttgccgtcgagccaattgcaggggacggtgcagatgaagaactgggagccgttggtgttgggcccggcgttggccatggagaggatccctggcttggtgtgcttgtggacgaacttctcgtcggcgaacttctcgccgtagatggactcgccgccggtgccgttgcccctggtgaagtcgccgcc

SEQ ID NO: 4447 - DNA, 550 bp, Hordeum vulgare
  UNSURE (20): n stands for any base
gtacccccgggtctgcaggnaattcggcacgaggagattttgaagaagggtaccagctggtgctctcgatgttgaagagggatcttgtgcccgatgatgaatgctacattgccatcgtagaggggttttcgcagaaaggaaggatgaagattgcatgggaggtccttcacaggatgctgaacagtggcctccggcctagcacaagcacgttccactctgttcttttaggacttttgaaaaaagaaggttgtgcaaaagaagctgcagatttgattgagataatgctagagaggaagatccgccagaatttggatctttcgaccaatacgattgacgcattgttcaaaagcagcctaaatgaccgtgcctacaaagtcatcacatccctatatgaccaaggctattacatcaagatggaaaaactaatcggggacctctgcgaggaaaagaagttcatagaggcagccgagcttaccttgtttagcttgcagaagcatcatgatttgggtgtgtcaatatccagtacggttctggatggcctttgcacaac

SEQ ID NO: 4448 - DNA, 549 bp, Hordeum vulgare
tgttcacttttgagactttatttaccgaatagatgacgataaatcaaagttgtacaatctttaccggtaacatctaatgcaactaaacaaaataacttgtgatctcagataatgagcattgcaatcgtagttttctgtaaactcctgtttctgcctagaaaaaaaagaacttacatctcggcattgaaagcaagttcccaaacattcttgtgaatgactctaatataaactcgtgctgctgcgcgcaagctgttcgacaaaatagaggcatggtttcctctttgagattcctgttgatgtcgaacaaggctgggccgtcagcctagcttacacacacatccatgcttagcaccataactgcacgggcagaatcttgcaacgacaggggtacttccctcccgtaagataaaagaaagccatggatgaggacttgcacactacaaagaactgtgtactgcattgtttctggcaatgcctctccatttcgtggcaaatgtgcctgacagccattactttaaactcaccaagtcaccatggctcatatggacc

SEQ ID NO: 4449 - DNA, 529 bp, Hordeum vulgare
  UNSURE (6): n stands for any base
gcacgnagggctctccggcatcgtcggcgtgcccacctccaagcgcaccttcgagcaggccatgtcgctcggcatccccctctccaccctcgacgaccaccccgtcatcgacctcgccatcgacggcgccgacgaggtcgacccagatcttaaccttgtgaaagggcggggaggagcccttctccgggagaagatggtggaagcagcatcaggaaaattcgtcgtcgtcgtcgacgagacgaagctagttaccggcctgggcggcagcggtctcgccatgccggtggaggttgtgcagttctgctggaagcacaatcaagtaaggctgcagggcctgttcaacgaggaaggttgcgaggcgaagctgaggctgaatgaggacggcaagccctacgttaccgacaactcgaactacattgtcgatttgtacttcaagacgcccatcagggacgcggtgggcgcgggcatggagattgcggccttggagggagttgtcgagcatggcttgttcttgaacatggcaacttca

SEQ ID NO: 4450 - DNA, 471 bp, Hordeum vulgare
tagaagaacatttttccttcttttacacagatagcctgttcattgaaaaatcgtaaacttacctttacccaacacatgaacaacaggtagctgaccccccaaaaaaaaactcactttgttttgacactgacaccctccgatccagcaatgatgactgaagttgccatgttcaagaacaagccatgctcgacaactccctccaaggccgcaatctccatgcccgcgcccaccgcgtccctgatgggcgtcttgaagtacaaatcgacaatgtagttcgagttgtcggtaacgtagggcttgccgtcctcattcagcctcagcttcgcctcgcaaccttcctcgttgaacaggccctgcagccttacttgattgtgcttccagcagaactgcacaacctccaccggcatggcgagaccgctgccgcccaggccggtaactagcttcgtctcgtcgacgacgacgacgaatttt

SEQ ID NO: 4451 - DNA, 830 bp, Hordeum vulgare
  UNSURE (1),(16),(17),(24)..(29),(37),(45)..(48),(58),(60),(64)..(71),(110)..(119),(133),(143),(144),(146)..(148),(160)..(179),(181)..(198),(200)..(205),(207)..(213),(216),(219),(224)..(227),(255),(259),(264),(296)..(299),(333),(429),(541),(752),(830): n stands for any base
ntttctcgcaatgacnncaattgnnnnnncttatggncatgaaannnnttgcgtattncnaaannnnnnnntttttgtttggggggaccaaaatttcttttttttttttnnnnnnnnnngttttttttttttngggggggggnncnnnccaaataaaaannnnnnnnnnnnnnnnnnnnannnnnnnnnnnnnnnnnnannnnnntnnnnnnnaanaanaaaannnnagggggggggaatttttttttttaaaanaaanaaaanaaaaaaaaaagggggggggggggaaaaaaaannnnaaaaaaaaaaagggggaaaaaaaaaaaaaaaaanaagaaaaaaaaaaaaaaaaaaggggaaggaaaaaaaaaaaaaaaaaaaagaaaaaaaaaaaaaaaaaaaaaaaagaaaaaaaaaaaaaaaaaaaanaaaaaaaaaaaaaaaaaaaaaaaaaaaaaaaaaaaaaaaaaaaaaagaaaaaaaaaaaaaaagaaaaaaaaaaaaaaaaaaaaaaaaaaaaaaaaaaaaaaaaaaaaaaganaaaaaaaaaagaaaaagaaaaagagggggaaaaagaaaaaaaaaaaaaaaaaaaaaaaaaaaaaaaaaaaaaaaaaaaaaaaaaagagaagaaaagtggaaaaaaaaaaaaagaggaaaggaaaatttaaaatttagttttttttttttaatttgagttttttttttttttttttttttttttttttttttttattgtttttttttttttnttattttttttttttttttttttttttttttttttttttatttttttttttaaatatatttttttttattatttttan

SEQ ID NO: 4452 - DNA, 441 bp, Hordeum vulgare
atactgatatataaaggcatcggagatagcataacagcagcagactgcatcgcccgtttagatagagaaaggggcacatttcttcagccttctgctgaacttgagcaagcactttctggggttgaggctggcctgcaaaggagctggtagcaccagctgacagtacaaattccattgcattcagattcattccttgcaagaaacaagaattccattacattcagatccatcgccttcccgctaactacacagaccgacggaacaacaacgcacgcataaagaattcagaaaggaaaccatagcaccggaacagcagcagcagctagcagggccgactcaagagggcagcggcggacgcaggtcagccgccgaatccgtagagggtgcggccctggcgcttgagcgcgtagacgacgtccatggcggtgacggtcttgcggc

SEQ ID NO: 4453 - DNA, 516 bp, Hordeum vulgare
  UNSURE (12): n stands for any base
gcaccgggtggncgtgctcatgacgcacgacgtctgcggccccggcaccatcgggatcttcaagcaggagttcggggaggacgccaaggtgtgggaccgcgagaaggtcgtcatcatccccgaccactacatcttcaccgccgacgagcgggccaatcggaacgtcgacatcctcagggacttctgccaggagcagaagatcaagtacttttacgacatcaaggacctcagcgacttcagagcaaatccggactacaaaggtgtttgccacattgcgctggcccaagaaggccattgccgaccgggcgaggttctccttggtactgattcgcatacctgcaatgctggagccttcggtcagtttgcaactggaatcggaaacactgatgctggttttgtgatgggaactggaaaggctcttctcaaggtgcccccaaccatcaggttcgtattagatggagaaatgccaccttatttacttgctaaggatctgattttacaaattattggcgagat

SEQ ID NO: 4454 - DNA, 551 bp, Hordeum vulgare
ttttgaacggagggagtagatacaatatcattctgtaaaatgttctttgtgcgaagatgtaacagttacgcacactcagtaataccaatgaaaaagcatacaacaaaacctttctcagttacagctgctactcgttgagtaacttatttctcatcacgacacacacacagaaatctaaactacagttccgaacacgaacaaaaagtaccagtacaggacggtccgcgacacaaatacgttgttttcaagatctctacgacaggaagtctctggggtctgtgacatatcccgtcaacgccgaggccgccgcagtgaagggagaagccaggtagatctgcccttccttatggcccatcctgcccgggaagttcctgtttgtcgttgatacacagaccgtaggttcattcatccgtgcatatgtatcacgaggaccacccaaacaagcaccacaattaggactagctggtgtatcacaaccagcctcttcaaatatctgggaacatgttttgccaccagatcctggtacggggaggctatacacgtccatccac

SEQ ID NO: 4455 - DNA, 430 bp, Hordeum vulgare
cggcagggcgcgtcggcgttagggtggagaactggaccgcgcagccggtggcgtcggcaccgcccgcagccgaggcgaggaggacgccgtcgtcggaggtaatcaaggtccccgtctccggagggtgaagaggacgagtgctcgccggccagccagccctgctccgtcgtggagtcttcagaacttcagaagccgcaggagctggctcagcaagctagtctcgtctgtctctcgctctcagggcgctgcaaacgtgcggagaaattcggagggattcaaatagttgaaaattatacaccatatgaactgaactgaactcatcgatgcccccaatagttcaaaatttatatatgcatacttacaccgtgcaattaattcattttccttgtggaaaaaaaaaaaaaaaaaaaaaaaaaaaaaaaaaaaaaaa

SEQ ID NO: 4456 - DNA, 390 bp, Hordeum vulgare
aagggaaaatgaattaattgcacggtgtaagtatgcatatataaattttgaactattgggggcatcgatgagttcagttcagttcatatggtgtataattttcaactatttgaatccctccgaatttctccgcacgtttgcagcgccctgagagcgagagacagacgagactagcttgctgagccagctcctgcggcttctgaagttctgaagactccacgacggagcagggctggctggccggcgagcactcgtcctcttcaccctccggagacggggaccttgattacctccgacgacggcgtcctcctcgcctcggctgcgggcggtgccgacgccaccggctgcgcggtccagttctccaccctgaacgccgacgcgcccttgccg

SEQ ID NO: 4457 - DNA, 964 bp, Hordeum vulgare
  UNSURE (1),(864),(880): n stands for any base
ngtcccccgggcctgcaggaattcggcacgaggctgtgtcggtttcgggtacaggtacccttttgttgaaggtcgttcgagcttttcctgggagtatggcatcggttacatacttcagcgccgtagcgcctggtatgagcctcgtggagaagcaattgctagtccacggggctcatacttcagcgctgcagcgcttggtactcggacctcggctcgaggcattttctctaccccttcttaccctgaaaaagcagggtcaccttgtgtccttaaacctataaccatctttcggctaacctagcctcctccgtccctccgtaccaacaaggggtagtacaggaatattgacctgttgtccatcgactacgcctttcggcctgatcttaggccctgactcaccctccgtggacgaaccttgcggaggaaaccttgggttttcggggcattggattctcaccaatgttttcgttactcaagccgacattctcgcttccgcttcgtcgacccccgctttcgcggttgcttccctctaaggcggaacgctcccctaccgatgcattttgacatcccacagcttcggcagatcgcttagccccgttcatcttcagcgcaagggcgctcgatcagtgagctattacgcactctttaaagggtggctgcttctaggcaaacctcctggctgtctttgcacccccacctcctttatcactgagcggtcatttaggggccttagctggtgatccgggctgtttccctctcgacgatgaagcttatcccccatcgtctcactggccgaccttgacccttgcctcgtgccgaattcggcacgaggggcatgatatatacagccagaaatcaaaattnggcctgcttagatagntacatgaaggatacaatgggaccataccatgcatttatcttcatcaacaaaaagtacttcatttggcgagtgatgaagctttgt

SEQ ID NO: 4458 - DNA, 571 bp, Hordeum vulgare
  UNSURE (10),(30),(51): n stands for any base
cattttgatncgatatatatatatttgttntgcttaccaaactactgtatnagttagtcgtcgtgtctcctgcaggtcactctgtacaacattttgatcagatatatatatttgttcatgcttaccaaactactgtatcagttagtcgtcgtgtctcctgcagctcttcatggtttttacaatgaaagaacaagtcatttacagtgaaatggtgtgtggatcatgttcatcaaatgtgtgctcctgtcctgcctcaaaactcctttccttgtcagttatagtcttctaatttacagactcatggtcatgggttcgctcgcatctattgtctccccttcctacatgattcttctcctttgctccaagcaagttaaccgagaaataatcttcaaacattgtctcaggagagaagaaccatgctagtccaaggacacatcacacaggagaatcctgtgcagctcgagcacatcagattggttgaagcttcgacagccgtagtggcaaaatagtctggcatacaatcagtagtctaccgcacttgattcttgtcagaactgaatatgcttgactt

SEQ ID NO: 4459 - DNA, 553 bp, Hordeum vulgare
  UNSURE (11): n stands for any base
gtccttccggngctgcaggccgcttatccacgaattttattcaagagaagtacagagccccattatcttacagttgacactggcttactatgggggaggcttccatcaaagcatatgtctcatccaacctgtctcttggagataggcaccttgccgcacaatttcaggaaattcctctggacctaaagatgcttgatgcagaaaaagttggatttgaaatgctgaaatctacaatggtggagaagctccccaatgatctggaaggaatggagtcttcaatgcaaaagttatatgctcttattgacgagatctacaaatatgttgatgatgttgtggaagctcgtgttgcaccggacaacaagataggcaggttcattgctgacacggtctcctccatgccaaagctgtctccagcatcttttgacaggctcttcaatgacaagattcaggacaatcttgcgcttgtatacctgtcaagcattacacggactcagatcgcggtagctgagaagctcaacaccgctgcccaagtcctgtgatttccatgtattgt

SEQ ID NO: 4460 - DNA, 554 bp, Hordeum vulgare
ttttctttgaacttggatacaggtacaaaatgctattctgacacatattcagatctctcattcaatcaaacgaaaaccaagcacaggcggcatggaatttggcagctatccaaacaatacatggaaatacaggacttgggcagcggtgttgagcttctcagctaccgcgatctgagtccgtgtaatgcttgacaggtatacaagcgcaagattgtcctgaatcttgtcattgaagagcctgtcaaaagatgctggagacagctttggcatggaggagaccgtgtcagcaatgaacctgcctatcttgttgtccggtgcaacacgagcttccacaacatcatcaacatatttgtagatctcgtcaataagagcatataacttttgcattgaagactccattccttccagatcattggggagcttctccaccattgtagatttcagcatttcaaatccaactttttctgcatcaagcatctttaggtccagaggaatttcctgaaattgtgcggcaaggtgcctatctccaagagacaggttggatgagacatatg

SEQ ID NO: 4461 - DNA, 526 bp, Hordeum vulgare
gcatcttcgccggcaagcagctcgaggatggccgcaccctggctgactacaacatccagaaggagtccacccttcacctggtgctccgccttcgtggtggcatgcagatcttcgtgaagaccctgacgggcaagaccatcacactggaggtggagtcctcggacaccatcgacaacgtcaaggcaaagatccaggataaggaaggcatccccccggaccagcagcgcctcatctttgccggcaagcagctcgaggatggccgcaccctggctgactataacatccagaaggagtccactctccacctggtgctcaggcttcgtggaggcatgcagatttttgtgaagaccctcaccggcaagaccatcaccttggaggtggagtcctcggacaccatcgacaatgtgaaggcgaagatccaggacaaggagggcatccccccggaccagcagcgacttatctttgccggcaagcagcttgaggatggccgcaccctggcagactacaacatccagaaggagtctac

SEQ ID NO: 4462 - DNA, 557 bp, Hordeum vulgare
ttattcatacgtttcatcatccgaacttcaaactacataccattcatgagtttgtaaacacaaacaaacataaaagagatagaaacaagaccagagcacacgctcaaaactccattggagtacaccgtcgacaccagacctatgaacccagagacagaagcagcgccatgagaaggcacttactggccaccacgcaggcggagcaccaggtgaagggtagactccttctggatgttgtagtctgccagggtgcggccatcctcaagctgcttgccggcaaagataagtcgctgctggtccggggggatgccctccttgtcctggatcttcgccttcacattgtcgatggtgtccgaggactccacctccaaggtgatggtcttgccggtgagggtcttcacaaaaatctgcatgcctccacgaagcctgagcaccaggtggagagtggactccttctggatgttatagtcagccagggtgcggccatcctcgagctgcttgccggcaaagatgaggcgctgctggtccggggggatgccttccttatcctggatctt

SEQ ID NO: 4463 - DNA, 513 bp, Hordeum vulgare
gcctcttgggccgcactagttgacccgccacgtgtttgctcaagtgagtgatctccatctccatgccgtaatgccaaccaagaatctatcagggcaaatgagctttcggacgtcggtttcaatgtctaagcagcagggccaaggaagcaacaagctgacgtccaaggagaaaaggcagcaccagaccgctgatgaagggatcagcattgacaagctgaataggctcaatcggagaaacgtctcagcctggaacatgaagaggctcatgaagattattcggtttggaacgctcacgacaatagatgagcagataaagcaggcgacgggtgagggggatctgtcagccacacatattcgtagcgaatacgagtcacacatggccgccaagaagatcttccataatgtagcaaagcatcgatccaagtacatatacttggcagacttgatgcacttcatgaggcaggaggaagccatgaaagcaatggatctttttgaaggaggacaagagtataa

SEQ ID NO: 4464 - DNA, 540 bp, Hordeum vulgare
aaaattgaaaattgatacatattctattgcaaagctgacatactacacaacactaattacacaccaaaccaagtgatgtgccttagacacgctaacagctcatatcatcacctacctgcctgttgctagcaagggctcttgtagctctcaccgctcgaactggataggaaatgccccgtgaacatcaactgcttcagcaataattccatgttgttggcatccttgtggataaaataggaggcgcattccgcacgttcacatcaagtggtagcatccgatactcaatgtcgaggtccttgaggactttgatcatctccttgagcaccagctccctcctcacatacctcatccccatgtcctggaagttgagcgtgtgacagagccatatggatatttttagcttgttcgtctcatctacatctcggaggatgaccatcgcccccgggtaccaatgctctttcttgttgttgatgtaacgtagtattctttccttcattagtgctagtttcgctaccggtgtggcaacgtgaatatagaaat

SEQ ID NO: 4465 - DNA, 517 bp, Hordeum vulgare
ctgagctcctgagggagcacgccgacctgctcagctccgtgcgcggcgacatcaccgagtccaaggctaccggcggcatgtcgccgagggtgcatttgctccgggagagggcttccattcacggcagcgtcaatcagatagacgaggtaattgggcaagctcaaagcacaagagcagcactatccaatcagagggccttgtttggagatgttcagggaaaagtcaagcagttgggtgaaaaattccctgtggtccgaggcctcctcggcgccatcaagaggaagaaatcaaaggacacgatcattctttcagcagtaatcgcggcctgcaccatctttttgatcatctactggctctcaaaatgatcggtgcgttgttggaaaagattgcggcggggactccccctctcggcacagagtgaccgacaggtgacaacagatggcacgataaaaagacttggtgattatccatttgttagggctagtatgagggaattggacaccccgttgtgtttagc

SEQ ID NO: 4466 - DNA, 552 bp, Hordeum vulgare
ggtttatcttgacacgctggcctcgcggcaattcaccaacaaaattgatctaggtataaatgacaggggagatctccaaaaacaagatatgtcgagggcagcacggtgagagctaaacacaacggggtgtccaattccctcatactagccctaacaaatggataatcaccaagtctttttatcgtgccatctgttgtcacctgtcggtcactctgtgccgagagggggagtccccgccgcaatcttttccaacaacgcaccgatcattttgagagccagtagatgatcaaaaagatggtgcaggccgcgattactgctgaaagaatgatcgtgtcctttgatttcttcctcttgatggcgccgaggaggcctcggaccacagggaatttttcacccaactgcttgacttttccctgaacatctccaaacaaggccctctgattggatagtgctgctcttgtgctttgagcttgcccaattacctcgtctatctgattgacgctgccgtgaatggaagccctctcccggagcaaatgcaccctcggcgacatg

SEQ ID NO: 4467 - DNA, 533 bp, Hordeum vulgare
ggcaattcggcacgaggtggcagtgcctattatgttgcaccagaagtattaaaacggcggtctggacctgagtcggatgtttggagcataggagttataacttacattttgctctgtgggaggcgccccttttgggataaaacagaggacggtatattcaaggaggttctacgaaacaagcctgattttcgtaagagaccttggccaagcatcagttcaagtgctaaagattttgttaaaaaattactggtgaagaacccaagggcgagattgacagcagctcaagctctctcacatccatgggtgagagaaggaggagatgcatctgagatccctgtcgatatatctgtactgtacaacatgcgccaatttgtcaagtacagccgttttaagcaatttgcgctgcgggctttagcaagtacagtcaatgaggaagagctagcagatctaaaggaccaatttgatgcaattgacgttgataaaagtggatcaattagcattgaagaaatgcggcatgcccttgcgaaggatct

SEQ ID NO: 4468 - DNA, 543 bp, Hordeum vulgare
caggccacaaaatggattctgttcagacagggaaaatagcatcatcctgcgtagcacagaacagtagcatggaccactgtacaagaagcgatttggggccttccacactccgaaaatatttaccttgagacttatctctaacccttaccactgactgcacacagaacctggatgctaacaaatcagaaaccctcacatcgcacggaacgaagaaaacagcacgaaagaagaagaaataaactctctagtgtacccacaccgtctcccccctatagatgccccttgccaattctcacagagcctggggattcggaactccagacgggctcggcaggttgctcatgcttgcggttcgtaggagtttgcggaactcggacaggcttatccgcccgtccttgtcgatgtcggcctcctccagcaatggctcgatggatccctttaagcccgtgtgcattctaagttcatcgggggtgatgtatccatcaccatccaaatcaaatttgctgaaagcagcttggcagcgcaagccccacctttcagagt

SEQ ID NO: 4469 - DNA, 518 bp, Hordeum vulgare
gctacgtgtcccgcgtctgctccgccatctgcgctctcatgcctatccttacgctgtactatggccgcatggatgttcccctgacgttatcggcatttattattgcaatatctttggtattgcaaagaggaaacccccgtttcgcgcagctaactagttcagtttttggtttattttattgtggctatcttccttctttctgggttaagctccgttgcggactagcagctcctgccttaaatacaagtatagcacataactggccaatacttcttggtgggcaagctcactggacagttggacttgtagcaaccttgatatctattactagcattattgctgccgatacatcagctttcctttgtggaagggcatttggccgtactcctttgactaacataagtcctaagaagaccctggagggtgctctagccggtctgactggctgtgtgcttaccactgtacttttgtcgattctctttcactggccaagatcgcggttgagtgctactgcttat

SEQ ID NO: 4470 - DNA, 478 bp, Hordeum vulgare
tactctgcaaaaagaaaacaaaaaactatgtacaccaaagtgacaggttttcaccattctggtgctgaagaagaaacagttcgatccggtacgaagaagaaacaccgcttagttagcagccgcatcctgtgatcttatcccactttacagccagccacgaattctcatattgtgcagccaagcaagctgatcctggccatctcatcaaggccccatcgcgacgttacattgggtgacaatgtcgtcgaaggtacaaggagaccgtttttctcgctgcggtaaatcagaccccatacaggggcagagctaccctgacgaaggagtaacaaagcgcccctgtgaagacgtagctgtcgacccggtcaagaataccaccatgcccaggaatgagtgacccagagtccttcacaccagcatcgcgcttaatcagagattcaataagatccccaaataatgaacccagaaagatcaggatccc

SEQ ID NO: 4471 - DNA, 516 bp, Hordeum vulgare
ctcgagccgcgccacagaggctacctccgcccgcctccgccgtcgaccccggtcgccccgtgaagagccgccctcttccaccgatcgccggcaagccgccccctccccctctccgaccctgccccgcacgcactgcgctgatttcagttggttgatccctcaaattctaaaatgcttaccaaagggaggagagttgccgggaggggtgaagacatgtctgcacattatgcatttgggccacatgaggatgatgcgattatcaaacaccggcttctgactaggatcacaactaccaggggtgaaccacccctaaagaagctccaaaagaagttcatgtccttcgccactgaggttgagaaggatgcagacaatacaaatgactgtgagaggctgtacaaggcctttctgcaggaaattaatacttttgagttgccccttcttaaaagcaaggctgtagttgatgcaaatctcagggagaaggagagcttcaacgagctgcaggttgagatccagcga

SEQ ID NO: 4472 - DNA, 554 bp, Hordeum vulgare
tattttgcacgccatggtttagcatcgaatacagcttacagtttaagaaaccacagcaacgacaaaaaaggggtctcctacaaagaaacacggtgcccagaaactctgaagcatgcttgagcgtacagggtaagcaactcgctagcattaagatcgttaatcagtctacagccattgcatccgaagcaccgccgctgccttcctctatgctcaactttggctcttcagtagcagctctcagctcatctgctatgttcctttgctcatcttcgattgagatttgcaattcctccaccacatgaagaagaagagcaaactgcttcttcctaagctctaacgtccttgtacatgctgcactctctgcctccaaattagctatctccttctcaagattagcaataagtttctcggtttctgaccgtggaggctgcgaggaaatcaattttctgatcgcttcacactcctctttgtgctgcctctcaatcttgctctgttcaagttgtttcttaagatcctcaatatcagtctgagcttgcaagatttgtcgctggatc

SEQ ID NO: 4473 - DNA, 511 bp, Hordeum vulgare
gggactgcaggcaattcggtacgaggcgaccccctctgatccaaccaccgatcgaagccggctctctcgtcctcctcaccaagatgcagatcttcgtcaagaccctcaccggcaagaccatcacccttgaggtggagtcctctgacaccatcgacaacgtcaaggcgaagatccaggacaaggagggcatccctccggaccagcagcgcctcattttcgccggcaagcagctcgaggatggccgcactctggcagactacaacatccagaaggagtctacccttcacctggtgcttcgcctgcgtggtggcaagtaagtgcctggtcatgacgttgcttctgtctcagggttcacaggtcttgtgttgtcggtgttctcaccaaaggttggagcatgtctggttgtgtcgttgtttccattacggacctgttcggttgtgtctaaaacttgtgccgtggctttggatgatgatctatgattaataagtgagccgttaatatcctgtgtaaa

SEQ ID NO: 4474 - DNA, 435 bp, Hordeum vulgare
ccacggcacaagttttagacacaaccgaacaggtccgtaatggaaacaacgacacaaccagacatgctccaacctttggtgagaacaccgacaacacaagacctgtgaaccctgagacagaagcaacgtcatgaccaggcacttacttgccaccacgcaggcgaagcaccaggtgaagggtagactccttctggatgttgtagtctgccagagtgcggccatcctcgagctgcttgccggcgaaaatgaggcgctgctggtccggagggatgccctccttgtcctggatcttcgccttgacgttgtcgatggtgtcagaggactccacctcaagggtgatggtcttgccggtgagggtcttgacgaagatctgcatcttggtgaggaggacgagagagcctggcttcgatcggtggtgtggatcagagggggtcg

SEQ ID NO: 4475 - DNA, 423 bp, Hordeum vulgare
gcccaggataccgcatgattcccgcatataatggagatggttgtcatctacgagacaatgatccgagaagtcataggaaggagcgaggcgaaaagccgagttgctttgagacttaaacctttgttagtttgtcaccatttgctttatctagtcacgaagaagagtatccatgcttgcttactttttccgtgtcgtcatcttcatcacccgtaacaaccaatgtattcagaggttttgtttacccaatcctcccgggaccaacgagcactccctctgtaaactaatataaaaacgtttagattattaaagtagtgtcctaaatctcttatattagtttacggagggagtattatctttctttctacttccgcatgtatactcaaatcaatgggaagcaagacatgaataaaccagaaaccagga

SEQ ID NO: 4476 - DNA, 408 bp, Hordeum vulgare
ggtttattatgtcttgcttccattgatttgagttacatgcggaagtagaaagaaggtaatactccctccgtaaactaatataagagatttaggacactactttaataatctaaacgtttttatattagtttacagagggagtgctcgttggtcccgggaggattgggtaaacaaaacctctgaatacattggttgttacgggtgatgaagatgacgacacggaaaaagtaagcaagcatggatactcttcttcgtgactagataaagcaaatggtgacaaactaacaaaggtttaagtctcaaagcaactcggcttttcgcctcgctccttcctatgacttctcggatcattgtctcgtagatgacaaccatctccattatatgcgggaatcatgcggtatcctgggc

SEQ ID NO: 4477 - DNA, 1814 bp, Hordeum vulgare
  UNSURE (13),(15),(18)..(20),(23)..(26),(28),(34)..(40),(44),(46),(47),(61),(83),(332),(772),(886),(1074),(1147),(1194),(1330),(1354),(1371),(1432),(1461),(1464),(1503),(1528),(1551),(1553),(1732),(1747),(1774),(1810),(1814): n stands for any base
tttttttattttntnttnnnttnnnntntttttnnnnnnntttntnntttttctttttggngcttggaaaggaatatatagcntcagagggtgcttagatccaacgactccccttcgtcatacctcgtcacccctcaccactcctcctccctatgcgagaaggtggaagaggggatacagaggcaatggctgatatattcgagggtccggaggtgacttgagatgataaagtgggagcgtgcgaccgtgcaagaacaatgacactgcgcggcgattgaagaataaccggatagactgtagttcgtgagtagcgtccgcacttgacagacganaggcccaccactcgcggctgcccccggcgtacgtcacctgtcatacctgccccctctgtgtccgccgcgccccggcccccctgcgtccagccagcctctccaggcgtgcgcgtgacagggactcgctcggtccggaagaaggggaacgggctgcaagacagagcgcggagaacgttaagataattgttgtgcgacgtgctgtgtgagcggtctccgttcggtgactacgatggcagcggtggtggatacgaatacacagacacctccatgagtcctacgtatctgaatcgctcctgcttctatggcgtcatattgccgtggattatcgccaggtcgcgtgagctggtcgcggtgcgcacacgcgacgcactcgctgacatgagttcgaaacagacgtgtcgaatgacggtggtcgtctgcacggtgagaaataaggtatntatactcagggcatggtagaggcgtcgtccgattcgcagtgtgatcgacgttcgtcgatcgtcccgacgcgcggttgtctgtctcatccatgacacgcctccagtagttatgtnccattgcgcggtgtcgctcgaccgtagcgggagagcgcaatccccatacatcgacgacgacatgctgacgcgcgttcctagcgtgttcactgttcgtcggtgcgacgtcgatgtggcacagcgcgcatcgcctcgtgagtgtactgcgcctcgcgttactcgcttgcgcacgccggtgacacgcgacntcgtacgtgcagtagcgatagcgccgagtgaccgcggagtgtcactcatacgtactcctcctagcagcgcgancgtgcacccgccacaccgacgttcacagtagacgccgctcacgctgngacgctgcacaggcacgccactcacacccgtagacacgtcagtgagtgcctctcgtgcacactgtacgcgatgcccacctgcgctaacgttatcgatgtcgcgatagacgatgtgatactgctcgagcgacatagntagtgaatagatagttgtaggtgngtaagtgcgttaatggntaatcacgtgcatgtatagaacacggcgcggactgttctcagccacaactgctagcgcagntgtcttgtcgtctgagtacgatcgcgaangcntgactgaaactgcacagttcgcgtgctctagcgtctgangttctggttcgtcggaccagctgcngtacacgtcagatctcgagagancncgggatcatgcccgacaatctctctttcccacctcatatctgaccttgcgctcatagtgaacacctctatcgtgtccatatggtagcacacgatcgtcatcagtagcacgtccagctgcgaccgccgtctgcgacgagagtcgtgtgatcacagatgcgctacccccatcagattcgcntacgcttggcgtgcntgctctgtcagcgaactgtcagagagngccgttctgtgcgagagtcatacgcgtcgttgcatngcgn

SEQ ID NO: 4478 - DNA, 535 bp, Hordeum vulgare
gatgtgtattactgcagtgacacacatatccaatggtcagcttccttctcagagcaatatcatagcgtttggagcacaatggcaattattttgactggcacagctttgatgccaggaacatccactggaccgggcataacaaatgcccagaatcctttcctgtcagcaaccggatgatcaaatttcggttttcctagctctactcgaaaatgggtagatcaggagccttattcttcgacccaacttctgcattgtttgaagatgcagatagcgatagcgcggccaaggcctttgcttgagattctttgtccatgtccaagaagagttgatgccatctagagtctgatgttagctctgggtgaaatgcggtggcaaggatgttcccttgtcgtactgcaacaatcacccgatctttggagtacacttggtcctccacaccctcgccagatgttattgtaatgctgggtctgccagcaggaacagggcaatcggccaatacttcaacatcctggcctacttctaggatagcaggtgc

SEQ ID NO: 4479 - DNA, 542 bp, Hordeum vulgare
  UNSURE (4),(12): n stands for any base
gggnctgcaggnaattcggcacgaggggcaattccgaggctaacaaaccctctctaactgcggaggagaagaagattaaagcacaagagctaagggagcgtgctcgtaaaaagaaagaagaagaagagagaaggatggagagagaaagggaaaaggagaggataaggattggtaaggagcttcttgaagccaagaagatggaggagttaaatgaaaggaaacgcatcatagaattgagaaggcttgagaaagaggaggagaagagagccagagaaaagattcgccagaaactggaagaggacaaggctgaacgtagaaggaaacttggattgccggcagaagccccagctgcatccaagccaagcgcaccacagcctgttgaagagaagaagagtgcatttttacctgtcagaccagccacaaaggcagagcggatgagggattgcttacgaaatattaagcagcagaacaaggaggaggatgctaaagtaaagagggctttccaaacactccttacctacatcggaaacgtggttaaaaac

SEQ ID NO: 4480 - DNA, 550 bp, Hordeum vulgare
  UNSURE (30): n stands for any base
tttaatttttcctgtgtagtctggtgtttnctataagcaagattgcactattttacagtttaattcgacaactgttcgtcacacattcccgattcagacgacggattttcaaaggggctacaacgggaatttctcggttttagaggactccgaagaaaggattggtgatggccgagttgagctcggctccagctacattcaggacggctttgtcaaccttgtcccttgccagaaacaagatctcttcaccttccggtttctcgaacccgcacagctcaagaaactctatgcctccaaggctcgcaactctctcctggaatgtagcattggtaagtctgatctttctgaatttctcctcgtcggggtttttaaccacgtttccgatgtaggtaaggagtgtttggaaagccctctttactttagcatcctcctccttgttctgctgcttaatatttcgtaagcaatccctcatccgctctgcctttgtggctggtctgacaggtaaaaatgcactcttcttctcttcaacaggctgtggtgcgcttggctt

SEQ ID NO: 4481 - DNA, 341 bp, Hordeum vulgare
gattaggcgcatcactgcaaaggttgggacagtacagagaagcaatgagctggtactacagggtcctggcgctatcaaaggaaaccggcgaggattctggctgcaccgaggcctacggcgcgatagccgactgctgcgccgatctcggcgatttggagggagcagcgaggttgtatgacgagtacatatcaaggctgctttttcgcgattgagcgctcgggcgttcttggtgagcaaacacgggggttcttcctacttactgatcatcatgccagagcccgtcagtcgccctgcttctgatgtcaaagattgcttgcttgctatctggcggaaaatgagcc

SEQ ID NO: 4482 - DNA, 422 bp, Hordeum vulgare
gcccctatggacgttaagtgcctccagccaagttaaaagacaagcaaaatcggctcattttccgccagatagcaagcaagcaatctttgacatcagaagcagggcgactgacgggctctggcatgatgatcagtaagtaggaagaagccgagtgtttgctcaccaagaacgcccgagcgctcaatcgcggggctgcagccttgatatgtactcgtcatacaacctcgctgctccctccaaatcgccgagatcggcgcagcagtcggctatcgcgccgtaggcctcggtgcagccagaatcctcgccggtttcctttgatagcgccaggaccctgtagtaccagctcattgcttctctgtactgtcccaacctttgcagtgatgcgcctaatcctcgcacagctttcttctcctcaaagcgat

SEQ ID NO: 4483 - DNA, 958 bp, Hordeum vulgare
  UNSURE (21),(832),(847),(920): n stands for any base
agtacccccgggtctgcaggnaattcggcacgaggcaatgtcgatgctcataatgcctcttgaggcatcagcggagacatgtcaaccgactagttcttttgccaatatgcccatttttattgctgtcgctctaataggagctgctgtgggtggattattagcacggcaaagaaaggaggaactgaagcgattgaacaatcaacttcgtcagattaatactgctcttagaaggcaggcgcagattgaatcatttgctcccggtcttacttatgcgcctgtaggaagaacaggagaaactgaggtcattgttgatcctaggaagcagcagttggctgtaaatttgaaaaacgggaagaattatatgaggaatcaggaccttgataaggcggtaacagagttcaagacagctctggagcttgcagaaagcataggggatcgctttgaggagaagaaagctgcgcgaggattaggcgcatcactgcaacggttgggacagtacagagaagcaatgagctggtactacaaggttctggcgctatcaaaggaaaccggcgaggattctggctgcaccgaggcttacggcgcgatagcagactgctgcgccgatctcggcgatttggagggagcagcgaggttgtatgacgagtacatatcaaggctgcagccccgcgattgagcgctcgggcgttcttggtgagtgtttaaacactcggcttcttcctgcttactgatcatcatgccagagcccgtcagtcgccctgcttctgatgtcaaagattgcttgcttgctatctggcggaaaatgagcccgatttgcttgtcttttaacttnggctggagcacttgnactgtccattaggtggccctctctacttctactcgggtatataaatcgccgatgtgctaccgcatgtgccggnttcagaattctgtatgcagggatgggcgatccatcttg

SEQ ID NO: 4484 - DNA, 552 bp, Hordeum vulgare
taagttccttttataatgaagtaacatggggcttgatcaagaggcatggtgcaactgttgctgtatcacgtgtcaggatatgacactctgtaatacaatcctgaagccgcacagtgaccagccaattcaaggaaaatttcaacaagaagatgggtcgccaatcccaattcaaggaaaatttcaacaagatggatcgccaatcctgcatacagaactctgaacccgcacatgccgtagcaccatcgcgatttatatacacgagtagaagtagagagggccacctaatggacagttcaagtgcctccagccaagttaaaagacaagcaaaatcggctcattttccgccagatagcaagcaagcaatctttgacatcagaagcagggcgactgacgggctctggcatgatgatcagtaagcaggaagaagccgagtgtttaaacactcaccaagaacgcccgagcgctcaatcgcggggctgcagccttgatatgtactcgtcatacaacctcgctgctccctccaaatcgccgagatcggcgcagcagtctgct

SEQ ID NO: 4485 - DNA, 294 bp, Hordeum vulgare
aagcacaacctttcctaacccaaagtgccgttgcggcctcactcactcaccccgctcccccctctccacgcgcacccaccctgccggagaattcaaacggaagcgccaccaacgggagcagcagaggcctcctcctcctcctcctcctcgcgcgcgcaccggcggcggcggcgggcgtcctcggatcgatcgctgtcccgatcctggcgtcccttcccacaacaacttcttgagaaagctggataattgccattttgcacatccttcctgggtccacttcacattgaaggcttg

SEQ ID NO: 4486 - DNA, 419 bp, Hordeum vulgare
ttttttttttttttttttttgaacaacaaaatcttttaagcactgacaagttattttcatccaatgatcactgacaagttatgaacattcttacaaaattaatacatgcagaatgtagatgacaacaagtcataaacattctaaagaattttgagctatctacatatctcaagcaaatttcgcagccttccttcaccaacaaagattttgagctatctacatatctcaagcaaattccacagacttcctcgaccaacacagaaaaagctcaatgcagttcaccttggcgaatcccatccccagtatgaaatatcagctcctttttcctcactgtaatggagtagaaaccaattggcgagttttctccttgatcatgttcgagattggctgccagcccatcagccatggcttcctactcg

SEQ ID NO: 4487 - DNA, 527 bp, Hordeum vulgare
cggcacgagggccgttcgctggtagtcaacgggccgcccaccgcgtgggagcatcggagggctgctcgccggagccgcccactgcgtcagggcgggacacaccaccaggccatatgtggaagcggaatcatccgtgaccatccctcagcccgagcgtgttcgtggcggctgccatctctgattccggtgtgacgacgcacgacgggttaataatatcaacttctggccatgtccatggttccgcacatcatgctgcgcccgttcggcgtaactccctgcggcggcggcggcggcggctgtctcagacggcatcatgcccggctgtgcctcccccgtgcgagctcggtcgatgcgacgggcgggagtgagccgggcgatggcagcaacaggaggaggaggaagaagcaggccgcggaggagccgcggttggaggtcctttatgacgacgggttcgggagcgtcaccatgaaggactactgggaggcggtgagggccatgcccaaggacgacggcggaccgccgcgatg

SEQ ID NO: 4488 - DNA, 539 bp, Hordeum vulgare
actttttatataattgtaaaaatgttgtttcagatgactcggcatacgaaggcacataaagctaacctccataaagtcatcttctcccacacaaccaaatggtatgacggtaactccaaaccgtgctgccattcttacaaattctggttgatctggccaaaacaatttgtatgcctcaccctgccaggtacaacagaataagcatagtagactatagggaacacattttccgtacaataaaatgttaagttcaaggacaccttcctatgtagagcttcccgcacaccgcctggatagagaagaacaaattcatttctctcaaacaacttgtacgtattgatcggactgactggaagtgcgccgtacgtagagaaccaatcaaacagcgacaactcctgacgcagtgtctcataatttccaacaaaaaatacttgatgggccgttgttcggaggattgtttttttctctcttaggaacccttcaatcagtgcaggcacctccatggcaaagagttggtgatagcccacgaacaagacggg

SEQ ID NO: 4489 - DNA, 497 bp, Hordeum vulgare
gcgcgacgccgacgccgacgccgacgacgaaccaggaccgacgcgcgacctagggctccgcgcattcccccgccccgctcccccccgtcggcgtcgaggtctgctgaatccagagcaatggagcggtcttttaagttgaatccagatgccgctcctttcgtgcctgcctccaagtctccgttcgcggagagcttgaaaggaaagaaggaccctgagaagcaagtagatgagactgaaaagagtgagaccgctgacaagtctgctgggtatgaactcccagagtccctttcttttgatgactatgctgaaagcctaggaaagatcaacatctctaccgagtcatcatcaaaaggagaagctgctgaggcaagtcacgcgggtagccatctcgccgtggtggaatctctctcagtgatgttcccagatgtgtcagctgacttcattcttgaagcactgaaggccaatgaattcgatgcagtactcaccattgatatgct

SEQ ID NO: 4490 - DNA, 454 bp, Hordeum vulgare
ggttttcgaattctggagtctaaacggctacgccaaaagagctgtacaacttgcaaccacgcatcacgatgaggcagactccaacaaacagaccagctatcccacccggaatttaaaaccccaacacatagtacttgttgtttttgggactagtaaccgaaacacttcggggtgaattcttcgcagaatcaagaaattgtactccgctacatccagtcttgatggtgaagaagatttgcttgaaccagatgtagctggagagctctcatgccgcctatgtggacgaagggtcatgatgctgcggctttcctgatacttcagcagagtgaccgttatcatcagcttcgcacagatcggaaagcatatcaatggtgagtactgcatcgaattcattggccttcagtgcttcaagaatgaagtcagctgacacatctgggaacatcactgagagaga

SEQ ID NO: 4491 - DNA, 526 bp, Hordeum vulgare
gcgagttccctggcgactatggttgggacactgccggactttcagctgatcctgagaccttcgccaagaaccgggagctggaggtgatccattgccgttgggctatgctcggggcacttggttgtgtcttccctgagttgctcgcccgcaatggcgtcaacttcggtgaggttgtttggttcaaggctggctcccaaatctttagtaaaggtggtcttgactaccttggcaacccaagcctcgtccacgcgcaaagcatcctagctatctgggcatgccaggtggtgctcatgggtgccgtcgaggggtaccgcattgccggcagcccactcggtgagatcgtggacccactctacccaggcggcagcttcgaccctcttggcctggctgaagaccccgaggcattcgccgagcttaaggtaaaggagatcaagaacggtcgcctcgccatgttctcaatgtttggcctctttgtccaagctatcgtcacgggcaagggcccactcgagaacctcgctgaccacat

SEQ ID NO: 4492 - DNA, 540 bp, Hordeum vulgare
  UNSURE (27),(30): n stands for any base
ataaatttcttcgtaattttacattanttntggtagtacaaggtgtaccaactcagaccacaggacaccacgcctcatggtgggcatagtctcaagacaccttacttgccggggacaaagttggtggcgaacgcccatgcattgttgttgacggggtcggcgatgtggtcagcgaggttctcgagtgggcccttgcccgtgacgatagcttggacaaagaggccaaacattgagaacatggcgaggcgaccgttcttgatctcctttaccttaagctcggcgaatgcctcggggtcttcagccaggccaagagggtcgaagctgccgcctgggtagagtgggtccacgatctcaccgagtgggctgccggcaatgcggtacccctcgacggcacccatgagcaccacctggcatgcccagatagctaggatgctttgcgcgtggacgaggcttgggttgccaaggtagtcaagaccacctttactaaagatttgggagccagccttgaaccaaacaacctcaccgaagttgacgccattg

SEQ ID NO: 4493 - DNA, 543 bp, Hordeum vulgare
gtacccccgggcctgcaggcaaatgtaattagaggcgcagatgagcatggtaggcaaatggacggatacacagagaaatctgacgaggatgagctggtttcgcctgaagtcgttgaagtcgtcgagcaggcagagtcgagggattctatcttcaaggtttgggatctagatgtgtcgttctccgaggacgagagcgagctcgaactcatcaaggacctcaagaaactcctcaggggcaacccccaggaggtcgcatatccacctcctggtgacgcggcccaggctctgagcaagataaacattgatgagcttgtggcaggcttgagtaacttgtcactgcagcgaaccagcgggtaaaagtttattctgggttctcatgatcctctgcatttcggtcgtccaatggtgaatttcgtggcagcaaaccagtggtttattaaaatgtaaacagagtgttttttggcaggtggtcctctgtgcatcttgaccatcccggtggtgatgtcagttgcagattacttctttagacttaagacttaggtt

SEQ ID NO: 4494 - DNA, 552 bp, Hordeum vulgare
gcttaatttgcatccttcctgtagagctctcaagatctgcttgaactttaattatgcatccttcctgtagagctctcaagatccgcttgaactgaattcatacggcatgttctaagggtgcccagacaatatacaaaaccaatatcgaaacagtcaacctaagtcttaagtctaaagaagtaatctgcaactgacatcaccaccgggatggtcaagatgcacagaggaccacctgccaaaaaacactctgtttacattttaataaaccactggtttgctgccacgaaattcaccattggacgaccgaaatgcagaggatcatgagaacccagaataaacttttacccgctggttcgctgcagtgacaagttactcaagcctgccacaagctcatcaatgtttatcttgctcagagcctgggccgcgtcaccaggaggtggatatgcgacctcctgggggttgcccctgaggagtttcttgaggtccttgatgagttcgagctcgctctcgtcctcggagaacgacacatctagatcccaaaccttgaagata

SEQ ID NO: 4495 - DNA, 432 bp, Hordeum vulgare
aacacagcgacgagctccactccgccccccgcctctcccttcctcctcctcctcctcctccgccgccgcccccgttcgatctcagggctccaaccccaagctcccggcattctccgcgaggaattgctatggaatgcttgactgccggtttcgccgcaaggagtgtgggtagggagtacaacttcgtatgcccgagtaagcccgtgggcgagaagcaatgggttcctggaagggttctctgctattttacagctcacacaaactctagccgatgctgcaaggttgccactggggtgtgtcccatcagcccagttgttggcaggcgttcacgctggagatctttcgcggcaagtttgaatttagagaatgggcctgcaccctcgagttcgacatcgtcttcatcagggcagactagtgagcagccgacctcag

SEQ ID NO: 4496 - DNA, 554 bp, Hordeum vulgare
tataatagaagggggtgggaattttatttgcttaaagagtaatttacatgcagtaacagtttcaaactaatttgatcatctcctgccccatggaagaagggtcctttcctaagtggcttcggtggatcagtcgaaaggcaaaattacagaaggtatgcagacccagtcaagaaaacgggggtttgcatttcatacaacacgaatattgcggagagatacccatggcagtaacatgatgcactcctaagagacagcgaaaatctgctattccacggcgagtttattgttctgcgtcaatccctcgccagtaatcgggtattctgatgacagtttccactccccgtccaccaagaacttgatctcatagctcccaggtctaagcttcagagtcgcagagaatctcgcatagtcccctgaatattcccttgacattgcctcaccatgtgaccagccatcgaaggagcccataatttgcacgttctcagccatgccaacccaatggacagcgatttctcgaggtcttaaagactcgatatcctttatctgtaccataa

SEQ ID NO: 4497 - DNA, 947 bp, Hordeum vulgare
tgtctccccggtctggcagaatttcgcacgaaggcttctttgagaacacatacccacgacttcagctttaattttcccaaggggggaacacccacgtgcctttcttctccttaccttttcccccgaaaggggggaacacaaccccctttggtttttttttgtgaggggcccggggacatcccgccccaaagcaggggaagaggaacaagagttctctttgtgaccccagtacagttggcgacccccggggtgtttcttctgcgccccctcttgtgtgggcccgcgccaccctccccccgaggttcctggcgactattggtggggcaactgaagacattttgttgatccccagaacctcttctccaaaaaggagccgggagagaagcattgtccctgggctatgcttggggcacccgggtgtgggtttccttaaatggtcgccccccaccgcgtcaaattttgagaaggccccttggttaaagggcggctcccagaacttataatgaaggtggggttggactaccctagggaaaccccaaccctgttgcacgccccaaagcaaccctactattctggggcaatgccaaaggtgtggcccaatgggggccccccccaaggggacccccgtgttgcttggcgggcccaccttcggggaggaaatcttcgcccccccttatttccaggagggggacctttgaacccccctttgggccaaaaccgacaaccccccagggaattcgcttgggcccaaggggaaagggagggaaaaaaccgggggccctccccagggtcccaaaaggcgggtttctttttccaaatttttttcccgggcaaaggcccccttggaaaaccccttttgcacaattgttggcccctttaaaaaacaggcttgggggttggcccccactttttccccgccaaaaaaaggcccttgaaaaatttttttt

SEQ ID NO: 4498 - DNA, 543 bp, Hordeum vulgare
tttcaagccccgacaaatcttgcattgcttttgcacaaaactctcgtaatttacatcatggtagtacaactcagattgcacaacaacatgcttcatggcatgcacaatcttcaaataaaaattcttcaaggcacatcttacttgccggggacaaagttggtggcaaacgcccatgcattgttgttgatggggtcagcgatgtggtcagcgaggttctcaagtgggcctttgcccgtgacgatagcttggacaaagaagccgaacattgagaacatggcgaggcgaccgttcttgacctcctttaccttgagctcagcgaatgcctcggggtcgtcggctaggccaagagggtcgaagctccctcctggatatagtgggtcgacgatctcgccgagtgggccgccagcaacacggtacccctcgacggcacccatgagcacaacttggcatgcccagatagctaggatgctttgcgcgtgcacaaggctggggttgcctaggtagtcgagaccaccctcactaaagatctgggagccggccttg

SEQ ID NO: 4499 - DNA, 518 bp, Hordeum vulgare
gttgcgcttgcagagagatcgggtcggggaggaggaggaggatgacgggagggcgcgcggtgctcttgctgccgctgctgctggtggcctcggcggtcttcgcccagatccacgcgtcggatccgttgttccacgagtccttcgacgagggcttcgaggggagctggattgtctccggcaaggaagagtactcaggtgtatggaagcacgagaagagtgatggccatgaagactatggtctccttgttagcgagccagccaggaaatatgccatagtcaaagagcttgatagccctgttactttgaaggatggaacagttgtcctgcagttcgaagtgaggcttcagaatggcctcgagtgtggaggtgcttaccttaagtacattcgccctcaggaggctggatgggatgccaaggaatttgacaatgacactccttacacaattatgtttggtcctgacaaatgtggttcaaccaacaaggttcacttcatcctgaagcacaagaaccccaagact

SEQ ID NO: 4500 - DNA, 562 bp, Hordeum vulgare
  UNSURE (20),(25): n stands for any base
tattcaaaaaattccttttnaaggntttcatttgatacaaaagaaaaagaaaatcacttctagctgattcaggacatcacacaaacaacacaaagcttcaccggctcgtagattctagtgacttaaaactaggggtagcagtagaagcggcggcaagactgttcgattatacactcgaggagttcacaaaaaggcgaggaccgagacgtccgaaaatgtgaaggtctggcctacgtctcccttcgcgaccttctgcgtggtgcagccgtgtcatccttctcatcctccttgtcctccttgtcaccgctgcttccggcggcatcggcttccgtggcactgggcttcttcaccacagcagcgggcttcacaggtgccactgccttcttgccaccgaaaatggttctgaagagcacagtaacaaggatgacagcaactgaggccaaaatcgaaattgtaatgttgggctgcttctctcccttctcaattaaatcaatgatcttgatcttgtatggttccaagaacggaatgtcggcgattttgtacaaaacgctgaagatcttct

SEQ ID NO: 4501 - DNA, 504 bp, Hordeum vulgare
  UNSURE (10),(11),(501): n stands for any base
aggcaagggnnatggcacagttgcttctttcaacatattccattagcgaggatggaaagtacattgcttacgggctaagtgaaagtggcagcgactgggtcactattcgtgttatgcgcattgcagacaggcaggctatgcctgacaaattgtcctgggtgaagttctcatctataagttggacgcatgacgggaaagggtttttctatggccgatatcctgcgcctggagtggaattggatgctggaaccgagacaaatatcaatcttaatcatcagatatattaccatatcttgggatctgaccagtcagaggatatactatgctggaaagatcctgaaaaccccaaacattccctcggtgcatcggtcactgaagatggaaagtacatcatactgggtacctatgatggttgtgatcctgtcaacaagctatactattgtgaaatttcttcacttcctcaagggatagagggtttcagagacacaaaggaaatgcttncat

SEQ ID NO: 4502 - DNA, 488 bp, Hordeum vulgare
  UNSURE (484): n stands for any base
aggaaatcgagaaaatctttaaatgagtatcaagtattaccatgagccctgagggccaggccaggctgagcctatagactaaatcattccagccagaccgcttattggtcatttaagtttcaacaacatttttctaagcagaaacacacacccttccacatatggaagaatatatagactcgggtaagcttgcaccacacaaacattggaagtgttgtaaacttcaaagagttgtgatacttgaactcaaaaactgttcagcagctgaagcgataacaatctttcccgtccaggattacacctttcaccgtctgagtgtgctcagcgcacagcatctccagatggacagaattaactactcagtccatgtagcgcccaacatctttgacataaaactgtaacggtccgcagcctcatcaatcaattttttagtcggcctgccagctccatgccctgacttgcggtcaatgcggccaattattgngttg

SEQ ID NO: 4503 - DNA, 422 bp, Hordeum vulgare
gggctgcaggccggttgcgcttgcagagagatcgggtcggggaggaggaggaggatgacgggagggcgcgcggtgctcttgctgccgctgctgctggtggcctcggcgctcttcgcccagatccacgcgtcggatccgttgttccacgagtccttcgacgagggcttcgaggggagctggatcgtctccggcaaggaagagtactcaggtgtatggaagcacgagaagagtgatggccatgaagactatggtctccttgttagcgagccagccaggaaatatgccatagtcaaagagcttgatagccctgttactttgaaggatgggacagttgtcctgcagttcgaagtgaggcttgtacttggataaataaaaataataattgaacagttggtcgtacaaaaaaaaaaaaaaaaaaaaac

SEQ ID NO: 4504 - DNA, 379 bp, Hordeum vulgare
cactgttaatattatttttatttatccagtacaagcctcacttcgaactgcaggacaactgtcccatccttcaaagtaacagggctatcaagctctttgactatggcatatttcctggctggctcgctaacaaggagaccatagtcttcatggccatcactcttctcgtgcttccatacacctgagtactcttccttgccggagacgatccagctcccctcgaagccctcgtcgaaggactcgtggaacaacggatccgacgcgtggatctgggcgaagagcgccgaggccaccagcagcagcggcagcaagagcaccgcgcgccctcccgtcatcctcctcctcctccccgacccgatctctctgcaagcgcaaccgg

SEQ ID NO: 4505 - DNA, 487 bp, Hordeum vulgare
gcaagatctgcaaggtttggacttcattcacgggcgtggggtagcacaccttgacgtgaaaccagataacatatatgtcaggaatggtatttataagcttggagatttcggttgtgctacacttattgatcgaagtttggcaattgaagaaggagattctcgttatatgcctccggaaatgttgaatgaaaagcatgagcatcttgacaaggtagacatcttttctctcggggcagctgtctatgagcttataagaggcactccgcttcctgtttctggacaccagtttgcaagtctcagagagggcaaaatttcattgctaccaggacacccaatgcagttccagagtttaatcaagtcgatgatggaccctgatcccgtgaggcggccgtctgcaaaagagatcctgggacaccccatcttcgagaagcttcgtaatgcgtcggcaaagaagtagggtcatatcctgaagtaggagagcgggcaa

SEQ ID NO: 4506 - DNA, 417 bp, Hordeum vulgare
ataccacaagatcccaactgaaaaaaaggacatcataatccttcctttagttcttccacacgacgatcacaacaccggacggcagtcaagcagactgcccacagcaccactaacacaccagcaaaccaggaaaaccaaccaccaccggggccataagcccataacttcaaaacattggtcgacttcccagcgcataaatggctttcacagcttgacaaccctcaatcagtagctatacagaaacaacagatcagggcaaaaaactgatccgtgccgcgttttcggagagccttctttcagacagacaaaatttgacagcagctgatgtcgtgctccctcgcttggctgcttgcccgctctcctacttcaggatatgaccctacttctttgccgacgcattacgaagcttctcgaaga

SEQ ID NO: 4507 - DNA, 517 bp, Hordeum vulgare
cgcgccgccgtccctcggctccgtctggaataggctggaacatgggaggaaaagaacctcaattcatgggctaatggtaggataaaggatttgttgggttctttaggttcactggatttctccacagggaaggcatccattgatgaagtcaccaaatgctccggcgatgcatttctagtaacggtccgtaataagaagagagtaggttataattatgaactgagcttgagatttaaaggtgaatggttaatcaaggaagagaaaaagaaagtcactggccatatagacatccctgagttttccttgggtgagcttgatgacctagaggcagaagtgaggttcaccgatacccttgaatgggacgacaagtcgcggatcagcaaggatgtgaaatcattcctttctcccatcagggagaagctgggtaccttcgagcaagagctgaaagataggtagggaaatgccggcaggcgccacgcgctgttttcagtatttgttacccattcttgtagctcgg

SEQ ID NO: 4508 - DNA, 547 bp, Hordeum vulgare
atactaaatgtttctgttgagttcatgactctaagagtaagagcacattgacacagaacctaagtcatcaaccgacatgtggcaaaccatgtaaccttacactgactggagaaacaagaataacatgacctcgagtctagacagcaacgcttaatccaacacaacaaagatagtccgagctacaagaatgggtaacaaatactgaaaacagcgcgtggcgcctgccggcatttccctacctatctttcagctcttgctcgaaggtacccagcttctccctgatgggagaaaggaatgatttcacatccttgctgatccgcgacttgtcgtcccattcaagggtatcggtgaacctcacttctgcctctaggtcatcaagctcacccaaggaaaactcagggatgtctatatggccagtgactttctttttctcttccttgattaaccattcacctttaaatctcaagctcagttcataattataacctactctcttcttattacggaccgttactagaaatgcatcgccggagcatttggtgacttc

SEQ ID NO: 4509 - DNA, 505 bp, Hordeum vulgare
  UNSURE (12): n stands for any base
gggtctgcaggnaattcggttcgaggacggggtccagagaaacggaggccttgcctgcctgcctaatcgcttgctcgcctctccttctccctctccaaaatggctgctgtttagttcttgacctgaggacagcgagagagagagaggaggtggtggatacagatcatttggagcttactgtcgccccgcaagaagctacaccgctgcacttggagctcctcgtttgccgttgctgggttggttccttctcctccctccctgcctcggagctctgaccgccgacgccgattcttgggaggtgccgagaaatggaggtggaggcgcacgagaagaagggccaccgggccttcgccaaggcaatcaagtccctcggctcgcacaggcgttccaactgcgatcttgacaagatgtgtggcaaagatgcgctctacgcttcagacaaaacatttgtccagcctaagcaagtggaaggcgtgaagactaaggtgaagagcgatttgagtaa

SEQ ID NO: 4510 - DNA, 487 bp, Hordeum vulgare
tccctgagacttgatggccacagaaaaagcgcacggcagcagcggaactagcaggcaaaatcgacaaatatgacccttagatgataaaaatttacaaactgaactacgttcgaaaaaaattcactcagctaacctttttatgtggcgcccgacacttagacgccacactatactgtgtgacgccttagccaacgacgccacacaaaaaaaccacgctggcgctggagggcctaccccggccgtgtgacgcctaagcctcgggcgttgcacatgctgcagtgtgacgtcgagcgtttaggagccacacatgcacagcagtgtcgagcacaagtacgggtcggcgggggcggatagctggaccggagcacggcatcgcctctgctcttgcaggaaaccctggcaccgggcattggattctcgtgcaagaggttgttgaccggagcggcgtctggccccagagctttctccagggcgtcacgcacgacct

SEQ ID NO: 4511 - DNA, 518 bp, Hordeum vulgare
gcaggaaccttccttcaggttgtaggaatccaaagccttctgcgaagaggaattggagttcaccatgctgggcttcttcctattgtgaaagaagtagttgagatgctgttttgtcgcggtgtgattaaggtactgttttccaccgagacatttgctatgggtgttaatgctcccgcaagaacggttgtgtttgatactttaaggaagtttgatggaaaggaacatcgaaggttacttccaggggagtatattcaaatggctggacgagctggtaggagaggactagataccataggtacagtgataatgatgtgccgagatgaaattcctgaagaaagtgatttgaaaaatcttcttgttggaaaaccaactcgactggaatctcagtttcgactaacatacactatgatactacatcttttacgtgtggaggaacttaaggtggaggacatgcttaagagaagtttcgcagaattccatgcacaaaaggatttgcctgagaaggaaaagctgcttct

SEQ ID NO: 4512 - DNA, 534 bp, Hordeum vulgare
gattttgttgattctacctacccagtctgggtgtcaacagcatcgggcggtactttcgctaaaaacatctttacacttgtgcgcttgttaagactgggtttgccaagaaactagacacccagaacaggaatttctctactttacaaacatggtcaggcccaggcgcatcatattcctgtgacatacaaacttgctgcgaagacgatgtcgcgcttgatggcgttggacgcgatctccatcttcttgtacagcgcagagttacccattatggaggcggcattcctgaactccctgcatgtttcatccagccgcacgattgttcgtacaatcagcccttcagatacgtctgtcagctcacatatgtccgcgaaaggcgttccctttgcccattcgtagacaacctcaacaagaccaaacttgagattatcacgcgcatactcctcaggatccacaggcacctcgtgcctcttttggagctgtcctaagctgattgccgtgtcatagagcctctttttggcatcagccagcttcgga

SEQ ID NO: 4513 - DNA, 558 bp, Hordeum vulgare
  UNSURE (20),(64),(74),(75): n stands for any base
gtctccccgggcctgcaggnaattcggcacgagggtgcgagtgtgagtccgtgagccgcgcagnagtgcgtgcnngtgcgagaccgccaagggcaaccagccaagaacgaggcctccttccttcctgctccctcctactacatgcactgtgggagaaggtgagagactgaggaggcgaggacaccgtgctgtaggcggcggcggcggcggcggaggccaccatgagctggaagaaagccggaggggatggaggcgtgtccaagcggtgggccgtgctcctctgcctcgggagcttctgcctcggcctgctcttcaccaacagaatgtggacactgccggaggcaaccgaggttccgctaccgaatcaaagcgtcgaggaaggcaaagctctagttgatgcagactgtggttcaaaaaaggttcaagaactgcaaaaatacaaagatgtattaccagatcaagatactcatcatgatgtacagacactagataagacaatagcgaccttagagacagaactctcggctgctagaaccctgcaagagtcattgctcaacg

SEQ ID NO: 4514 - DNA, 535 bp, Hordeum vulgare
  UNSURE (6): n stands for any base
cctttntatctagagtgagcctcagctgttacaaactcaaaactagcccagaatgcactgaaatgcaggattcagggacgtgttttattccggtcatacatctggggcagccaaacagtacaggagatcggtacagaatggccacctgcaacatttttccaccaaaagaatgcggcgacagctagctcgtatacccttcttcgccttcgccttcggcgccaccggcggacagacgctacgtaaaattgtggtccgcttcgtcggtgtcagccattcccagaaccaaaaccacagctatacctacaggatgaattacatacacggcaccgtggggcgatctagtatacaacaactaacaaacaaaccaacaggagaggggagcttcttcggcttcggtagtcggcgtttcgttcgcgctagaaggtggaattccacagcgccttgtcgccctcggcgcacttattgtgcacctcccagatcctgccttccgagttgcatatgccgctgcacttccagtcgaatgacgccgcgcagg

SEQ ID NO: 4515 - DNA, 446 bp, Hordeum vulgare
agccgcgagggcggacgacttcttgagccggtgctgcctctgcaacaagaggcttgatgggctcgacatctacatgtataggggggagaaagccttctgcagctccgagtgccgatgccaccagatgctgatggacgaccacgcagaaaaatgtggaccggaagccctcagagccaacagctactcagcctcgccatgctccgcgcccatgtccttctcccccagcgtcgcggcggcctagccgaccgagctgcctgatgtcgtcaagctgctcctcggtttgtagtagcagagaacatagagatctaaaagatcttttaagcgaattaaaacatagagtaattacttaaaaaaggtttctgaactgtggctcaaataaaagagaggaagggaagttttggggtcatgtccgccgcaagatgttcaaaaaaaaaaaaaaaaaaaaa

SEQ ID NO: 4516 - DNA, 420 bp, Hordeum vulgare
tcttgcggcggacatgaccccaaaacttcccttcctctcttttatttgagcccagttcagaaaccttttttaagtaattactctatgttttaattcgcttaaaagatcttttagatctctatgttctctgctactacaaaccgaggagcagcttgacgacatcaggcagctcggtcggctaggccgccgcgacgctgggggagaaggacatgggcgcggagcatggcgaggctgagtagctgttggctctgagggcttccggtccacatttttctgcgtggtcgtccatcagcatctggtggcatcggcactcggagctgcagaaggctttctcccccctatacatgtagatgtcgagcccatcaagcctcttgttgcagaggcagcaccggctcaagaagtcgtccgccctcgctggct

SEQ ID NO: 4517 - DNA, 516 bp, Hordeum vulgare
ctgagaatgagaagaacttgtatgatacaacggaatacttgagtagattgttaaatgctttgagtacagtggacattgctcgagaatttgatacagatccaatcaccaaggttggaaaaattggacaggtttaccttgacctacaggcaacagtggtttcatcacaaaatgaagtgaagaaattgaaacgagcaacagagctgcttctagctgagttgaatgaagctcatgagagggccgataacctgcaggaggaattagccaaggaagaagccgcactttctgaatcctctaaacagaacaatattatagagtctgcaagagcggatgctgttcgccaccttgaacatattacctatctgcaggcacaggcagcaaggaagcaaatagatcatttgaaggagctgaactctacctgtggtcaactaagagaggtctgctttgacctttcacatcgccttgccaacacattcagtaaagatgtggaccttatcagctatatggagagcttcatga

SEQ ID NO: 4518 - DNA, 550 bp, Hordeum vulgare
gtgaattgacatgcatgtatacagtaaacatttaagaatagtacagggggtcaacttttaagagggggaaacgctgttaccatcccaataccctagcttccaaaactactagtacatgtcaaccattcttctgtaaacctgtggtgtatagtgtagatgctaccatgtaagatgccctcaatctttctaaaagcaaagaatagagcaaacaaaaaatgagagtatgtacaggggatctctgctgctgctgctgctttctccggttctcttccatcggtactgtaggtgcaggtgccttgagttggacccatctgaggcagaaccaattccagcggaagaaaggggaagattggcaacaaaaacgatacacaggtgcccgttcggttcaggtattcagtaacaaacttcaaaaagaatcgacatcattttgactggattgcttgtgttgcatagcttgtcatagacatggcactgtacagtaagtagctcaccaaggagatccaccactacatcttcaaataaaactcacaagcaatgcatgcaatgctat

SEQ ID NO: 4519 - DNA, 878 bp, Hordeum vulgare
  UNSURE (18),(737),(826): n stands for any base
gtcccccgggctgcaggnaattcggcacgagggcgaagttatcttcatagtagaaggtatatcctcatcttggatgacctatgggatgctaatgtttggtttgaaatccgtgatgcatttgctggtggagatggttccagtaaggtagtgcttacttcgaggatccatgacgtcgcatcactagcaaaagacaagtacataattgatctcggaccattagaaagccagcattcatgggatttgttctgcaaagaagcattttggaaaatggaagataaaagttgtcctcgagaactggaagcttggggtcggaaaatcgtagagagctgtgacggcttaccgatagctattgtgtgcataggacggctcttgtccttcagaagccagacttgttatgaatgggagaaagtgcataaagatattgagttgcagctaacgagcaattcgatcattgatatgaacctcattttgaaggttagcttggaggatctgtcacacaacttaaagaactgtttcctattctgtagtttgttcccagaggtctacagggtcagaaggaagatgctgatcagattctgggtatcagagggattcattaaaagaagtgaaacaagaacagaggaagaaatcgctgaggattacctgaatgaactagttaacaggtgcctgctacaagttactaagagaaatgaatttgggacgagttcgtgaatgtcgaatgcatgatgtgggcccgngttcttgctctatcaaaatcaaaagaggagatgttttctgctggttatgactgctcaaaaacaacctcattactaggcaaagcacgaangatgtcaattcaaaatgctgattctgcgctttcaagacatgagatgagacat

SEQ ID NO: 4520 - DNA, 553 bp, Hordeum vulgare
  UNSURE (24): n stands for any base
ggagcaaaaactccctattgtttntatacaagcaatcctggtacttttttggctacaatcagagttacaacttacaaaaggtataaacccaaaaggtttctgtcagcagaaggcagcaaacgaacaatgtgagtgagtcacggcgcggcccgcggagaacatacaaggcatacacaacgcaaaagcttaacataaccatatctggcggtcgaaatttcagagcagttacaacatcatcggcagaggcacgcatcgcagggtgttggatcggatgggacactccaagcatcgccagtcccttttgttcctcttatcagagtgctggaaacatctgacgagaacaacacacattgaggggttatggatgatagttagttaccttgtagtagaccaaacaaacggcagcgggcggggagaatgcattcctacttcatatagactaaacgaggcgactctgaggcgttgcgagagtagccagctttcatctacttgagactaacctgccatgagaacatcccagtttgcttaccaattccgtttgcatagctttgag

SEQ ID NO: 4521 - DNA, 525 bp, Hordeum vulgare
tgcacgaggcaattactgacctgtctctaggtgccgttttcattggcaattaaagtaacttctattcgtgggacaatgcgcatgcatataaagcctcctccctcagatcaaatctggtatggatttacatcaatgccagagcttgtgtgggaattggagtcttcagttggggacaggaagatcaccaacagccacgtcgcttcgcttatcagcaacagaatcaaggcttcgcttcaccaaagcttggtactgccgaattgtgaaagtattcccatgtcatggatgatatcagagaaggatgattgggtgcctcgcagagctgcaccttttatatggctgaatcgtgaacacagcgagacagcaagcagtcatagttcaggcatgggtaagctccagcctgatgatgttgccgctagcaaatcaagtccacctgctccttcaactagaagcgacgacgaaccgctgaagaaggtgacatccactcgttggcctaacgaagaaccaagaacagaagcatcaaccagc

SEQ ID NO: 4522 - DNA, 555 bp, Hordeum vulgare
tatggagtctccttttgtattttatcagtataaatgatacaacacaactttgtcatttcccccacaaactaatacatttatgtaactgcaaactctccaatttctttctagaagtaattgccatgtatagatatatatactgtaaactatgctgggacagcaatggctccctaaaaccatgagcacaattcccagactgtacaacatcttaacaatggacgttccaaatttccaattccggcagaggaataagcaaggatataaattttggtaaatatgtacttctaactaactgggtgtttgtctccaagctattgctcctttccagaactctccttcatcttctcgacaatatgccgtgtcttttcttccaatttgccgctcatcttcctccccaaacacatcaccgcagctcgcttgctgcctttcctcttcaggtcatactccccaagagacgcggaggatgacaatggcggccgccgatgcccagcaggtaccaccactcctaactgaagagaagagcccactgctgcattttcagaagcatcttcctcg

SEQ ID NO: 4523 - DNA, 516 bp, Hordeum vulgare
ggatagagataaggtccaaagagctctccgtgcagcctataacaatccagaacgtgccattgactatctgtactctggtattcccgtgacagccgaagttgctgttccggtggttggtcaaggggcaaacaccactgctgcagctcctggagaaactggcctctctggaatcccaaacacagcaccgttggatcttttcccgcagggggcttcccatgctggaggtgctgctggtggtggatcacttgattttcttcgaaataaccaacagtttcaagcacttcgggaaatggtccatacaaatccacaaattttacagcctatgctccaggaattgagcaagcagaatcctcaacttctaaggttgattcaggagaacaatgatgagttccttcagttactaaatgagacatttgaaggcggcgatggggacttcttagaccaggctgaccaggatggaatgcctcatgctatcagtgtgacaccagaagagcaagaggcaattggaaggttgga

SEQ ID NO: 4524 - DNA, 514 bp, Hordeum vulgare
tcccataaatttgctcattctacaagttttttcaaattcgcaatgcaagtaacctaaggtgttgtgcatacagataataagttcaatcgagcattagctccatctcaacctgtgtagccattcgtcagtcaccatcaatttgggtcagatgttcataacaagctccaatgtgaactaaatgttctctattcttcgtcaccagcatgctcaagaagatagtttgcagcgagttgctcattcctgtcacaggcgaagaatgcttcgatgacacgtgctctctcaaaccccatggcttccaaccttccaattgcctcttgctcttctggtgtcacactgatagcatgaggcattccatcctggtcagcctggtctaagaagtccccatcgccgccttcaaatgtctcatttagtaactgaaggaactcatcattgttctcctgaatcaaccttagaagttgaggattctgcttgctcaattcctggagcataagctgtaaaatttgtggatttgtat

SEQ ID NO: 4525 - DNA, 430 bp, Hordeum vulgare
gtatcaagcaattctatgtcaatgttgagaaggaagagtggaagctggacacactctgtgacctgtacgagaccttggcaattacccagagtgtcatctttgtgaacacccgccgcaaggtggactggctcaccgacaagatgaggggaagggaccacactgtctctgcaacacacggagacatggaccagaacactagggacatcatcatgagggagttcagatctggctcttctcgtgtgctcatcaccaccgacctgctggcccgtggtattgatgtgcagcaagtctcccttgtcatcaactatgacctgccgacccagcctgagaactacctccatcgcattggtcgtagtggtcggttcgggaggaagggagttgccatcaacttcgtcacccgtgaagatgagaggatgctgttcgacatcca

SEQ ID NO: 4526 - DNA, 547 bp, Hordeum vulgare
tttcaaaacgaactttatcgagcaccttactgcattcctatgataataatctagagaaggtcggcgacattggccgggagctcctcaatgaccacgttgtagaacttctggatgtcgaacagcatcctctcatcttcacgggtgacgaagttgatggcaactcccttcctcccgaaccgaccactacgaccaatgcgatggaggtagttctcaggctgggtcggcaggtcatagttgatgacaagggagacttgctgcacatcaataccacgggccagcaggtcggtggtgatgagcacacgagaagagccagatctgaactccctcatgatgatgtccctagtgttctggtccatgtctccgtgtgttgcagagacagtgtggtcccttcccctcatcttgtcggtgagccagtccaccttgcggcgggtgttcacaaagatgacactctgggtaattgccaaggtctcgtacaggtcacagagtgtgtccagcttccactcttccttctcaacattgacatagaattgcttgataccctcaaggg

SEQ ID NO: 4527 - DNA, 518 bp, Hordeum vulgare
gtttgtgatgctaactttgtgctggagcttggcctggtggagatcctaatgcaattgaagtagcaacatctgctttaccaactggtgtatataatcaagctttgcattggatggctgttgcacatgctgaagcttatgactacattcattcagaaagcaagaatgcaatgatgccaatagttggtgtatcacatcatgtatcatttacacggccatatggtctatttgatgttgcggctgtcacaatagctaactcaatgaccctattcccttacatcgatagcatctgtgacaaattggactttattggcctcaattactatggtcaggaggtaatatcaggacctggtctaaagcttgtggaaaatgatgaatacagtgaatctggtcgtggagtttatcccgatgggttgttgcgcatcctacttaagttcaatgagcgatacaagagcttaaacataccttttatcattactgaaaatggagtttctgatgagactgatctgattcggaaacca

SEQ ID NO: 4528 - DNA, 553 bp, Hordeum vulgare
ttcagctgcatcttcagtacaataagaattttaacttgtttagacgttctggagataagaacaaactaaagcagaaggaaattacaaggtacttctactactacagtgaacagtatataaccatgtacatttgaaatgcaaaatgtgaagattccacttgccagaacttcttatgtgcttcgtccagaggaaatattacccaaaagtttgatgtttttttattgttaccaaagaaacagaacttgaatagctactacaacagcaggtctcaagaagaaatagaataagaaatcgcatcgtcctcaatgtagtgaatcttcttgcgtggaaatggtcgcataatgcatcttataaagcgactcaaaggatcctgcaagccttccatttcatagtggccaaatcgccagtcccgcaatacaaaagttcgctcaataggccgatctagaccccctgcatacatacgaccatgtttatctacttccctgtaaaatgggcgtgttttcttctgaatcgcagctttttgcagttccctccaagcagatgttctgtcatg

SEQ ID NO: 4529 - DNA, 501 bp, Hordeum vulgare
tccatcacctattccacctccggcactccggcttgcctgttggacttctccggcaccaccgcagctcctcccttcgaatcgctgtcacgcactcactgactcactctcacttgcagcacgcgagcaggctattgagttgagctaacagcagaaggagcctcgccattgagatgtctgcaccaatcatcagcgccaccatgggggcgatgaacaccctcatcggcaagctcgccgcactgatgggtgacgagtacaagaagctcacgtccgtcagaaagcaggcctcgttcctcaaggatgagcttagcgccatgaaagctctccttgagaagcttgagctcatggatgaactggatcccttggccaagaactggagggatcatgtcagggagatgtcctacgacatggagaattgcatcgatgacttcatgcgagaccttggaggtgccgatgcgaagatgggctttataaagaagacggctaaacgtctcaagacgctac

SEQ ID NO: 4530 - DNA, 552 bp, Hordeum vulgare
  UNSURE (29): n stands for any base
tgttactctccagtttataatgtactggngttttctccactacaattatttagttacagagagagtagtgcgtatagaattttctaagtcaaagttggaccaaatttatagaactgagggaaggcggaggtattatttgtaaggaaggtcgtcttgggtgcacatcgacgacgcttctgaaggcagactcgacatcacagagattgacgccgcatctagcaaatacagagatgtgatcgagggccaataggtgctccatacctcgaggcacagcaccaccccagccattatttatttctagagtgagctttcgtaggctgggcattagccctatctgaaactccatgtgtgcaacatcacgagagaatagagcaaggactttgaggacttggaataagcccgtgcagattacggccccaccttcagcgaacacccatatatacagatggacaaggcagggcagctttcccacaaaatgaacctcgttgttggataagttgtcgacccacaaatccaggacccgaaggaaatggaggtcaccaatccatgtgg

SEQ ID NO: 4531 - DNA, 548 bp, Hordeum vulgare
  UNSURE (1): n stands for any base
ntcccccggctgcaggccgcaacggaaccacaaatcccaaccaatctcgtctccaatcgacccgaggctcgtcgaatcctcctcccccgccgcttcaagatgcagatctttgtgaagacattgacgggcaagaccatcacccttgaggtggaatcctctgacacaatcgacaacgtcaaggccaagatccaggacaaggagggcattcctccggaccagcagcgtctcatcttcgctggcaagcagctcgaggatggtcgtaccctcgctgactacaacatccagaaggagtccacccttcaccttgtcctccgtcttaggggtggcatgcagatcttcgtgaagaccctcaccggcaagaccatcacccttgaggttgagagctctgacactatcgacaacgtcaaggccaagatccaggataaggagggcattcccccggaccagcagcgcctgatcttcgctggcaagcagctggaggatggtcgcacccttgctgactacaatatccagaaggagtccacccttcaccttgtcctccgccttcg

SEQ ID NO: 4532 - DNA, 551 bp, Hordeum vulgare
tatgaagttacttattattagttgatgatactgctgtaccagcaacagtttaaaccacacataacacggtgactctatagttcattaaaccaaccacagtaggacagacgcaaacgagaaaacagttcaattgaacagacagggcaccgcccaccggacgacccaggacttccaacgctagggcaattactgaccaccacggaggcggagcaccaggtgaagggtagactccttctggatgttgtagtccgcaagggtccgaccatcctccagctgcttgccggcgaagatcagacgctgctggtccggggggatgccctccttgtcctggatcttggccttgacattgtcgatggtgtctgagctctccacctccagagtgatggtcttcccagtcagggtcttcacgaagatctgcatgcctccccgaaggcggaggacaaggtgaagggtggactccttctggatattgtagtcagcaagggtgcgaccatcctccagctgcttgccagcgaagatcaggcgctgctggtccgggggaatgccctcct

SEQ ID NO: 4533 - DNA, 551 bp, Hordeum vulgare
  UNSURE (19): n stands for any base
gtctcccgggcctgcaggnaattcggcacgaggtacaggctcaactctgacatctgcgttgtcgatgagattagggtgcggccgtaccaagccttttttcaggatgatgaccctatatactcttcaaagacggtgcgatttcggatgggccattacaagcttccgcgagaatcagagtcgtttataattgatgatgatgagaataagatggtaaatgctgaggaaaagtacatgtggacttacacttcgccagagttccctatgttacagaaaaacgaactacaatccttcaagctcccacgccctgccctttgcattggtggtgtgttgatgattgaactcttgggcagagtacagaaacaagaagcagatgatatgtactacatatgtgtttgccatgttcaagtgttgggccgttcactctccccacttttcatggttgacatctcggatcctgaaggtcattcaatcctcaagtacttaccgggtgccaaagacctatccatcgatgaccttctgcaagatgataccaatgactcgctggagtggca

SEQ ID NO: 4534 - DNA, 552 bp, Hordeum vulgare
  UNSURE (26): n stands for any base
tgcaatccgtcccaaatggcatttantttgaaaagtaatatatgaccaatattcaccactaaaccgaaaacacaagagaaaacacgaccaggcttgagcagagttgcaaaccataagagcaagttgtctcagatcaggtcctctgggttccagaatcagcttcagaaatgtttgcaacgaaggcttgcagagttcagaggtgttcactaaactacaatgagtaaaaccatggcacagttgtaggtgcagtccagcatgcagatctactcacgataatcatcgtctgacatgccacctacatcatcttcatgatcatcgtctgagatgccacctgcatcatcttcatgatcatcgtctgagatgacacccacatcatgcatgtaatgtacaggctccagaagtgcactcactactgctgctctgcgattcatctgcctgtatctagcaacaagatggtgccactccagcgagtcattggtatcatcttgcagaaggtcatcgatggataggtctttggcacccggtaagtacttgaggattgaatgaccttca

SEQ ID NO: 4535 - DNA, 521 bp, Hordeum vulgare
  UNSURE (17),(25): n stands for any base
gcagggggtcgcgcggnccccaggnaaggaggaaggaaccttggtgcgccatggcggaggagtgctgcagcgcggacctgctggagtggatcggccccgacgtctcagcatgcgtcttcgaccgccttgaccaccccgccgacctcgtccgcgccgccgccgtctcccgaacctggcgcagatgcgtggtcgagagcggcctgagcaagagcctgtgcctgcggctgtgccccgaggtcgccaccgtcgccgcggcggcagaggtgaccagatcgccgccttcaaccgccgcctccgagtcagtcagcgagagggactacaggatatactcaaacctcgccggcgcctacgtctccgactccgcgaggccctccgcgggatgcatctcgcactgtatcggcgcctccagcaccgacgacttcccaatagagaccatggagaacaccctcgacgaggaggagattatcaatttccgcccctcctattggtcgagcggcggggcggacgaccccgaggcgccg

SEQ ID NO: 4536 - DNA, 527 bp, Hordeum vulgare
tatacagcaagtctacagtgtcatgctttcatagtgtgccattaagatttctgcaatccgtccacaaatggcatttatttgaaaagtaatatatgaccaatattcaccactaaaccgaaaacacaagagaaaacacgaccaggcttgagcagagttgcaaaccataagagcaagttgtctcagatcaggtcctctgggttccagaatcagcttcagaaatgtttgcaacgaaggcttgcagagttcagaggtgttcactaaactacaatgagtaaaaccatggcacagttgtaggtgcagtccagcatgcagatctactcacgataatcatcgtctgacatgccacctacatcatcttcatgatcatcgtctgagatgccactactgctgctctgcgattcatctgcctgtatctagcaacaagatggtgccactccagcgagtcattggtatcatcttgcagaaggtcatcgatggataggtctttggcacccggtaagtacttgaggattgaatgaccttcagga

SEQ ID NO: 4537 - DNA, 545 bp, Hordeum vulgare
  UNSURE (16): n stands for any base
gtcccccggctgcagnaattcgcacgaggcgcccgcagcctcctctgctcggttcctcccagccggcgccgaattccctgctctaggtggcagaatctcttcgctacagctttagggatgtcgtcctcttccacaatcgagggcaaggatggcgagttcaccgaggtcgtggtggtgcggcatggcgagacttcctggaacgccttgcgcatcatacaggggcacttggatgcagagctgaatgagattgggaggcagcaagctgttgtggttgctcatcggctgtccaaagaagccaaaccagctgccatatactcgtcggatttgaagcgggcggcagagactgcaagaacaatagcaaaattctgcaatttaccaaatgttgtgtttgatcctgcacttagagaaagacacataggagatgtccagggcctgacgcttcaagatgctgtcaaagaaaagccagaggcttacaaagcttttatgtcccacaagagaaaccagcaaattcctggtggtggagagagccttgatcaactgtcaga

SEQ ID NO: 4538 - DNA, 541 bp, Hordeum vulgare
ctgcatcactaaattttagcatcctatatgctgcgattgagtaacatctaatccatatccgtattcaagtagcatccgctccatatatcgcacccgtatgtgttacagcaaaaacatgacgacaagatggtaaaccgtatcctctacatgtaagaactgctgcaggtggggtgctcttaggctgaagacttgtcgcccccaaacgcattctccagaacaccggtggcctcaaggtggctaacatctccacacatcttgacaatgcagcggccagtgtcaccagaaacgagcacgacagtaaccgacgtgttgtgtattttgccgcgaagcggcatgggactggcgtgcctgtagagctctctgatggttcctccatgagataccaggataactcgctcccctctatgtttctcgactattttatacaggcatgagacacatcgctctgacagttgatcaaggctctctccaccaccaggaatttgctggtttctcttgtgggacataaaagctttgtaagcctctggcttttctttgacag

SEQ ID NO: 4539 - DNA, 269 bp, Hordeum vulgare
gagagatggggatccggttcgtgctgctggtgaacaagcaggggcagacgcggctggcgcagtactacgagcacctctccctcgacgagcgccgcgccctcgagggcgagatcgtccgcaagtgcctcgcccgcaccgaccaggagtggggtttcgtggagcaccggaactacaaggtcgtctacaggcgctacgcctccctgttcttcctcgtcggcgtggacaacgatgagaatgagttagccatccttgaattcatacatcttctc

SEQ ID NO: 4540 - DNA, 549 bp, Hordeum vulgare
ggagagcagccaagcagagtttatttacagaactgttgttacaagtaacaagtaagatgatggggtcttcattttcagcattacaggacatttcacattttccagtcgggtgaacacaaccacccatgcatacagcagttgtctggcatttctcctcacacaaaagaggaacctaggcgctcttgagctcacacactatttacgaggttttctccataagctggatgggcgccaatatgttctgtttgctcgtctccacgatgcaaccgttcatcaccatctcttcgagcatgaagtgcactttttccagatggaacatgatgtcgagctcgcacacgttgccaaagtggcggtccatggtttccacgagaagatgtatgaattcaaggatggctaactcattctcatcgttgtccacgccgacgaggaagaagagggaggcgtagcgcctgtagacgaccttgtagttccggtgctccacgaaagagcactgctggtcggtgcgggcgaggcacttgcggacgatctcgccctcgagggcgcggcgct

SEQ ID NO: 4541 - DNA, 1777 bp, Hordeum vulgare
  UNSURE (9),(16)..(21),(24),(29),(346),(565),(701),(992),(1011),(1136),(1141),(1198),(1237),(1263),(1397),(1421),(1583),(1676),(1713),(1777): n stands for any base
ccccccccnccccccnnnnnnccnccccnacgtgcccaacacaccagaccagagcgtacccacccgcgatctcggcgaggctaatttcggaatacgcaggcgtcagcgctcgactctccgagagcaattgtaaagaggctaatattgaccatgaacatatacgtagcgtgtactagtgcagatgtagcacatgctgagttggtacatggtgcgatgcacgtaccggtctctagttgtcgatagtgtgccgctctctataggtagctcgatgtcacagcatctacgattcgcgtatcattgtgagagtttcagtatctatgtgtgtgtaacgtcatagcgcctcganacagtgacacgtagaccgatatttgcgagctaagagtatattgatacgttcagttgtacgcgcatacgcaagatcgttggttaagcattcagcgctagatattgaacgaggttgtacatctttgtacaccgttatatcgggtccgcgtatatcactatatcgctacttcggcgggaatagtagttttgagccgctatggctcccgttgtatacatgcanccgggcggtcgttccacaactctctcgcgtagacgtgcgagcaatccttgccactcgtaaggcacgagaggcatacacacgtgactcgacacaccattgcacgtttccgtgtgtgtctctctatgttctatgcctncacagacagtggtagctttatgccaggagttagtgtatgtagagtctacactcactacacagttactggtcggcctcgttactacactcgcgaccggtgacaatggctctgtagtattatatcgtatgtgccttttttagtggtgggacatcttcgagtctaggccatgagccgctgtgagagtcgcattaggatagagagagaggtaggagagtattagttctcttcggtcgtggtgggcgactccaccgctgacactacgttaattgacggatcgcacgatttacgagngagatttcgtagccgttgnttaccagtcgagtgatcaaattgtgtaactcgcgccacccgcacttcacttgcttctgaacgatcgaagatctaacgttacgtcgctgtcgacccgcaattatagtgtctgttatcacacagtanccgcntgtcttcgcgtctgacgcaccgcgacgcttcatcgctcgcgtattagagtagatgtntcgcgtacgcattgtctatacgcgagttagagacgaganatagacgcacgagagcagagtgagantccggaatgtcaccgcgcgcgtccataaatggatctttaccattgtacagcgcgctccgtcttttatatgcgtacgccgtccctatcccgtgcctgtagtattcacccacacaagcgtgtgtatcgcgccagtnctagcaacaccatacgcgtctctntatccgtcgctgattacttgttcgcagcccgatgagtccgcgttcttatcacatgtactcctacacgtgccgtcacgtccgagattagttgtccggccctgcagcccatatatagaggacagagcccgacgagttgtcagcgcgcttcactgactcccgttntctgttcacgcgtgccgctattacacataatcatatgagccagtatatagaggcatcagagagagccgtcttattacgtaagcattctcgtcnatacttatcgccgatccccgtaaaacgttcgtaacanatcacgagctagccaaatgtatgccgattccgaggtgacacatatctactgcgagtcattgttn

SEQ ID NO: 4542 - DNA, 554 bp, Hordeum vulgare
taatttcctgggcttataatatagtagttctggtcaatgtccagaatcccatagatgtttgttcactcacacggattccacatatcacatagttacatccattacctagttcagagtgttcctagatatggcaatggccgcatgccatgatttctgttatggctattcaataccttcggtcacagtgaacacaaaatttctgcagtgcacaaaggtccccaaaattgagcgggcttttggtaaagaaagaatatacaacatcagaagaaaatacagcaacataaaggagctaaaaagaaggggggaatgccaaatggtaggcaactgatctataggaacagggtaaacctgatgaaccagtgacatgtctgtcaacaagtcatatgacactggctgttcgaacacatcatgcggctgttgtgacggcaaactggtactggcggttgcaacgctccacgtggattataagtgctgccaacaaaggtttcggtaggtactgatgataccatggcggcagtggttgcatctcgtcgtgttctgttgtggtagacctg

SEQ ID NO: 4543 - DNA, 524 bp, Hordeum vulgare
gcacggcttccgcgtgctaggaagacgaagaagagtagcagcagcagggagagggaggccgcgatggaggtcggcttcttggggctgggcatcatgggtaaggcaatggcggccaacctcctccgccacggcttccgcgtcaccgtctggaaccggaccctctccaagtgcgacgagctcgtcgcgatgggcgccgccgtcggggacacgccggcgtccgtcgtggccaagtgcaagtacaccatcgccatgctctccgatcccagcgccgcgctatctgttgttttcgacaaggatggtgtgctcgagcaaatcggggagggcaagggctacgtggacatgtccactgttgatgctgcaacttcttgcaagataagcgaggcggttaaacaaaagggcggagcttttgttgaagctccagtttcagggagcaagaagccagctgaagatggccaattggtcattcttgctgcaggcgacaaggcactatatgatgacatggtccctgcatttgacatacttgg

SEQ ID NO: 4544 - DNA, 558 bp, Hordeum vulgare
cagataccttatgcccaagcacataattcgaatgtacgtacacatcaatagtacgatgataagccacatgggtaggaggaactacaagaatatctgcatgcccatggcacgtggttttaagcattcagcccccggtcacgctttagcctgaaccacctgtgcctttcagcacctcgtgcaccgcagaaaaatccaggtcgccaagtcccaagcttcttgctttcttgaatgcctcattagcagcagctgcgactggcatggagacggcattttcatctcccaatgacagagccagcctcatatccttctgctgatgtttgaggggaaatgctggattgtagctgccctgtagcatcgaaggccctttcatcttgaacatcggatttgcgatggcaccgagatccaggacatcaagaagcgtctgggggctcaacccacttttgtcagccaaacagagtccctcggagaaagcattcatcatacttcccatgatcatgttgaccaccagtttcatctttgctccatttcccatctcccccagaaagaacgacttcttcc

SEQ ID NO: 4545 - DNA, 173 bp, Hordeum vulgare
gtccccccgggcctgcaggaaattcggcacgagggtttgcttgtttgtgatgcttgtgagagggcagcacacttgaagtgccttcagcattatggtaataagggtgttcctgtaggtgactggcattgtccacatgtgtagcacagaataagggtaaaccccttcaccaaaaa

SEQ ID NO: 4546 - DNA, 556 bp, Hordeum vulgare
gcggaaatgccctattatgacgcaaacactcagtacccagtcaaagcatgtctaattacagcaccgcagagtaacacggagcaacagaacgaatcagctaactagaaacgcataatgaaccacataataaagtacaacaacctcacgaggcaccaagaggctctgggcacctcgacgaaaatggttgtccatcactaataaatctaaataggtgatccaggagaataaagagagcatggctaatcactgatgctgctagctgaactacaggtgcatccttcatgccccccatctgcaaaagtaaattggatgcaaccctaacatctgaatctagttgttgtcttctcttagtgccgcactgcaacccacaaggtcaccctccttagtctcctgactgcataaagcttcatctgtggcgggtagcaccccatttggaattaactgatggttggtgtgatgatctgacatttcgctgacgtcagacttatctatgcatgcctcttcatgaagaggttctcctactccattttcagttgatccatctgctagttgtgtg

SEQ ID NO: 4547 - DNA, 10 bp, Hordeum vulgare
  UNSURE (1)..(10): n stands for any base
nnnnnnnnnn

SEQ ID NO: 4548 - DNA, 511 bp, Hordeum vulgare
atcgtattaattgtgcgcacacacggaaatgacagattggcatacatggatgcacgcgaggatagtgcacctagctacatactactgaaaacagcttccaagcttcttgctgatcagcatagtctaactaagcttcctctgtaaactaatataagaacgtttagaacactaaagtaataagctaaacgctcttatattaatttaaggaaggagtacatactactgaaaacagcttccaagcttcttgctgatcagcatagtccacctagctacacactgaagatactctaccgacctagcgtagtcgagctgggtgcatactggaaacggcttcgatcttgctgatcaatgagcatcggggccacaaatctagctaacactttagtggccttgtgcttgcttatagaggaaggttggcatgggcagctcgctcgggtctggcgacaggatgaatgtcgggccagcgaagaatgatgcctccgaggttgcctccatcttagccaagggcttc

SEQ ID NO: 4549 - DNA, 431 bp, Hordeum vulgare
cctcgtgccgaattcggcacgagggcagatctttgtgaagacattgacgggcaagaccatcacccttgaggtggaatcctctgacacaatcgacaacgtcaaggccaagatccaggacaaggagggcattcctccggaccagcagcgtctgatctttgccggcaagcagctggaggatggtcggacccttgcggactacaacatccagaaggagtctacccttcacctggtgctccgcctccgtggtggtcagtaattgccctagcgttggaagtcctgggtcgtccggtgggcggtgccctgtctgttcaattgaactgttttctcgtttgcgtctgtcctactgtggttggtttaatgaactatagagtcaccgtgttatgtgtggtttaaactgttgctggtacagcagtatcatcaactaatgaata

SEQ ID NO: 4550 - DNA, 442 bp, Hordeum vulgare
tatgaagttacttattattagttgatgatactgctgtaccagcaacagtttaaaccacacataacacggtgactctatagttcattaaaccaaccacagtaggacagacgcaaacgagaaaacagttcaattgaacagacagggcaccgcccaccggacgacccaggacttccaacgctagggcaattactgaccaccacggaggcggagcaccaggtgaagggtagactccttctggatgttgtagtccgcaagggtccgaccatcctccagctgcttgccggcaaagatcagacgctgctggtccggaggaatgccctccttgtcctggatcttggccttgacgttgtcgattgtgtcagaggattccacctcaagggtgatggtcttgcccgtcaatgtcttcacaaagatctgccctcgtgccgaattcggcacgagg

SEQ ID NO: 4551 - DNA, 524 bp, Hordeum vulgare
gcaccgggtggtactggtgcagggatgttgttgtcgccgttgtccgatggtgcggttagggtttgtggctggtgctccatgagattggctctccgttgcacctttggatgctactctgacttcgatgatggttagatggtactactgctccgtcgactcctggttccaccatctttggctgcatgtttgggtgtgtaggattcccattgtttgaacaacctcctaatattctaattcatccagaggtacaaattttgaggagtcaaccttttttatatgaagagggaaaacacctttgtttaacaaaaattgcatatatagctagacccgtattacatgccaggcagaagtgggtagatcatgaattgttgtcatctatcttggatatgttggcctttcttacgcattgaccttatttttaaataatgagcttatatgggacgactggtgaggtttccaaacaacatatggagcataattcatgaatttttgggcccccgagttgatgttacaatccatttgct

SEQ ID NO: 4552 - DNA, 548 bp, Hordeum vulgare
tttgcatgtcttaaaatatattcataccgacaaataaagcttgcaaaaaaattcagttacatataggaatttgtttatctggcatacatacagaggatggcatgatcatagtatatacacgaggctaacaataagtcttgtgcgggtacaaaagcgtatggtttgttcagggcggcctgagttgaccgatccagtaatcctctttttccaaagctaggaatatgtatgtaatttagttagtaccttccttttctaacacagttcttgtggttgcgacagtaggcctcgaggtcgtcgcagggctcctcctagtcatagctactccatcccacatccatgaacccgacgtaccggataccaactgctgcgagagtcatcccaacataagtcaggtcagaaatcatcacatacatgtatccagttccatgctgctgaaaaccatttagcatgtcaatagaggggggaaatagcacatgtgcatcagaagataggtacagtttgaaagaacatatatatgtatgaaagcaatatcatgcaagaagtctcac

SEQ ID NO: 4553 - DNA, 549 bp, Hordeum vulgare
  UNSURE (12): n stands for any base
gtcttcccgggnctgcaggcaattctcacgagggctttttgatgaaaagcgccgggctatgggcttaggcattgctaccagaagagctccccacatggcatttctgggcaatccaggaacaggtaaaacattggttgctcggattcttggaaagctcctacatatgattgggattctctctactgacaaagttactgaagttcagcgaactgatcttgtcggagaatttgtggggcatactggaccaaagacgaggcggaagatagaagacgccgagggagggattctgttcgtggatgaagcttacaggttgataccaacgcaaaaatcggatgataaggattatggtttggaggcactggaggagataatgtctgtgatggacagtggcaaagtagttgtcatatttgctgggtactgcaagcaaatgaagcgtgtcattgcctcgaacgatggtttctgtaggagggtcacgaagttcttttattttgatgatttcaccacgacagaattagcggagatattgcttctgaagatgaatagcctgac

SEQ ID NO: 4554 - DNA, 556 bp, Hordeum vulgare
  UNSURE (27): n stands for any base
gtatcccgagaccgaatagtccacttnctatcaaaactcctgaactgtaacttggtttgtcaagaaaaaaatgttcctgattgttttcgagaaaacgcagtgacattcatgcgtttctttgtattgaaaaggtagagtttatgttacaatcctcctaggaggggtcaccgcaaatgtcgctgtctcgagatctgccttaggcctgcttccaggtcttccaatgtgattgtgatcatggtctcagcgtcattgcaactgaaatcaagacgaagatccaagttttcacgtgcattgacaagaagtgtgtctaccagacctccgttcatctgtttaagccactcctcagtagtttccctggcaatcagctctccaacagcacctctggtgcagctctggtgcagcctgaacccgtaaagcaaactagtgtcagtcaggctattcatcttcagaagcaatatctccgctaattctgtcgtggtgaaatcatcaaaataaaagaacttcgtgaccctcctacagaaaccatcgttcgaggcaatgacacgcttcatttgct

SEQ ID NO: 4555 - DNA, 518 bp, Hordeum vulgare
caaggttgtaaaggtggagcattgtgaaagagtgcatattattgcagctgcaaaacgaatctgtattgccaactgtcgtgagtgcatcttctacctgggagtaaatcaccagcctcttattgtgggggacaaccataaattacatattgctccatttaatactttctatccaagattgggtgagcacatgacacaagttggtgtggatccctctacaaataagtgggaccaaccgtttgtattgggagttgttgatccacatgattcgttgtcccatcctgctggggtttctgatgttcaagccgaatctgctgcttgtgtagatcctgatctattcacaaactttttgattcctaattggtttgaggatgaagtacaagagcctacaaagtgcaatccttttccattgcctgaaatttatcaggcatcgcaaaacaagaagcaagctgttctggaagatactaaaaaaattattcgggagctgcaacttgacgaaaataggaacaaggaattagcaa

SEQ ID NO: 4556 - DNA, 552 bp, Hordeum vulgare
tttgaaatgtcctttgttttgcaaagttgagtggttaacaatgcctgttacgtattcgtggaacttctggagagcccaaaaaaactgtggaaaccgagaccaaatatcctaacaacctaatgatattggggggaaacatatgaagctactttgcaaaaggcaaaaaggaaagaaaaaaaaggcaaaaccacctgttcctttttacatttttctttcagggttctacagggctgaagacagggcggaaaccactccttagagtaaggtcagcttcgactacatgctgtcgaatgtttcaggagtcccaccagctagtcagcaaaggatggaaaacagtcttgtggatgcacacctctgttgacgaaagcagcccacggcatggttagtcaccttgcagacagtagagctggcggatgttgcctgtagcgtatagccaatctttgaactgcgagtgaagggcacttgctaattccttgttcctattttcgtcaagttgcagctcccgaataatttttttagtatcttccagaacagcttgcttcttgttttgcg

SEQ ID NO: 4557 - DNA, 387 bp, Hordeum vulgare
acactttcatctcagtctctaccacacacaccgcgtctgcctcatctctcggagcagcaggaggaggagcttgcaggaacaatggcggcccagggtcttctctctgggaggcagctgctgggtaggcctctgcagtcttccttctccaggtcgtcttcctcccggaagtcccccttcgtcgtcagggcatcgtccagcccccctgccaagcaaaatgacaacaggcagctgtggttcgcgtccaagcagtccctcacctacctcgacggcacgctgcctggtgactttggcttcgaccccttggggctgtccgacccggagggcaccggcgggttcatcgagcccaggtggctggcctacggcgagatcttcaacggccggacggcg

SEQ ID NO: 4558 - DNA, 395 bp, Hordeum vulgare
ttttttttttttttttagagatgcaatgcactaattttcatagcacgatataaatattacaagcatgcacgcagcacgcgtacaaatttacattttacacccaccctcgcatatataccgctcgcgcgctcacgtttcccacgacgacagacgggtaccatgcacaggacgacgatgctcggatttcgcctagtggaacttgaggctggtgaggatgttgttgttgacggggtcggagaggtggtcgaggaggttctggaagggcccgacgccggtgaagatggcctgcagcgacatgccgaggaaggcgagcatggcgagacggccgttcttgatctccttgagcttgagctccttcatctccttctcgctcttggtgccgaacccgagtgggt

SEQ ID NO: 4559 - DNA, 520 bp, Hordeum vulgare
ggttgaaacaaagccttccagtgctataagtataattgagactgattgtgaggttgacttcgccccaccacttgactataaagaacctgagcggccaaaacctactgctcctccgagcgctgatcctgctgcagaggctcaagttgaggaggaacctaagttcagccccttcactggtcctggtaggcgcctggatggcaagcctgctaaagatctggatgcgtcatcctcttcgcctgcaaagcgacaagctaatgcaaccaacagtgttcagccatcagcagcctccacctcacagagcaccgcgcctcgtaaaaccacgggaaaacttgtctttggctctggcggaagccagtcatcaaaaggaacagaaaaggtacccgaaaaggatgcaaaggaggacccgaagaaagaggagccgaaattttcagcattcacgggaaagaagtactccttgaagggctgaatgtccagagtatgtatttatcacttatcagcacttcctatcacaaacatcatc

SEQ ID NO: 4560 - DNA, 544 bp, Hordeum vulgare
  UNSURE (5): n stands for any base
ctggntcaaagccttaaaactgcccttgaagtccaaaccaatagcgcagacaaacgcaaaatgtgtaggaactcactaaaaatccatgaccagacattaaaatactttttacaaatcagtcaaactgacccacggtggctgacataaggatcagttgacaggaaagaagcattgatactccaccaaaagatgccccagctcccaaaagggatcaggaaactaaacaatagctgactgaactcttctccctgatgatgtttgtgataggaagtgctgataagtgataaatacatactctggacattcagcccttcaaggagtacttctttcccgtgaatgctgaaaatttcggctcctctttcttcgggtcctcctttgcatccttttcgggtaccttttctgttccttttgatgactggcttccgccagagccaaagacaagttttcccgtggttttacgaggcgcggtgctctgtgaggtggaggctgctgatggctgaacactgttggttgcattagcttgtcgctttgcaggcgaagagga

SEQ ID NO: 4561 - DNA, 393 bp, Hordeum vulgare
tagtacctgactgctgctaaaaaatctgggtcattcgggtaagatatgaggctttgcattgtcctgatgtatgaagatggtttgcccagcatcattctcaggccaagctgattgtattgctggcaatagattatctatcatgaactctctcatcacttgaccgttaacttttatggacttcgtctccattgttcctctaggcctattgtcactttttctttgagcaggaacttctttcacaaacggccaaattccaattttcccagagaaggtcacatttcctttactatcccactttggtctagcaactgttaggaagtattagtattagtctaggagtccttattagtctattagtattagtctaggagtccttattagtctatgtttact

SEQ ID NO: 4562 - DNA, 506 bp, Hordeum vulgare
  UNSURE (506): n stands for any base
tcgatcaactaaaagcagaccaggaccaagccttcgatctggcagaagcacctgctcgtgcaggcaaggcggacgggatcgtgagcaaagaaatagaacgggcaaagcactccttggtagtagactggaaaagagacggagccggcgccctgaggaacagcagcggacggcgagagcgcagacaagcagcaggagatggggtccagcggaacggcagaggacggaacccacctcggggtagccttctcctccaggcaggtagacgcggcggcagctgatctggcgaggggcgagattcggagaggggcgagatccagcagggtggaacgaagacgacgggaaccggcagaggatgccagaaaccggatcgggagccagcggccgggagagctgcagaagacctgcgggcctgcaggagaggtagcagcaggaggatcggggagcagcagcctcgatcccgaccaagagcgggacgagctcgagcgggaccggtagctgcgatcggn

SEQ ID NO: 4563 - DNA, 517 bp, Hordeum vulgare
ctctcctcgtctcgacgcgcgcgagagagacaggggaagaaagcccaaaaccctagtccccatcgccggcggcgagatggccgtcaacgaggagacgtccgtctacgtcggcggcctgccctacgaagccgacgaggatatgctccgcaactactttgggccctgcggcaccatcgtctccgtcaaggtgataaatgatcagagagtcaggggcaagtgctatgggtttgttacttacactcaacatagggctgctcagcgtgctatcttggaaatggatggcaagcaaataggtaatcgtgctgtgagagtaaatgaagtgcgtacaagaggcaacacccgtgattttgggcgtgatggcttccgacgagatcctgtaagagatggaagggatgtatactgggaccgaagggatagggagaggagttatgatcgtcaccgggatagagatccgtaccatgacagggatagcgatagacctcgtgaccatgatagagacagatatgatgaacgtggg

SEQ ID NO: 4564 - DNA, 549 bp, Hordeum vulgare
tggaattgcgctggttgatatactgcgggcagcttacattacaaacggggaagtctgcgacaaaaaggtctgtacggcactaatcaatgtgcgaaggaacatggtttcctagacttcacctgcatgagctacttactggttacggttctactacatggtaagtaataattctccgaaatcagcaccgtgagaagtgatttcatttttgctttgagattcagaccgtgccgttctcataccctgaaccgtctttggttgtagcgtcttcagccatgtcgacctcagccatcgcagaatcaacaagagccttgagatcctcttctgcggtcttggccctgtcattgtagtcttgaagttgaagaaaacttttgtacagctttgtgacagtcaattgtcgctctgaagaaactttccgcgcagcagccaattcatcctccagtttctgaaatttcttttgcaaatctgcaatgtggtgatctttgcttgtaactttatctttgatctgagaaacctcattttcaaggtcttcatgcatctgaatagccttgt

SEQ ID NO: 4565 - DNA, 517 bp, Hordeum vulgare
cgccgccgtctccgccgccggcctcttcgacggtcccctcctctccgcctccccatgcttccgccaggaaacgctcaacatgttcttggggttgggccggccggcgtggaaggaggcgcgcgccacgctccagaaaatcctctcagctgatgagccggtgttgcgtgacaacgaggccttgaggaagaactgccttgtgccaatgagtgatgtagagatgcttctacctatcacggtgggagactacacggatttcttttgttctgtgcaccatgcaaggaactgtggattcatcttccgtggaccgcagactccagtcaatccgaattggtttcatttaccagttggttaccatggacgggcatcatctgtaatcatatctggaacagacattattcgacccagaggacaaggtcatccaacaggaagctcccaaccttatttcggtccttctcaaaagcttgattttgaacttgagatggctgccattgttggaccagggaatgaactgggcaag

SEQ ID NO: 4566 - DNA, 557 bp, Hordeum vulgare
tcgaggaagtacgacatttaatataagtatttaagtaatcatgttatcacacactagtaaatagtaatcgcgacatctctcttctcctaaagttcagggaatgcacctcagcatcatatataccatcactactaagcccttgaagatacatggcagctctgctttattccaagaaatgaagatcatcctccctgttggctcatggcagtgacggcacgatcttcccggtgcaggttccgaatccgacgttgtagtcctcgcccttgcaacaagctgtcaagatgacttcatccccatcttggaggaacttgcgggtcgaattcccaactgatatctccttctgcccgttccacgttatctccagcaagcatcccaaagagtccggttcaggtccactgagggtgccagtcgcaaacatgtcccctggtctcagattgcatccattaacagtgtggtgtgctagttgctgcgtcacagtccagtacatatgtttgaaattggtctttgtgacaattgatgcgtcactttgttctttgggcttaatccaagcttcaaga

SEQ ID NO: 4567 - DNA, 373 bp, Hordeum vulgare
acctccaccccgcagtagtagcagcagctgcatcaccatctcccccttgctttcttcctcggatcggaaggggagagggaccggccgacgaggaggagcggcggcgggatgagtctcttcggcctcggacggaatcagaagacgttccgtcccaagaaaagtgctccatcaggcagcaagggggcacagctccgaaagcacatagatgcaaccctcggcagtggaaaccttagggaagctgtgaggctgcctcctggagaggatatcaatgaatggcttgctgttaacactgtggacttctttaatcaagttaacctgctatatggcacactcacagagttctgcacatccgagagctgcccatcaatgactg

SEQ ID NO: 4568 - DNA, 281 bp, Hordeum vulgare
tttttttttttttttttttttttttttttgctatcacaacccaacccaaacatgcatgttatagcagtacaaccgcgtttgcacaggagaactgctgaacatgtacaaacaaatacatcactagtaatgtacatgttttttatgtcaaagaaatggaacaataagatttgtgccagtaaattattggcgcggatagcccaatcgctcaaccattcctgtagaggactcagtagcagccatgtttagttcggttcagcctcagtgtttccttctcagtaggg

SEQ ID NO: 4569 - DNA, 194 bp, Hordeum vulgare
  UNSURE (155): n stands for any base
gcatggctgacggttggtcgagtggacatctccgaagcaccccagccggctcgcgtaccaggcgaacgaagctcggccaagggtcgcgccgtggtcggaggtggaggggtctgctggcagctactaacctgcagcacatgccacgactctgcagnctccagaatccgcctagaagacccacaagcctcaacgcg

SEQ ID NO: 4570 - DNA, 555 bp, Hordeum vulgare
ggcagattgcgtagcttaattacactagttcgatcatcaaacattatacgtagttaattatgctaccacatgcggatcttaaaaactttgttaaccatggaacgacacaagttaaaaaatacaagtccagcaacgtgcagttacacgctttcacagcttcagcaaggcggagaaagctcgggtcctcacttccacagcttccgcaaggacatgttcttctcattgtccttcttcatcaccttggccaccgccatctcaaagtcctcctgcgttacgtgcacccttctctcgcggagagcaaacattccggcttcggtgcacaccgcctttagctcagctcctgaagcgccattcatctttcccgcaatctttttcagatcaattccacgcatcaagttcatcctccttgaatgaatcttcaagatgtcacctcgtgaatcctcattaggatttggaaattcaatcttcctgtctatgcggccaggcctcaaaagggcttgatccaagatgtctatccggtttgttgccatcagaaccttaattttgtttgatgct

SEQ ID NO: 4571 - DNA, 553 bp, Hordeum vulgare
  UNSURE (20): n stands for any base
gtctccccgggcctgcaggnaattcggcacgagggggaaagcacctgcacctggcggcggtagttcatcgaggaatttacttactcgctcctcggcgctcgccggaaaatcgtccgtccgtgtcggcggcagaaggaaactacggatggtggaggagaaggtcagttcctctagtccctccattcgcccccctgtaaatctgtccttgcggatcgatctcgcggcgacgaggcggccatggagccggatctggagatggcggccatgagaaagaaagtagaggatgaggtgcttggcacctggctgtgggacaaggagctggattccatcctgcaggaacagcaagagcgagacgacgaaggtgattacgagtactacgaaccagacgaaccacccggatcagatgaagaagaagaggagctccactgtggttcttccgggtacggatatacattctactacgacgacgggaacccttactacgtcgccgacatggaggagaggtgggagaatcagatccagtttcctccgaccatgcccagcgccaagggat

SEQ ID NO: 4572 - DNA, 555 bp, Hordeum vulgare
gtatatttgtacaaaaccgttggacatataaatctatctgtacaaacgtggaacctatgggtaaagagtggaattaactctaaactaatcaatgctaactaagaaaacacttttatataaaagtatattgtacaaaccttggacatataaatcttagtgacatggttcacacaggctagaccatgtgaccttcactgacattacaagaccgtacatattacttgaaatttttgtagagcttccactcttttgcggttcaaaccacaccgtgtcaaatgtaatatcctcaatgtcgtaatgaaaatatccgggaattttcaaatcaccaacaacgccatcaggatagcaattatcatcacctgagggacggttgtgggtgtatagtctatagtcaaattctcggtgtaatccacacaaaccgtgaccggtggtagcctgcaaacacgcaacttgccattgaagactgaaagagcacccccttgcatggttctatagaccgcagttatcgtaagtgaatcaaacaaattgtccccaagatgatgaacctcaaactcc

SEQ ID NO: 4573 - DNA, 537 bp, Hordeum vulgare
  UNSURE (3): n stands for any base
ggnctgcaggcaattcggcacgaggcacacgctccccctcctccgctccgctgatcccccgcaaaccctagccccggcctagccactccctcctcctcgccggcgaccgactgcgcgcccgagcccgcccctgcctccgtgccagcggccgagatgccgccgcacggggatctggaccggcagatcgcgcacctgcgggagtgcaagcacctcccggaggcggaggtcaagggactctgcgagcaggccaaggccatcctcatggaggagtggaacgtgcagcccgtccgctgccccgtcaccgtctgcggcgacatccacggccagttctacgacctcatcgagctcttccgcatcggcggcgagtcgcccgacaccaactatctcttcatgggcgactacgtcgatcgtggctactattcggtggagactgtttcgctgttagtggctttgaaagttcgctacagagacagaattacgatattgagaggaaatcatgagagcagacaaatcacgcaagtatatggcttctatgat

SEQ ID NO: 4574 - DNA, 551 bp, Hordeum vulgare
gaaggggatctccaaacaaaagaattgattgaatacagctcgggccccatggagcccgtatctaaggacacaagatctacagactccgacgctgcggaggagaggagcatcaacactggtggtaagttaaagaggtcaacaccacaattacaaaaagtagtcgggggtcttgcgtgttgtgtcaggctcgatttgccgaggcgctggatcaaactggaggaagttacgatccatgttttccccaatctcgagaatcgcagccatgttaccacaccggtaacagtagtttggcgcactgaagactgttacaacattctgatcctggcaccaattgaatccttccattacaagttgatgggcccttgatatgagagagagaccatttgtatgattgaactgttgtgcaatatcttgcccaaacgtataacctgctcctcttggtgaaatcccccatccacatcgatcgtctggatcagaccacaaaagatcgcacatgggcccttcatgaggaacctcttgtatgcgatcaagagcacgaatgttgtctaatg

SEQ ID NO: 4575 - DNA, 230 bp, Hordeum vulgare
gtttatgtgacggcctacgacatcctcttcggccaggagattgtagtttctggatctgtcgaggagtacattatgctacataaagatacttttaagattgctcttcagaaaatatgtgttaaaaggaaagtcagtaatgtcgaggatttgttaagcgagaaaactacagtcaaaccaaagcccaggtttgttcgtgtaaacacactcaagaccacaacaggatctgttat

SEQ ID NO: 4576 - DNA, 541 bp, Hordeum vulgare
tttccgactatgtgcaagctcgggtgcaattagtggtaatacacgttgctttttcgatgttaattgctccaaaactgaatgtgcacaatggccttatagtttataattccgcctacagatcggggaaacacaaaattcagttacaagttcaaagccggcttcgttcagctgcggctaccaaaagaaatcgctcaaagatcctagggcaaacgtctctaaagaccccagatggagcagagcacgtccatcctggacaatctcaaggagctgaatgccctgagacctccacttcgcgttgtgcaagctcgtttccttttccttggcaacgcgccaccggtgttgctaggctccaaagcatcagccgcagctgctttcctcacaaacagcgctatgaagaatccctcgaggtcatcctcagggtctgtccgaagcaaatgctcggctccgtcgaagactggaaggccacggcgcctccattgagggaatggggtagagagctcgaaacctagtgatgaagctaaaggcagcacagagctgacga

SEQ ID NO: 4577 - DNA, 543 bp, Hordeum vulgare
ggctgaggaattcggacgaggagaactcgacaaattccctagtcagttgccctgttctagtgattcatggtacagctgatgaggtcgtcgactgttcccatgggagggcattgtgggaactcgctaaagtaaagtacgagcctctatgggtcaaaggaggaaaccactgtaatttggagctctatccagaatacatcaagcatctaaaaaagtttgttggagccatagagaaactgccacccccaaatgatgaatccccagagagctcaggtgcatcagaccgtacccaaacagagcccgaaggcacagaggagccgaggaaaagtgtagaccatagggagaagacgaggccaagcttagatcatagaaagagcacagaccgtcgagataaaccgaggggcagtacagataggagggacaaaagcagaaagagtgtagataatcctgacagaccacgagctagcgttgatcagcccgccgataggccaaggaaaagcgttgaccgcttcggaggtatgatgaaggctgtcaggttgcgcaaca

SEQ ID NO: 4578 - DNA, 559 bp, Hordeum vulgare
agttaagttttatttactctacaaggaacacaagaaaacagaagccattacaaatcccccactgtattgagatataccgcctacagccgaaccaatcacccaaatgaattaacttacacggatggaatacatacagacgaggcacccttcaaaacaccactgacctttcttctggtatctatcttcagctcccggaggaggttgtcggtaccttgaaacagtcaatgttgcgcaacctgacagccttcatcatacctccgaagcggtcaacgcttttccttggcctatcggcgggctgatcaacgctagctcgtggtctgtcaggattatctacactctttctgcttttgtccctcctatctgtactgcccctcggtttatctcgacggtctgtgctctttctatgatctaagcttggcctcgtcttctccctatggtctacacttttcctcggctcctctgtgccttcgggctctgtttgggtacggtctgatgcacctgagctctctggggattcatcatttgggggtggcagtttctctatggctccaacaaactt

SEQ ID NO: 4579 - DNA, 430 bp, Hordeum vulgare
cggctctagcacagccctccgcctctcacgcgcgtcaccgccgtcgccgtctccgttccacctcatcgcccccccgggtgcccccactccgttcgcgatcttggacggcattggttcctgagttattatcatggcagcaatgaatagtgatctgggtggcttaggtcctaggcctacaaatgcaccaccaaatccttttgaaagtgccatgtatggtgctggacctgggctgatccgtactggacttggagcatacggagagaaatttcttggttctagttctgagttcatgcagagcaatattactcaatatttgtccgaccctcaatactactttcaagtcaacagccagtatgtgaggaacaaactgaaggtcgtcttgttccctttctttcacaggggccattggacgagaataactgaacctgta

SEQ ID NO: 4580 - DNA, 538 bp, Hordeum vulgare
aatgttcgtgtgtattatctcatcctatcctaagtgaccatgttattacctccagcagaaaacgaaaacggtgttcatgcgctttcatccgtttatccagatagctctactggcttcacaagaggctaagcaattaggtaagctattaccaagttcaccagggaaagttaaccaccgagtgtatcctgcacaggatcctctttaaggtcgattcacgttaccatacgacgggaagatcaaccactgatgttgccgagccagaacagcatcgggaactgcacgaccgccaggaagagcagaaagtagtggtttcgactcagatgccgctcgtagctccttggtccacccagaagaaccctcttcatggtcttcacaaggaacacgccagtgcagagacagaaccatggcatgatgaagtagtataagtagctccagaagatgcgggccagcatcgcaagagatgtgccagcaaatccatacccagcatacgccacaatgtctagcaatggtgcttcaccactgcccagggagtacagca

SEQ ID NO: 4581 - DNA, 516 bp, Hordeum vulgare
caagctgcctgtgaccctcgacgtcaccgcctcccccactcccggccaagttcttcacgccggcgaggacgtgatcacggtgacgtgggccctgaacgcgagccagccggccggcaaggacgccgactacaagaacgtgaaggtgagcctctgctacgcgccggtgagccagaaggagcgcgagtggcgcaaaacccacgacgacctcaagaaggacaagacctgccagttcaagatcacccagcaggcctaccccggcgccggcaaggttgagtatcgcgtcgccctcgacatccccaccgccacctactacgtgcgcgcctacgcgctcgacgcctcgggcacccaggtcgcctacggccaaaccgcgccaaccgccgccttcaacgtcgtcagcatcaccggagtcaccacctccatcaaggtcgccgccggcgtcttctccgccttctccgtcgcctccctcgccttcttcttcttcattgagaaacgcaagaagaacaactaaactcgcaa

SEQ ID NO: 4582 - DNA, 554 bp, Hordeum vulgare
tgtctgaaatacaattatttcattcattagtcattacacgctcacaacaaaaaggaggtatgcacccgaacatttatccgtacagtttgtgccgtacgtactagtccgtacttgatactgttacttgtagagagaaaaacgaccggccaacaaactttgctacggtcccgacttgcgagtttagttgttcttcttgcgtttctcaatgaagaagaagaaggcgagggaggcgacggagaaggcggagaagacgccggcggcgaccttgatggaggtggtgactccggtgatgctgacgacgttgaaggcggcggttggcgcggtttggccgtaggcgacctgggtgcccgaggcgtcgagcgcgtaggcgcgcacgtagtaggtggcggtggggatgtcgagggcgacgcgatactcaaccttgccggcgccggggtaggcctgctgggtgatcttgaactggcaggtcttgtccttcttgaggtcgtcgtgggttttgcgccactcgcgctccttctggctcaccggcgcgtagcagaggctcaccttcacgt

SEQ ID NO: 4583 - DNA, 502 bp, Hordeum vulgare
cccgtcccccgccgcggcgtggacgacgacgaggacccctaccgctcgccctcggcctgcaagagcacgtccgttgccggcctctcccccatggtcagcgccgtcgtctctcgctgctcccggtaatatcttaaagaactgggcgttggttttcttcagtttgggaagaggaaatgttgctctcggatgttataattttcgttatcacttaggccttgagattaagagatgctgattcccgaagcttctgtagactgtttaatacacaaacttctttctttttgttatggaattagatcatcgcataatcctggatagtatcgttgctctctaaactgcaggcatggcgacgtaggtgaaaattctcagaagatcttcaaacaatattagcttgcatattattattctttacatgagtccagagtactatgtttgaggaaaaaaatagcaaagtctggtctgagggagttcatcttggatctgaaaatgggtttagggtctc

SEQ ID NO: 4584 - DNA, 548 bp, Hordeum vulgare
gattcaacttgtatttctcatgaggccatagaccgatatatatacatgtacaggtatgaactatatgcagaaaatcccttatacaatgaaataaatacgaagaggtacatggctatattatatatgctctaacaagataaatatacattaagactcaaacacatgcataatactccttccgtttttaaatataaggttttttttagaggtttcactacggactacatacgaaaccactacttttgagaatagactagttttgtgatatcagggcagagcacagagaggacagaaaggaactaccactcttcttctttttttcaagaacaagaaaaggagctaccattcttattgaaatactaactgcagttcatttatcatatcctcagacaatgtacacagcggtgcgctggtgatccatctcgacatcggccaaactagacacagaatcacagtttgtacacacaaattcattttgtcttcttatcttctttgttatccttctccaccactactggcgctgcaggtatgctgaaccaccactctct

SEQ ID NO: 4585 - DNA, 519 bp, Hordeum vulgare
ggacgataaggatgaaccatagcgaaaatagaagatctgatggaaatcggggtggttcaagaagtccaccatataatgaaagttactctgaccgtcggagttatagtggacggagtgatgacagaaattccagacattcctatggagaacgtagtcctggctatgaccagaatgattataagaaaagcccccgccactttgaagttgtcgacgatagatctgggaaaacaactccagttcaaaggttcgaggaccgcaggttttctgaaccacgaaagccagagactgggtctccaaattaccagagagaagccaatggatctagtcctcctgttgtacggccagtgagggagatattgggtgatgatgctcctcaacttcggattggtgaacctccaaagccgaatgtagccagaccgattgaccctccaaaaccaaatggagccaggaccattgaacctccacctcaggcacagaggacatctactgccagcagcattggttcttccgaggggattt

SEQ ID NO: 4586 - DNA, 547 bp, Hordeum vulgare
caatcaaaacatacaaggcatagggtctctgtgaattacatcggaggcaacgcatacagaacaccaaacacaaatatacaagaaaataggggctagaagcaccgaactactgctcctgaagcttatgccccacgttgcttccacctcccagaccaagttacacggagctacagtgacagaacacatgaccagtaatatgaaacaaatttttctccagggctttgtgcattctggtctcactgggcagtgggcactacacaccagcggtctgaagatacataagataccataaacaggtaacatggtacgtccacatttgataagccttttttacccaaaaggatttccaccgacagcaccatatgaaggtggggtgcttggctgggagtacctaggggtagcttgttgatcatatccgacgccgagggaaccagcccctccttgttgccttggaagcatgccattaggtagctgctcaggcatgttgtttgaaacatgctgcatcatgtaatggttttgatgtacaggtggctgaatcatctgctga

SEQ ID NO: 4587 - DNA, 517 bp, Hordeum vulgare
gggaaggccgcaatggagcggcaccagtcgatcgacgcgcagctgcggctcctcgtccccggcaaggtctccgaggatgacaaactcgtggagtacgacgcccttctcgtcgaccgcttcctcgacatcctccaggacttgcacggcccccacctccgcgaattcgtgcaggagtgctacgagctctcggcggagtacgagaccgatcgggacgaggcccggatagccgagctcgggagcaagctcaccagtctgccccccgctgactccatcgtcgtctccagctcattctcgcacatgctcaacctcgcaaatctggcggaggaggtgcagatcgcctttcgccgccggagcaagctcaagcggggggacttcggtgacgaggcatcagcacccaccgagtccgacattgaggagacacttaagcggctggtctccgagctcggaaagtcccgtgaggaggtgttcgatgcgctcaagaaccagactgtcgatcttgtgttcacagcgcacccca

SEQ ID NO: 4588 - DNA, 471 bp, Hordeum vulgare
ctccagagttcacaagcattggcgacctagctaaacatattcaccatatggcggaagacgttatttatacaacatactggcctagccgtgtgttctgcatgccacgcagcaatgcccttcatagtcaggatgagggtgtcctccaggcctggggcatactcgctcccatggttcagttgcaccagctcggcgggctccttgtcgctgaactccttctacaggggcggctgctgtggcgtcacctcgaagctggggtctcttatccgcttcagggtgtaggcttggcaaacattcaaggttgtgatgtaggactcacgcaaccgcagccgctgctttaggtaaggatccccttcaagaacgtccttgtgaccagcaacctgtaggagtaactgttttgtctcttcaaagttttgcctcaactgatccccaaaggactgcagatcttgagccacaagcaatttgtcatataaa

SEQ ID NO: 4589 - DNA, 526 bp, Hordeum vulgare
gcacgaggacattcctgacttcaagctggcattcgagcacttctgcatccacgctggtgggcgcgctgtgcttgatgagatagagaagaacatggacctcaccgattggcacatggagccgtctcggatgactctcttccgtttcggcaacacgtccagcagctcgctgtggtacgagctggcctacagcgaggcaaaggggaggatcaggaggcgtgacaggatatggcagatagcgttcggctcggggttcaagtgtaacagcgccgtctggaaggcactgaggtcagtgaacccagcgaaggagcagaacaacccctggatggacgagatcgacacattcccggtggaggttcccaaggtgtccaaggttgctgaataattttgccttttcagcattgtcacccgaaacaggaagcgcgcaaatcttgccattgaattcgactgtattcaatatgtttgggtgatctgtcgggtattaattttagatgattccatttaggtggtacagaggggtgtgatgtcg

SEQ ID NO: 4590 - DNA, 552 bp, Hordeum vulgare
ggactgataatggcataaatagtgaacagcacgacatcacacccctctgtaccacctaaatggaatcatctaaaattaatacccgacagatcacccaaacatattgaatacagtcgaattcaatggcaagatttgcgcgcttcctgtttcgggtgacaatgctgaaaaggcaaaattattcagcaaccttggacaccttgggaacctccaccgggaatgtgtcgatctcgtccatccaggggttgttctgctccttcgctgggttcactgacctcagtgccttccagacggcgctgttacacttgaaccccgagccgaacgctatctgccatatcctgtcacgcctcctgatcctcccctttgcctcgctgtaggccagctcgtaccacagcgagctgctggacgtgttgccgaaacggaagagagtcatccgagacggctccatgtgccaatcggtgaggtccatgttcttctctatctcatcaagcacagcgcgcccaccagcgtggatgcagaagtgctcgaatgccagcttgaagtcaggaatgtcct

SEQ ID NO: 4591 - DNA, 550 bp, Hordeum vulgare
gtacccccgggcctgcagggaattcggcacgaggtgcggattgaggaggaagacgacacagacgaggaagacgataatgaggatgcccgggctcttgtgaccggagccaggttctcatgtaatgatctcgaatgcagcggctttgaagaatcaggggatgaattagatagcagcagtacatcataccacctgatggggaaaaggagcacagagaaaagcatcctgctcgagctggaacgcgatcatcatctcaaaattcaagaggaagttagaagcaagttatcttcattggaggtatgccaccaaaacgaaatccagagaacaatctctgcatttgctcgacttcagaaatatgcggaatcacgaaaagagatagatagaaggctagatgtccaattccagagaaaaattgcagaagtactcgataaacacttatctatggtccaaagggatcatgaacagaaatcccagattgtggaacgtagaataagagatgatgcagctgttgaagaagctaaaagaaaggagcaatctatgaaggaagaaaaaa

SEQ ID NO: 4592 - DNA, 484 bp, Hordeum vulgare
aactgacacaggtttgcacctcatagtacagacatagtacacacaacaaatcgcaccaagtggcacctctattctaatttactgaacatgttaatcttcaagacgattttgggctcctccataagttatgaccatgcagtttctccctcagacaaaatagatgcaccagctgatagctccaagccaatccggtgttaatcttcacaagaacattttcgatagcagctgctgggcgaggtactgcccttctggctcctccagataaattttgtcatccagataattttgtagattattgatagcttctggctgaactttcgagccttgtgctttcaaagctggtatgaagtgccgcgatattacatctagaattttcatgaactgtgatccatatttcttgtgaagcgcaaaaccagccaccttgaggaaagcatgaagagcaaaagcagtggccgggatcgctgggagagtgttgaggaacatt

SEQ ID NO: 4593 - DNA, 517 bp, Hordeum vulgare
tgagttaccaccaagaggatggaattcctatgattctttctcttggacagttgacgaaattgcatacttgcaaaatgcaaagattttggcagaaaagttactaccacatggatatcagtatgcagttattgattacctgtggtaccggaggtatgttgatggggcatatacagattcatatggatttgacaacattgatgagtggggtcgaccgtttcccgacctccaaagatttccatcatccaaaggtgataaagggttcagtcaaattgccagcaaggttcatgagatgggtttgaaattcggcatccatttaatgaaaggaataagtacacaggctgttaatgcgaacacacccatcttggacattgagacgggaaaaccctatgtagagaatggtcggcaatgggcagctcatgatattggcctgacccataaaacatgtgcatggatgccacatggatttatgagtgtaaatactgatattggagctggacgggccttcttaagatctctt

SEQ ID NO: 4594 - DNA, 554 bp, Hordeum vulgare
ttatgtttgcaaaatgcaccagaagagaccagtcagtacagctcctctgttgccctctcctcattttctgctgcccttctatatcagtgcattcgaatgtttcatcatcctgagttgatgcataattactcaaacccatcccgttctagcatgggtacggtttgacggtcacctcgaccgctttcaagcgccgacccaataggattcaaggttcacgctgtttagggtaggcttacatcatatcatatcataggattgcagtaggttcccaagattattcccactgtgagaagtctgcggcaaacctcaacacataagttcgaacaccacgcaaccgtgtggattcacggccgctgaaatctcttccttgaggagaccaagattcctcccgctccaaacgtcactgcagctgcatgagtgttttcgtacgaaggctgtcccaagaaccttttccaggtctgatattcttgcggttatcttcctgctcgtcgagtcaaggttgaagaatgcgaggtagatttcccctttacttccagttgcaatccatgcacgat

SEQ ID NO: 4595 - DNA, 509 bp, Hordeum vulgare
cccggtgatggcatcgggcctgagatagccgagtcggtcaagcaggtattcaatgttgcaggtgtaccaatagaatgggaagaacattatgttggtacggaagttgatcccagaacagagagctttttgacatgggagagcctggagtcggtgcgtaggaacaaagttggcttgaaaggtcctatggctacacctattggaaaaggccaccgttctttgaatcttacattaaggaaagaacttggactctacgccaatgtcagaccttgcaacagcctcccaggctacaagactagatatgatgatgtgaaccttgtgacaatccgtgaaaatactgaaggagagtatagtggccttgagcatcaggttgtgaggggtgttgtggaaagtttaaaaattattacccgccaagcaagtttaagagtggcagagtatgctttccattatgccaaaaccaatggcagggagagggtctctgctatacataaagctaatatcatgaggaaaac

SEQ ID NO: 4596 - DNA, 540 bp, Hordeum vulgare
aaaacactaacagcgcagcaatgcatgcttaatccttctagtaccatgacaaaaagcaaaagaaagaagatcaaatcaagtactctaagaactagatcgaacaaattatatgagctcatgctggcaatgattattacagatgattcttcagcttgactgcaatgctggtaaaacttttccaaggacaagaatgtgaggattattcaggagtcttaaacggggtcaacacccaaggaaattgaggtgtccgtcacttaacctactccggctaaagctcctgccatgcaacaaaattatcgcgggcgtggggggtggggattgctggtgctcagatatgatcgcaaactgcttttgtgtagtctgatgttgatgacttcccaccaagatcagcggttctgtacttcccctcggcgattgtctggaggatggcattgtggatccggtctgcttggtcgttgaattgcaagtgacgcaacatcataacagcactcaacataagagcagttgggtttgcaaggttcttgccagagatatcaggtg

SEQ ID NO: 4597 - DNA, 1365 bp, Hordeum vulgare
  UNSURE (1),(18),(82),(837),(907),(981),(1026),(1251),(1289),(1365): n stands for any base
ntttgctatcttgaaacntagattttcgagttgtgaagcgccaacaattgacgtatgctgcctaaaacatcgagacccggcnaaaccccgccacgcactatagggcgccgggcggggccccaaaaatatccccttgccgccgaccgaggaagcatcgaggcctagcaccctgtgtgtaatctcggggagttcaagccaaaaccacaaaccatgagtctactgtccaagtctacgaacttcgcaagcgctcatacgtgggcatcattcgcggacacgaccttttttttttgtccttcggcacatacctgcagggcgagcgaccatgtcccttttttttttttatacgggacaccatgctcatcggaatatcaacatgttttgataacgtacatctcactccacccccctcctatcaaatttctcgcacagccaccccaacgtcgttcgcccgccgttttcctctctcactcaaaacaaaatacaccatatttcgcgttcaatcgttaagtactttattgtaacaattgctgatacacagcgaatactcttcgattatatatatcgaggacggtcaccgcctcttcggtagatttccacgtagatatcagaacatcaaattacccttacaggagtacatacgtattaatcttcagttgcccccggacttaacgacccgttaccccaaccgcttttccaacgcgtattttctcagcatccgttttcgggtacattgatatattgcagttccgcgatcaacctctttccgttcgttccgcctttcgcctgtcccaccgttccctaatcccaccaaccatcacgtattcgccttgctcgtgnatctctatgcacacacttacgtgtccacactgtagcgcgttgtccagtagttgccgcactattcagtccntccacgcttccacatggctcccgttatcctctaatgttcatccacactattgcgcacctactgtcacacgcgantgtcgctccacgcaatacactcgttattgtatttgttctcctgtntccgcgttatcctctaatagttgtgttactcctcccactacccctttattctctcacctattccactcacctcgtcctcttccgacgtctcacgaacgagtctggccgcgcatcaattatatctaaacctcgcccatatcgctcttatccacacctattgcactcctccctccctcaccctgtgtatgccaccctttcacataattccctatgactctaccgctntatataataccgtcacccgtcccacacgcctgttcgtntgacgcctcagttaaataattacccacctactctacccacgccgcacgccccacgttacacttcctctcttttccn

SEQ ID NO: 4598 - DNA, 514 bp, Hordeum vulgare
tgtaaacacatgcaaaggatgacactgacatccagggcaagtgcttaaagcaatcttcaatttagccacattggttttctatatggcttttacagttccaatctatcgcaaaataggcaaccagccatcacctacatctgataagcaggctaaccatcataaataaggaatattcggtcccttccactacaaaatttccaacaacttacttatgcccacattaaaatacttaacaaaccagagacaaaaatacacgctaaagaacaaagaacaacaccatctgccccatcaagaaactccatccatgtaaaacctttacgccagccaagcaaccggtacccatctcacctacacacccatcatattctttcaagtgtcaaaaaaggacagtggaacgccagaactaagacttctgtgcatgtggacgccaattccctctgcaaagctcctccataagatgaacaaacttttgaggctgttgccaccacattggttccgaagtggctggcctttc

SEQ ID NO: 4599 - DNA, 518 bp, Hordeum vulgare
gcacatacgagatgagaaagtaaggttctgcaatcagtgagctctataaagcatgacgaggtagtccttgggcaatatgatggctacaaggatgatccaacagtgccaaatgaatccaacacacctacttttgtatccgttgtgctgagggtacacaatgagagatgggatggagttcctttcgtccttaaggctggtaaagcactaagctctaagaaagcagagatacgtgtgcagttcaaggatgctccaggcgatatttttagatgcaagaaacaaggaagaaatgaatttgtcatacgcctgcagccatcggaagccatgtatatgaaattaactgtaaagaaaccagggctcgaaatggcaacagaacaaagcgagctggatttatcctacgggctacggtaccaagatataaaaatcccagaagcatacgagcgtcttatcttggacacgataagaggtgaccagcagcactttgttcgccgagacgagctgaaggctgcctggcagatctt

SEQ ID NO: 4600 - DNA, 562 bp, Hordeum vulgare
taataataccttaagtttactttatttgtaatcgtaaaatggtatactgttttgaaaagcacagattgcttattacaaaatgctcttccgtatataacacacagagcaagtaatttccctctgaagtaattctctgtaaacccagaacactcctgttcttaaccggcacttggtagcggctaaaactttgcaagggttggtggtgcccagacatagccaagagtcggcacgtaccccatcctcttgctcaactcatcggcctccggaggaccccgggttcccggttggtatggtagagccttgaacctgccactatcgatgtcgtgcaacaagggagtgaagatctgccaggcagccttcagctcgtctcggcgaacaaagtgctgctggtcacctcttatcgtgtccaagataagacgctcgtatgcttctgggatttttatatcttggtaccgtagcccgtaggataaatccagctcgctttgttctgttgccatttcgagccctggtttctttacagttaatttcatatacatggcttccgatggctgcaggcgtatga

SEQ ID NO: 4601 - DNA, 518 bp, Hordeum vulgare
agtagcagtctcctgaagcaaagcagattgtgttttgattgttcagattcaggccagaccacggagtagaattctcatgtcaattgctactcaagcataattaatcactacttccatcttatgttatgcaattgtgtgtaagatttaattgttcaggttcaggccagagcaccgggtagtctcctacaaaaacttggcgattgtgtgtaagatttaattgttcagattcaggccagagcaccgggtagtctcctacaaaaacttggcgatgtccatggttcaggttcgaaccagcatgaaaggaaacatctaattgggctgatttatgttctgtgctacacagatgcagtgctccggcaagcggatatgctggtaaaagtgtgcgctgttcatgtgttgtgctgcaaaaacaggagagttcatatgatagttttgtcgcacaacgggattcgatgcttgtcttgttgcgacccaaccaggcgcagctaactctagctgacaccgcggatgccggtgcc

SEQ ID NO: 4602 - DNA, 556 bp, Hordeum vulgare
gtttccgaatacaattactactattagtctccgaattaaaataccgaacaaagttagaacattacaaatctcgaggacgcgagtaacaagtttgtcttacattacaagtcgatatcgatcatctaaactaccatcacatagaagagagctgcggtcatcacgatgagcataatcgcgatgaaactggtcttcatccggttcctccaacactccctcctctctcccgctagatagcgcgcgtatataacttccgcatccgcccttgtggtgtaccctttatactctgtccatcagaaagcttttgactcacagagttatcatcactacttgtctgttgcaaatcttccttgccttctacctcaggttgtgtaaagaccatgctacttgcaacagcagcactatcctcaacaggaactgccctgttcctcaacaggccattctgtccatcaggaatcttttaactcacagcaatatcatcactacgtgtctgttgcaaatcttccttgccttctacctcgggttgtgtaaggaccgtgttacttgcagcaccaccacc

SEQ ID NO: 4603 - DNA, 523 bp, Hordeum vulgare
cccagcagcagcggcgcatgccgcagctccccaagatcgaggacgacggcaacccccgcttcgtcatcttcatccgcaccgccaatgtgtacttttggtacccgctcaacatcgtcaccggcggcaccaccgccaagatcatgctcgctgccaaggacaacttcctcggcaagtacatctacaaggacacgctcgcccggaacctcgccaccgtcatttacaaagacgaggatgacataattgacctggcgaaagagcagttccgcgtgctcaagggagaaaccgagttccggtacggctacaagatcgtggtaattctctcatccttggctgcaggacaggagggagggcgcgtcgtttcgataatcatatcttctactggttgtactagcctttcattcaaaaatcaaaatggaggttgcagttcatatacttgtcgtttggctgagcaggagaaggggaacctcaggtctgcgctggcgacaagcaacgtgctcgagctcccaaagaaagaagagctcaa

SEQ ID NO: 4604 - DNA, 541 bp, Hordeum vulgare
aaattaatataaagctgtggttgtcgctgttctgcaagtacatcaattggcttcatttctaagatttcgcggggctgcctaacatcatatactctgtgagaagtgaacaaagtttgttgttgcccacagggaggttacactgcaaaactcaaaaagcctctggtgtgctacagagcagctcgggggaaactacagccgggcggtccactcgatcccactcttccgatcagctctcgggcttgaacccttgcttgggcttctgctgcttccctttcctcttgcttcctcgtctcttggagcggggcctctcgtcttctgcttttccttctgcttcggcctctgctgcgctggcagatcctgttatctgtgcaaaggattctttggcgcccgaggttacctcaccgaagaagtccctcaccttgtcaactacacttttgagctcttctttctttgggagctcgagcacgttgcttgtcgccagcgcagacctgaggttccccttctcctgctcagccaaacgacaagtatatgaactgcaacc

SEQ ID NO: 4605 - DNA, 540 bp, Hordeum vulgare
  UNSURE (11): n stands for any base
ggtctgcaggnaattcggcacgaggtaattatctgcaaccctccacttcagtcgtggatgatgctcataaggccgacttagaaatttatgctgctgattttgccaacgactttgcgctcagctacaactacagctatgatccgttagcagaataccttcgcttcatcgataatggcgccttctgtgttgatggtctcttgactgatttccctatcactccattagaggccatcggttgctttactaacctgaacaataccaaggcagatcatggggcacctctagttatctcccacaatggtgctagtggcgaccatcctgactgcactgacctagcttatcagaaggcagttgctgatggtgcagatgtcattgactgtgctgttcaagtgacaaaagatggcataccaatatgcatgagttccattgacctaatggatgtcactactgtcgcatcctcacaattttcttctcaagcgggtgtcataaatgacattaaggctgttgctggagtctataccttcaacctcacttgggagg

SEQ ID NO: 4606 - DNA, 538 bp, Hordeum vulgare
  UNSURE (3),(6): n stands for any base
acnctncaacgtccaccatcccccaaatacttgtacagccaaaccaaaaggaaaaatgaatcgctcgctacatagaacaggtggcagaaaagaatggtcctcagtctcagataagcagagaagcgcatagcaccagcagcatcacgccggcgtccgtgcgtattctggaggcggcgtgggagggcgccggacctgtggtgttgctcacaggaggaaggggcggctccgccacgtccgagtccgtcaacaccggcattggggccattgctggtggcaatgctgctttatccggtatgaccccaaggaggccgccgcgctggggaggcagcatgtagtagggcgtcttgtcccccatcttcctgcacgagttcagtttgtatctatgggccgtcccggggaaatcggtgatgagtccatccactccccctccctctacacctttgtgcacaagggcattaatctgtgccgtggcatctgagaagaagtcatacggctgagaaaggaactcgttcatcagcagatagacatagactggaag

SEQ ID NO: 4607 - DNA, 1101 bp, Hordeum vulgare
  UNSURE (1)..(3),(11),(12),(14),(20),(21),(24),(25),(28),(176),(302),(1101): n stands for any base
nnntttgaatnncngcaggnnccnnagntgtgggcccctcagtacgatgttgagctctcgcctatccccatgacaaaactagagctggagggagcggccgccccaaaacccagcccgctctcttctccctccaccctacacttttcttcatgttctcggggctagacttcaccctncagctcatgaccgccccggccaggaggcagccggtgataaccaacgcgtacgacgactaaccttcgcactcgtatggcgatgacgggggggggccagccatggctctttttcagaaccgctacgcngagcaatgacccctcgggtggggcgtttagttacttccctctcctcctccgtctctctcatgtttcatcgtttttcactcgtttccccagattccacctttatcgcttttgctatcttcccttgttcgcccttttcgctccccttacgtagcacccaagtcaccttctccccttccgtgccccacccccctatctccgccctttccctctccccgttttccccatagcccactttccccccccttatgactcttatgcgcatcccgttattaccgcctccctgtttttcccggttccattaccttccccccgtacttttttgttttctcaccccccatctcatctccctcttcttttttttttttcccccctctcccgtcaccttttcgtttttatgattccgccatgcagccagtcgatccttcacaactttgcctctcgtcctcatcctctttcgttttcccccttattattattccgctttttgttcccccacaactctccgcattctctttttttttttctttcccgtttctttttttcctgtccttctcgtcgctacattatgaattactcctctttgtcccccttattacacgggcctatattcctcttttctacgccttcctctcgaaaagttttctcttttcccctcgttatccgtttttgctcgtctccttcctccgatgccattcaccgtctctttccgcttttcctttcacccgtctactccctccctcccattttattctcactcccatcctattcgcctacgttccatttcgccccgtccgccttn

SEQ ID NO: 4608 - DNA, 554 bp, Hordeum vulgare
  UNSURE (17),(25): n stands for any base
tgctgaatcacgtattnctcacttnctgggtctcttggcattacagttttcagatgcaggggcatgagcaaagcatggggaagatcaattccagatgtacacgcatggactttactacaccagtgcactaaaatggtgcaaattggcaaccaaactgaaaaatatacaatcacaaatccacagggtttatcttcggatgagcgccgattccggaccggttggtcggtcactcgtctttgtagaggcagcagcagaagcacttgaggcagtgctcgcaggcttcatgacagaagaagcagcagcacaacacgaagaagcagtcataaaggaagcccttctcctggtggcgcttcctggcatgatccatggccggcagcttccggtcattgccctgcgagtgcgaaggttcgtcctcgtccgccttggtcgtcgccggctgcctcctggccggggcggtgatgaactggaagttggaatctagtgacgagaacatgaagaaaagtgtatggtggaagggagaagagagcagggctggggctttcggcggcagcttg

SEQ ID NO: 4609 - DNA, 551 bp, Hordeum vulgare
gtacccccgggtctgcaggaatcggcagagggctgattatgtgaagaaggaaagggtgccacaaagcaaagctgattatgtgaagaaggaaagggcgccacagagcaaagctgattatgtcaagaaggaaagggtgccacgaaccggaggtccgaagccaagctcaagagattccgctttcggtgtgaaaccaaagaaggtttcttcgcttcatctgaagccagcaaagagtgccttaccaaagtcgccagtggtgaagaagaaactgaagatcgatgaggctttattttctgcaagttcatttgaagagctcggtctgccacctttgctcattgaccggctgaacaaggaaggcctaacctctccaaccgaggtccaatctgcttctattcctgtcatatctcaaaggcatgatgcggttattcaatcatatacagggtcagggaaaacacttgcgtaccttctccctattctttctgaaataggacccctgaagaaggctagagagcagggtaattctgagaagagatcaggtatagaagctgttgttg

SEQ ID NO: 4610 - DNA, 529 bp, Hordeum vulgare
tcattgtgcctgcacccctgctaaatgccaccagcaaaaacgtaccaagtattttccaatgtatctagtctccactgagcagaagtattaagtggcaacattttaagaaaatacagtcggactaaatgccaatgaaaagcagtacaacttaagacaaactaaaaagatagttgagcatcgcaggattttattccacgtcttcctccttatgaacggtaatctggccttcagtgaattcgcatggcttgatggccacacctagctgcttgcgcattttcctcatgataaatgcctcgctttcttcacaaattgagaccacagtccctttccgcccaagacgcccggtccggccagccctgtgggcgtaatgtgtagagtctgtgggaagatccaggttaatcacaaggtcgcattctggtatgtccaatcctctcgcggacaactcgtttgtgaccaaaaccctgaattcacctgccttgaacttctttaggactgttgaccttgcaagcttcccaagatctccatgtag

SEQ ID NO: 4611 - DNA, 419 bp, Hordeum vulgare
agacccacctgacaaattttgctagaatattgaaggagcgagctcattcggacttgaagaaagcagcagataacattggagtgatggagctttggaggcagatctgcgacgagctgacatggttgttcgacgacgtgccatggaggatgctttcatggctttaaagtttgttcgggatattcatgacatgatggcaaccaaactacaatatcagttcatcacactcgagaaaaatgggaagattcttaagttgttccctcgtgaagtttctactgatcaaatcgctgccatagaggatgcatatcttaatatggcatctgccttatctgaggctgatggtatcgactacaccaatcccgaggagcttgaattattagtagcggctcttattgacctggatgccatggatgggaaaaaga

SEQ ID NO: 4612 - DNA, 552 bp, Hordeum vulgare
ttgccccttccatttgtttagcacttaccagatatcatagacatgccttctcgtgaggtagtcaacaagcaaaccattttatgctgcgacggaacacacagaaatgcagtcgacttagttacacttttttcggttcctattacagtctgtacgtgttacagtggaaggttcattgatctttagttgagtcattcatctgatttacacctcacgtggtgataccatctctgctactcaactgtcatcatcagtctcatcggaaaccaagttttggttcatgacaaacctcagactgtcaccctcttcaagctcccactgctttctgagttcaccaatggctcttgctgcagagctagctacagcgggattggaatcttgagccaatctctgtaatgcgcccatcccagcattccctagggtccacatggatggagcggcagccaatgcattagccaaagctttcctggtattaacatctggagaacttgaacattcaactatcaaggaaacactctttttcccatccatggcatccaggtcaataagagccgc

SEQ ID NO: 4613 - DNA, 433 bp, Hordeum vulgare
gaagctcagaactaccacgactcggggacggggtccggtgctcttcgtctgatcaatctcgtccgcgtttcttgtacattggggccaaagatggcaaggtcagccatgtccgggctagtgctcctgcttctatgtgcgacctgcagattggcgctaggaatcgccgatgggctgctggcgaacggcaacttcgagcgcgggccgcagccgtcgcagctgcgcgggacgcaggtggtgggcgcgtcgtcgatcccgtcgtggcggacgtcggggttcgtggagtacatcccgtcggggcaaaagcagggggacatggtgctggtcgtccccgagggcgcctacgccgtgcgcctgggcaacgaggcgtccatcgcgcagcgtctccgcggcgcggtccccggtgcgcgctacagcctcaccttcagcgcggcga

SEQ ID NO: 4614 - DNA, 406 bp, Hordeum vulgare
tttttttttttttttttgcagttaacgtcttccaagttcctgacgaattccttcgtgcacattcaagctcaatgagcagtttgagcgcccaagcagtgaacagctgcctaattaacacggatgcagcagcagcagcaacaacaacgccgtgcacccagcacactgtatggccagctagctcagccttctaggcgcgctttgggtgccgcgcgcgcacgctgacgactgcgacgtcgtcgatcaccggcccgcagagcgagctcatgtcgtcggtcctggtgttgtagaatgagctgaagaagacgacgcgcgtgcgaggcgacgtggcgcggaacgggagcacggcacgcttggcggcgccgccctgccccgccgactcgtacggcaccttggccgactccctgcc

SEQ ID NO: 4615 - DNA, 549 bp, Hordeum vulgare
attaaacgtatatagttgaatattattgtataatattatgcgtacgtgcatatacatagccaccgacagcattcacatacaagcatgttttctcgagccatgttggtacatgaacatggacatacacatattcttaggaacaaataagaaagataaatggagaaggaaaacccaaagcaatgtcagagttgacaaaactgcaatggcactttatatgtggcccatcgtcagtgagctttttatgccttgccggactcctcgcagcctggtggcttgaaggcgatgaagctgacgcactgcacctgacgcatgttgtcgaatccgatgatgcggacatacgcgtcagggtactccttcttgacctcctccacctcgttgagcacctgtgtggcgtcggtgcatccgaacataggcagcttccacattgtccagtaccggccatcgtagtacccaggagatgcgttgtgctcacggaagatgaacccaaccttgctgaactcgaggcaaggcacccacttggagcggatcaggtagtcgacctgcttaagg

SEQ ID NO: 4616 - DNA, 529 bp, Hordeum vulgare
caatgcattggtcgcatgtcatatgcaagtaaaccacaactcaaaggtgaacaaaggaataacttcttttatgaagcgcattgtcaaaattacatggaatggtagcccaaaccaagttactaataacaagactagctctccggaggaaaagagtgaacgcacgagcaaagagcatctgatttaaatttcttgattgattgaacggccctcctttgactttgactgcacagcatgaagggagcagcagctttagcttcccagcctagagccacaaggtaaatacccagttggttcgatgtttacagcgaagctgaactcccgcatgctaacagcgaaggatcatctccattgctgcaagatctgccattacatcagtgaccactacgtcttagtctttgccaaagtctgcgctgtagtgggcactggattccagcttcttggcgtcgttcagcttcctgacggccttcatgaagtcctcatggactacgtagtctcgctctgcgcgaatagcagacatgccagcttcggt

SEQ ID NO: 4617 - DNA, 517 bp, Hordeum vulgare
cctcgtgccgaggacgtgctctcggccgtgatgcggggcagcgttcggttccctccgaggctgttctccggcgtgtctccggccgccaaggacctgatgaggcggatgatgtgccgcgacgagtggagacgcttctccgccgagcaagtcctccgccacccgtggatcgtgagcggcggaggagcccgagcgatggagcagccaacctgatgaacggccgccggatccgagacttcgccagagcagatcgaggcagatttagagcgtgccgcccgtggggccccggctctgcagagaagtagagagatagtcggcgatcgagacgcaccggccgacggcgtcgatacggtttttgtacaaaaggccgggcgcgcagatacatacgctagtagtatcgcgctacggcggtagatcgagtgaagaagcagtagcagctagctccatctttatctagagggcgccttaatttgttttctccttgttgtgtgcggtgctgcatgatggatgatgatgcagc

SEQ ID NO: 4618 - DNA, 502 bp, Hordeum vulgare
tacacagtacaaaacctgctgctgctgcatcatcatccatcatgcagcaccgcacacaacaaggagaaaacaaattaaggcgccctctagataaagatggagctagctgctactgcttcttcactcgatctaccgccgtagcgcgatactactagcgtatgtatctgcgcgcccggccttttgtacaaaaaccgtatcgacgccgtcggccggtgcgtctcgatcgccgactatctctctacttctctgcagagccggggccccacgggcggcacgctctaaatctgcctcgatctgctctggcgaagtctcggatccggcggccgttcatcaggttggctgctccatcgctcgggctcctccgccgctcacgatccacgggtggcggaggacttgctcggcggagaagcgtctccactcgtcgcggcacatcatccgcctcatcaggtccttggcggccggagacacgccggagaacagcctcggagggaaccgaacgctg

SEQ ID NO: 4619 - DNA, 552 bp, Hordeum vulgare
gtacccccgggcctgcagggaattcggcacgaggctctccctcgtccttcctcctcctctctccgttttggtggtgcaagttgttggtcgcagtggagttggcacagggcgttgcctttttgggcgcacaacaaaggcataggctgataggcagaaggaggaggaggcttgtgcttctctcgcctttgcggggccgccgcttttgggcctcctccttcccattggagcgtacaaagctgggcggcaccatttaaaggaagaacaccaggaggaggaggagatcaagccaaaccccaaagaaaggaacaagagtgagagcgcaccaacacccccaaacaccatccatcgctagtgctgctacactgcgctccgtcccagcgagagggggatcgcgccgctgttgcttctgccctgcagccctgccctttctcagcctgcctatcggcggctccttcccgaccgcgaggaccgacggacggacggagaaagtgtaatctgcaagcttctcaaatctgggtactgtttgtaaaagaggagtggccttttttcagt

SEQ ID NO: 4620 - DNA, 550 bp, Hordeum vulgare
atgaagtgagagctttgcattacacacagaagggttgccttgcaagtgacaaagatgcctaattatttgtatcaagtttctatgctgcactacttgttaagatgatcacttggactggagcaagagctggacaccaggggagaaaaccgtaaaaataaatatgtgcaacaagatgaggaaaactgcaatcgcgaaaaccctccctattttcaatgactaatatcatatatagacttgcagagagagcacacttgacgccgtgtttgaaggcacacaccacagtgcggctctccggatattaggtacgaaaagaaggacgtttcttgcctctcttgcttctcgacgcagacacgaggcaaagagctcgccaaacctttcatctattgctgaaaaacgaggagccacctttgcattggctcaccaagttcctcttggctcttctttcagatagctgctgctaagaacttgggccaaattaacaccagggagcagataaccggcaagcttatcatccactgaaacaggcaacctaggcatcttgctcatgatt

SEQ ID NO: 4621 - DNA, 517 bp, Hordeum vulgare
cggacggtacaccaaggttctcgacagggcgcgttgaagacggtgtatcctttccacgccgggttgctccggccattgacgcgccgatgccccttcgattcgtttcccgggggccgtttgactcctcctggctggccaagattcagtttttacccggtccacggagcctttcgctgttcggaacagtcccgtgtgcactgtgatgcgttgataatctgctcaacttttggtatctatatgtgcctagtatgtcaggggtttgaatgatatctatctcctctgtgcaaaaacccgtgatttcttcctcgtttagatgggagttttgctggcattgacctgctgtggttgcctgatgggagttcaggggttccattgtcacctgaaagtttccatttcctgctgcgcattggctggcatacagtagtcgatgtccttctatgaatgatatgacaagcatatatgtctattttttaccgaattcaaccaaggattgcggggataggtaactgctttcatt

SEQ ID NO: 4622 - DNA, 502 bp, Hordeum vulgare
atgaggtaagtttgagtctagccaattaaaccaactaccactgatgtaacctataaagatggactgaacaataacaatataaaaaatgacagctaaattatgaagagtcctaaaattatagtaattattattggacatgatatagtaaggtaccgaaccacggcttgctcgtagaacattgcaccaggcaagggtgccgaaccatggcaccatcgcagattgtgtggcgaaaccatccggttgaggaacaaaatacacaaactgctgcatgctgctcggccatggagtccatgagcttccttctgtggcaccgccagaaggtaggtttctgcttccttgtgtggttgtgtcatctgaaggttcagttccgacgtccctgccattctgcgggttgacggtgctggtgttcggcttctggtatgtatcattcaccacgactttcttgccgaatagcttgaggactgatgtctctgatcctgtacatgacccccttttggcatca

SEQ ID NO: 4623 - DNA, 519 bp, Hordeum vulgare
agaggaagagcgaaaacgcatcccttgccttcctccacgcccgtagggtttccggatcggaggagcccaagccgccgcagccatggttcacggatcgctcgggaagttggcgacgcgcgccctctccgtcgccggcaaatggcagcaccagcagctccgccgcctcaacatccacgagtaccagggcgcggagttgatggggaagttcgggatcaacgtgcccaggggcgcggtggtggggtcagtgcaggaggtcaaggaagttttgaagaacgtcttccccagtgagaaggagatagttgtgaaaagccaaatcctcgccggtggccgtggattgggaactttcaaaagtggactgaagggtggcgttcatattgttaaggctgaggaggctgaaggccttgcagctaaaatgcttaaccaggtcctggtaacaaaacaaactggtccacaggggaaggttgtgggcaaggtctacttatgtgagaaaatgtcacttgttaatgagatgtactttgc

SEQ ID NO: 4624 - DNA, 560 bp, Hordeum vulgare
  UNSURE (533): n stands for any base
gggtaaatcctacttgaacttataacagttgctgcccaattttgtgcccatatagatttattaacacaaagatcacaagtttaaagcaaaactcaaagtggaatcactccacttcaaaaaaatgcacttcaagatttcgtcccccgaaatcagtaagagagcaccactcctcttgtacgagtgaaaacagaactttagactgatatggtacaatcattaatcatttgaccgatgcttttacagccttctcggcagcatcatcaagatcctctgcagtgatcaatgtcattccactttccttaagaatccttttcccttggtctacattggtgccttctagccgaacaacaacagggaccttaagatcaacctgtttagctgcattcactattccacttgctatcacatcacatttcatgatacctccaaaaatgttaactagaattgccttcactctatcatctgaagtcaatatcttaaatgcttccacgacctgtccctcggatgcgctcccaccaacatcaagaaaattnggcaggtgtaccaccatgcagcttaat

SEQ ID NO: 4625 - DNA, 500 bp, Hordeum vulgare
gcctttgaactgcttcatgagatcaatgaacgcatccgaactgggctatgggttggcgattgttttatctacaataattcttcatcgcggcttaattactgtgtaggaggagaggtcacaaccttgtttcacctggaccggccaatgtatttactaggatatcttgctaaccagagccgtgtctatcttattgacaagcaatttaatgttgttgggtacactttgctccttagtttgattgagtataaaacactagtgctgcgtggggattttgatcgtgcaaatgatattttgccatctataccaaaggaacaatatgacagcgtggcacatttcttggaatcacggggcatgttggaggaagcccttgagatagcaacagactctaattacagatttgacctggcagttcagcttggccgcgttgatgatgcaaaggcaattgctattgaagtgcaaagtgagaccaagtggaagcagttaggggagttagctatctc

SEQ ID NO: 4626 - DNA, 545 bp, Hordeum vulgare
gtggagatcagagcccccacccatccgataactgtgttaacaatctgaggtttacatacgggaccgggataatgttcccaaactgacacgcgactgccctatgtacttagtgtaacatatagcacctttccaaccaccaaacaaaatccatctccaaacaaacagcctcttacaaccctgtgaaacgtcccggatgactatctatttgaaatgaatcgcaaaattttctataacatgaactaaagtgctaattaaattgctgcccagactgtaaccggataagccaatcctagatcacatgaaagcttatagaatgaggagaaacgggttttacatcatcccagtaacaaacctttacaaactgaacctcttaagcaggttgctgttccactatccactattggtcaggagtcagcaacttgctcaactacagcttttatgctgatggttcttctttgttcgtaccccactgttcctcactatcatttccattcacatggatagtgccatcagtagaaccatcagcctcaacctcaacagcatct

SEQ ID NO: 4627 - DNA, 518 bp, Hordeum vulgare
ccgagtcgctgataccctacggttccacttccaccgctgcccagttctcctccgatggcccacctctccgccccgcctgctgccgccggccaccgcgtcctcccttcgcatcggcgccgcctcgctttgaagaacatcgcgccgtcatcgggcggagccgtcgcgacgggagggcttcctttctggagggctgcggtgtctaaagccgccgcgagctccagtcgggcagcactggccggcaccattgtcaatccaattgatgtccctatcttgtctttctctgaggttgcagaaaggcttgatgcattccaagaatctggtgctagaagtcaaagttacgtggccatgtactctagtatttttggtggaattactacaaatccctcggcgatggtgataccgattgatgatcacatggtccatagagggcatggtgtatttgacactgctgctattatggatggtcacctttatgagttagaacagcatatcgaccgattcctgaattctgcacagat

SEQ ID NO: 4628 - DNA, 547 bp, Hordeum vulgare
  UNSURE (42),(43),(56),(57): n stands for any base
ttcctacactttcaatgagaggcatatgtgctgcaaactagnnagtacaagaatgnntttgggtttaacaatgcctaaaaaggcataagattgacacacaagagtggctccaaatgatttctgcaaagaccaaaaggaacagggtgttacagtatatattggagttaacagtattgatgtatttgttcacgtgtattctacaaggactataatgcagggggtttcagtaagggacagggatgcgaactgaaggtggaccagatctcatgtcctcaagaataaggttgaaaagtgtttgagcaattgggccttctttaccggagccaatcatctgatcatcccactgaacaacaggtttgacaagaattccactcccaatgagcatcatttcgtcggcctccttcccttcctggacactcacattccttgaagatatcccactgagtcttccatcctccactagctgctcagcaagggccagaacccgtttggccgtgcacccactcaggatcttgtcgaagcggggcatgagaagctccctgttcgg

SEQ ID NO: 4629 - DNA, 519 bp, Hordeum vulgare
ggatcgttgcccgaagagcatttggaaaacttgttttcatgaccataagagacgactccggaactattcagctttactgtgagaaagaaagccttacggaggagcagtttgagcaactgaaggcatttattgatgttggcgatatcttaggtgcaagtgggtccataaagaagacagaaaaaggggaactatctgtttacgtcaacttttttgaaatccttacaaaatccttactcccgctaccagataagtatcatggcttgacagatgtggacaagcgctatcgccaaaggtacattgacatgattgcaaatcctgaggttgctgatgtgtttcgaacaagatcaaaggtcgtttctgaaatccgcaagacaatggaatcatttgggttcattgaagttgaaacgccagttctacagggagcagcaggtggtgctgaagcaagaccttttataactcaccataactccctccaaagggatctttacttgaggattgcaacggaactgcatttgaaaa

SEQ ID NO: 4630 - DNA, 542 bp, Hordeum vulgare
gacaaaattgccgttacaattgaagggagggtgcgcacccaagcattcttcatttacatacgcagcactcctgactaaaaagtagttgtaggaaaccatatataaatatgaaatgtgaactgatttcttattcctgcgtcggcacctagcgactattttgtgtaagaatctcgaccctcctcaatgaagtaatgcgcggtactatataattgtacacaagatctaccagttgaaatattgatcagacacaacaaaactgcttcaacataagatacgggatgcgctgaacttcttctcggctcggcattgtcaaaattgcatctctccttgcgttgaacaaaggtcctattgctgaagcttcaggactggaaaggcaataacatcccttatgctggcagagtttgtcaaaagcattactaaccggtcgataccaaggcccattccagaagcaggtggcattccgtattccagagaagtcaggaagtcttcatccaaggaaacttcataggaatactcatcatcccccttactctcgtccgatt

SEQ ID NO: 4631 - DNA, 387 bp, Hordeum vulgare
  UNSURE (379): n stands for any base
gcgccacacaaaacatacgccgataggccggctggtcctgataggcgcgacgccgccgccaccgcatcctccctctcagactcatggcgacggtccacgcgcgcttgggctgccttccgccaccgcctcctcctcggctcccccgccgccgcgccgccttctccgccggttcccggcggtccgtcgccgctcgcagtcgcgttacgagtttgcgcagggcgttccgtttgggtccatggactgcgcaggcgatgtccggggcagagccttctgctggtggcggcgatgcgagtgagatcatcgatgcggtggaagtggaacctagcaatcctggcgcttctttccttgcaaaagtggcagttgctctcggtgttgcggngacggtca

SEQ ID NO: 4632 - DNA, 444 bp, Hordeum vulgare
tttttttttttttttttgtagtatcaatcagtataatcgatttgaaagcttccaaaattttacaagcatgtattttggagtcccactgggaaatactactgaactatggtgagctaagtggttggcatgcaccatgaactttcgcagggatcacccagtcagctgctgggcctgcatcgctggaggtagaggaacaaagccgtgcacgccgctgctgcgtaagggaacactgtccagatgcccacaacagctgcaacgctcgcaagccccacgacagggcgttctctgagaagaaaaccgaccgctaactggataggaagagtaaatagacagccgcaacaaattccggcgaaataacagtctgctgatacgcctactgcgcctgccagaaatcctgttggattccttacaccgattgaaaaccgttcaacaaagccaatcagg

SEQ ID NO: 4633 - DNA, 524 bp, Hordeum vulgare
tagcctggtgttggaaagaaggcattctcacaagttaagttcaaagtctggggctgtcgtgtatgatttgcagagcaaacaagttctattagatgggcagtttgaaccctcgcccatccaagaaggtgaattcacctcagtccttgcacttggtgaggtattgtctctatctacctcagcgagggtccaagacttcgtgcggatgctttatgccatcatgtttaagatctatgccgaggatcattatagatgcagatttctgaagggcctcgttgaccgggcaacaaatacctcagataactgccgagaagttgacatagatatggatgtcttggtatttcttgttaaggaggagtttggaattgctagacctgtgttaaacatgatgcgggaagctgctgaagttgctcaggccgatcgtgctaatctttggcaccaaatatgtgctactgaggatgagaatattcgtttgcgggaggagatggacatggatcaaactaaatttaccaatgaaaaagctgtat

SEQ ID NO: 4634 - DNA, 549 bp, Hordeum vulgare
gaatataagcagtgggtgtataacatttcatagctttcacttgcacctgatagttccatcggatctctttgttattacagcttattcacatggagccccttgacgagcgcccatgacatctcgagccgacagcactaccactccagaatagtacaaagcaagaagccaaacggaaaggcatgaacaaaaatggctgccaggcaggattgctcggcagctggtgaatgggatctatcggaccaatgcacgaaatggacatcttcaggccttccgcttgcagttgcatcccatagctaggtttgattgaaccaggggcccaccgcattgttcctgtgcccgtttccatgggtacccacgccattaggagctatggaggacgtgtggatcaatgaggaaggcggtccaacagccatcgaagacgaggggaataagccagggacgctcaagagatgtttccagagtgcgaatatattgctggcaaacttgcagttttgactccattccatcaatgtaagcttcgcagcgagaaatttgatcttctttttcttt

SEQ ID NO: 4635 - DNA, 520 bp, Hordeum vulgare
acgaattaatttatcaaagccagtgagaggtaggttctccattattataaactacatatatatgcttatcatgcaatacgttaattaatcaacataaggagtaggaatcacatgcaaagtgccttggatcaggttattcggtaaagatataaattatgtgaagttccataaaatactttaagataagtacttaaaaattgtccaaggtattcaattattttatgaaaattttggtcattgcaagagaagacatcatataagggcaactaggtagatatgtccgacttctgcagtgggatcctagtttacatgtttctttgttctgttttgatgaggagacttgttaggtccttgatgtggtgctttagagaaaaagaatgggattaggtaaccttgagccgacttttgagacgttggttgatgcatttgtgttcttggataagaacaaagatgggtatgtcagtaagaatgaggtgatagaagcaataaatgagaccagtgcaggagaacgctcttctgg

SEQ ID NO: 4636 - DNA, 552 bp, Hordeum vulgare
ccaagcgcaagtttatcgccaattatctaacaacttcggttcattctattaacaaaacataaacagacataattggcaagacaccaatgaacattttaaactactctttcattatcataagtaggaaagctgttggaggctaccgagggctgacttggcctattcagaatggctaatcttcagctgcgctcattcatcatcatcgtcatcttcgttatcgtcgatccccacccagcgagtaaaggcaaaaagaaactccttgaaggtcaccgttccgttcttgtcccaatccatttcctcaaatcttttcacgcctatgcgtccagaagagcgttctcctgcactggtctcatttattgcttctatcacctcattcttactgacatacccatctttgttcttatccaagaacacaaatgcatcaaccaacgtctcaaaagtcggctcaaggttacctaatcccattctttttctctaaagcaccacatcaaggacctaacaagtctcctcatcaaaacagaacaaagaaacatgtaaactaggatcccactg

SEQ ID NO: 4637 - DNA, 553 bp, Hordeum vulgare
  UNSURE (223): n stands for any base
gtacccccgggtctgcaggcaattcggcacgaggcgcttgtccccttcctccctccctccctcccttccttgttcctcgacccgcgcggcgcaggcaggtcccatccaaggcaggcaggcaggcaggcaggtacgggatggctctcaccagaattggtcttgccggcctcgccgtcatggggcagaaccttgccctcaacattgcagagaaaggcttccccantctctgtctacaacaggacgacatccaaggtcgacgagaccgtccagcgcgccaagctagaaggaaaccttcctctctacggtttccatgaccctgcatccttcgtcaactccattcagaagccacgtgtcgtcatcatgcttgtcaaggccggtgctccggttgaccagaccatcgccacgctcgcagcacacctggagcagggcgactgcatcgttgacggaggaaacgagtggtatgagaacacagaaaggagggagaaggcgatggaggagcgtggactcctctacctcggtatgggtgtttctggaggagaggagggtgcccgcc

SEQ ID NO: 4638 - DNA, 551 bp, Hordeum vulgare
gagagatatgtgatctccttgtagaaaataaatcaggactcattatacctcgaatagtaaaaattaaacggcagttgctcccctgcaggaaaaggactcatgactggcagcggcaaaggataccaacaagacgaaacctgacgggccgtctctcggtagaccagcggcagcagcagcttagatcttcgagttggcgatcttgtaccactctgtgtggaaggagccgggcatgtcgaccctctcgtaggtgtgcgccccgaagtagtccctctgggcctggacgaggttggcaggaagcctgtccctccggtaggagtcgaagtaggccagactcgcggacatgccgggggtgctgacgccgttgttgatggcgaggcagacgaccctcctccacgcggcttgcctgtccatgatctcctgcgcgaactcggggtcgatgaggaggttggcgagctcaccgttcctgtcgtaggccttcttgatgcggtcgaggaagctggcacggatgatgcacccgcccttccagatcctggccagctcgccgaggttga

SEQ ID NO: 4639 - DNA, 382 bp, Hordeum vulgare
ggaattcggcacgaggtggtgatgtcgtcacctttgacaccacctacaaaactaacctatatgatatgccttttggtttatttgtcggtgtgaataaccatttccaaagcgtgctctacgctggggtgctgatgcgagacgaaacagaagacgcgttcaaatggatattcgacgagtttacaaagatcaagctagagctatggaaaaggctattgaagtcgtttatcctaattccacgcacacatggtgcaagtggcatgtgctaaagaaggcaaaagaaaacctggggtcgcattacacaaagaaatcggatttcagggcagaattccataagctcgtgcatgaaatgctgactgtcgacgagttcgaggatgggtgggcg

SEQ ID NO: 4640 - DNA, 534 bp, Hordeum vulgare
agttacgaagttacaaagtttgtgaaaaactacacgatacactacaacaacgcgagcctaatgtgtagaggggacaccagccatcatcgagaggaggggcttgctgcacgttgtcctccggtgccctggcacaccacaccttccgcaagtagcaatcttcctctcttttttcagggtgtcacctcgatcagggcatgtgcttgatttgtgccccttgcccctacagatggagcagaatcttgatcttttaccgctttctttctcgtatggatctttatctcggcttgtcgttggccacccatgttttttgtttctttctggcgcaagcaaatcttgttcgccattcatcatcagacgagagccagcttcagagtagtccgagttgtagcttgctccgtttgcgcacgatccctctgacgcctggctgaccggagggtgcaccgacaccgagactgcatctttagatttcgagcggtttcctttcacgctcctcatcgaacaaccagacttgccatcgagcaagttcgccccaga

SEQ ID NO: 4641 - DNA, 2022 bp, Hordeum vulgare
  UNSURE (1),(20),(103),(342),(542),(846),(894),(1123),(1167),(1191),(1258),(1278),(1294),(1300),(1308),(1358),(1372),(1438),(1505),(1620),(1681),(1683),(1704),(1738),(1779),(1831),(1841),(1894),(1902),(1906),(1921): n stands for any base
nggggggggggtgggggggnggtgggggggggagagcgaggtggatgtgggggtttttcttgggatttaaggtagagagtgtccatggcttgtttgattgganagatgagtcattatgatctttttattcaccatactaactatactttcttactccacgcactactcgcctgccgacgattcactacgcattgagatcccgtcgttatgtcgtcatcttactatgacaaccagaagcacggcaccaaaatctctacatatagacgtagaagctccccacagtgagggaggggagtaggtaattaacattatttaataattcgtagatattaataattatanaaattatatagaggagcggagagttgtatggagtgatgatgtataagtagttatgtgtgtgtttttatattattgtgataagttactactactctactcatgattttgatgagacatccgacggtcacgccatagcagatagcgatatcggcaacagattgcattacacgaaataacccgagatcgcatactctgtctcncgcctcgagtcggagttttgcgcacgtttggcctcgtgtgttgaccgtcgatatctatctaacgtagctccctagtcgttcgcgtcttactctacagttcactcgcactcactcctcgccatcaccattcacacacaacatacgatacatcggacaacattaccatcactcaaatcccgcactctaacctaatctcttccgcgaagtctacagaattataatgcacacatgatacagcgatagtactgtagataccaatctatttacgacgatgatactcacatagttgcgttatgactcgcanttgggcacgtatagtatagatattacggtgtgtagactgtgtaggacntactcggaaccatcgattgatacgcttcactctcggccagtcatccgcggtcgcgatgtgctgacacgccgaacttctgtcgcactatagacatatatagtcgagtagtacgagatgcgaaagagcgtacgcattcaaattctaacgctcgttgtgttacatgtgtacacgccgcgcgcacgtttcatgttgtgccgcttagctacgagaggtatgcaatagaactagncacgacagaccgcgctgccgcagcgcgagtttccatatcagacntctctgcattcacaacacgccatnacgctttctattcaaccagacacacgcattccacgatacaaggtaccagcgcatgtgaatatccttnttcgcgatccgagatgcgcngccatgcttcccgacntacgcngtaccgcnattccgcacctcgcgacattgtacgcctactcggtgtgtataccctaggnattagtcgcgctcngtcctgcacgtcacacatcgaccaccacgcagtgttagtgctttcgcactcattctgtgtctcgcncgatgccgaagtgtactcgcttcttcgtccgtcttcttcgacgacaccccgcctgtgtgatcgcgangtctttcacccccatctcgagacgatactacagactcacacttcacatgctgacccctctctatgcgcgcatctcatcggctgctcagagttcccctaccgtcacagctctgtcngccgtcgcgagctcgatgcataattatctaccaggtaagaacggctactgtagatggatantngtttgtattaaccacatctanactgtgcgactcatggagcgctcagctctacagntcatatcactcgcacgcggcggcacgtctatattgaagcantcatacacagcccttctctatcacagtactatcgtattaacccccatatctnatcgctcaantgtctgtcccctgtaatgcgctctccacgaattgatacgacgcaccgagtgtncgcccggntacntacacatgatagtanagtgagatgacgtctgcccagatgtacgcatgatgctgcgagcgatcaagaaatatgactgcttcatctccgaacacgtagatgtaggtttatgtgagaag

SEQ ID NO: 4642 - DNA, 351 bp, Hordeum vulgare
ttcgccaccgtagagattacctaatacactaagatcgatacagataaacacacatcatggctgttacagtaccggccgacttcatatacagacggatgaacctatcatttaccaaagagcgacttgaaccaccaggcccctttgctgtcggtgggcgcagcatcgccctccggcggcgggtcgctctgcggcgtcttgtgcagcttggccacgtcgtagccttcctccttggccttctccagcagctgggctcaccgacgagggcatactggtagtcgtcgtcgacatagaggacccagtagtcgtcgacgacggggatgatggggaggaacggcgggacgtagaacttga

SEQ ID NO: 4643 - DNA, 1060 bp, Hordeum vulgare
  UNSURE (1)..(3),(12),(20),(21),(29),(30),(55),(70): n stands for any base
nnnggtttaacnccctgacnncatatggnngcccattaggacgtgttgcgccggncacagagcgatcgancgagtttccttgcgccataccgatggctctggtcccctcgggctcaggcagcgcgccagtgattgccgaggtgtatatgaacggcggcgcataccatatcgccgtcaccgtacgagccaccgtcttgcaggcctccaccgtcttctacgactcccttgccactctagataaagtacacttattgttttcgggggggtgttttatgttgttcacagtcagtttgcgtttctttttttcttcagttgatttctcttctcccgcattctcttttttctgttggtgttggtttttgggtttttcttttgatcttgtattttttttcttttatttcctatggtgtgcctttccagtggtggtgggggttttttcttttttttattttgcccccatctccttttttgaacctcggtgttgtcttctgttcgccagcgtgtttgttgatgtgggtcttagatgctcattccgccgtttttttttttctcttgtggttttttttcttgcgtattatcgttcgtttgatctctctttttattctattttttccgcctccgcatatttcttccttcccgcttacggttggttttttatgttctttagcttcgttagtattattttttcttgtctgttttcttttccgcccctttttcgcgtttttttaatatgttcgtatgtcccgtctttgtgcttctgtgttgttgtatttcacgctttcaattgttatccgctcttattggtatatagagcggctccgtggttttccttcttctgttgcgatgtaggtacattacttgccccgcgttgagtgctctttttcttttttcttgctcgtttttttttttttttcttgtgttctcgtgtttattttgttttctgtattatttttttacctttccgttaggtcgccctgtttatctgtctctgggcgtgagcctgttttttggagtgtggtactcgggtgccggggtgtttgttctatttttgtgtcgccat

SEQ ID NO: 4644 - DNA, 551 bp, Hordeum vulgare
gtgaacggacctcagctgattgttcgggaatgcactttacaagcagcgaaagttacagggggcgtcagacatgcgggcgatccgagcccacatttcatcgccttattaagctaccaacagaagtcctttcatcacacaaaaagagaactatcgatagttatcaatcaactgctttgtgactgagctgatggtcgtcaggcggtcagggctttgcggcgccgtcgctcttggcagccggggccttctcagcggcagaggtgaaggacaccggacggtgcggctggtcgtccaccaccaagcccagcacctcaggccgagcgtagtggcccaccacgtcgaaatcaaacttggcccgaacgatctctcccatgtcaaggtcggctgtgatcagcgcctctccgtcgtagttgggacctgccaggacttcccctgacggcgaaatgataacactgcctccagggcaaacaacggtgtctggagacggctcttctcctaaaccggcaaaggcgtactcggatggcggagggtagtcctttctgcggcagaactgg

SEQ ID NO: 4645 - DNA, 517 bp, Hordeum vulgare
gcccgcccacccgcctatcgtcgccgtctcgctcctcgccgccgcaaagatgccgttcaagaggttcgtcgagatcgggcgggtggccctggtgaactacggcaaggactacggccgcctcgtcgtcatcgtcgacgtcgtcgaccagaaccgggcactcgtcgacgctcctgatatgatcaggtgccagatgaacttcaagcgtctttcactgactgacatcaagattgacatcaagcgtatccccaaaaaggcaactttgatcaaggccatggaggaagctgatgtgaaaaccaaatgggagaacagctcctggggcaagaagcttattgttcagaagagaagagcatcgctgaatgactttgacaggttcaaggtcatgttggctaagattaagaggggtggtgctatcaggcaagagcttgccaagctcaagaaggaggttgctgcttagaataccttagtggatgttgcatgttgagttttttgttccaagttggatctgctctatgttcca

SEQ ID NO: 4646 - DNA, 555 bp, Hordeum vulgare
  UNSURE (535),(548): n stands for any base
atgcaacatttcaaatgaagggggcagcggcacatctgtagcaaactagcttgggtattcaataacagccatgaaaagatatgaaatagtttcctgaaaacagttgtactaactctggctttaagaacactggaacatagagcagatccaacttggaacaaaaaactcaacatgcaacatccactaaggtattctaagcagcaacctccttcttgagcttggcaagctcttgcctgatagcaccacccctcttaatcttagccaacatgaccttgaacctgtcaaagtcattcagcgatgctcttctcttctgaacaataagcttcttgccccaggagctgttctcccatttggttttcacatcagcttcctccatggccttgatcaaagttgcctttttggggatacgcttgatgtcaatcttgatgtcagtcagtgaaagacgcttgaagttcatctggcacctgatcatatcaggagcgtcgacgagtgcccggttctggtcgacgacgtcgacgatgacgacgaggcggcncgtagtccttgcncgtagtt

SEQ ID NO: 4647 - DNA, 524 bp, Hordeum vulgare
  UNSURE (484): n stands for any base
atcaggatgaaaggcatgatggccctgattctgacatggaaatggattatcacacacctttggaagactcagcaaggagaatcactattcaaggtgcaagagttaagagagaatcagctggagctgaaacaaaagatcaggatggtagcagagtaacaggtgaacatagaggaccagaacctatggcagaagacatcggtccctctaagcaagctcatctcgatgctaatgccatggctgtcgatgagccgggaaatgtcaagattgagtcaggaagctctagtaagttgccggacccaccagccatctaccagaagccatgattgtaagcattcggaccgtgcgtgtgttttgacagtaaaaagacgaagtgatgagtggtagtctcgagtgtctaacccatgtatacatgcagcatggattattaagctgtaatatgtatagtcgattaaatgagccgtgaggcagaattttcttggcttanaaaaaaaaaaaaaaaaaaaaaaaaaaaaaaaaaaaaaaaa

SEQ ID NO: 4648 - DNA, 483 bp, Hordeum vulgare
  UNSURE (23),(24): n stands for any base
ggccataaaattcttgcctcacnnggctcaatttaatcgactttacatattacagcttaataatccatgctgcatgtatcatgggttagacactcgagactaccactcatcacttcgtctttttactgtcaaaacacacgcacggtccgaatgcttacaatcatggcttctggtagatggctggtgggtccggcaacttactagagcttcctgactcaatcttgacatttcccggctcatcgacagccatggcattagcatcgagatgagcttgcttagagggaccgatgtcttctgccataggttctggtcctctatgttcacctgttactctgctaccatcctgatcttttgtttcagctccagctgattctctcttaactcttgcaccttgaatagtgattctccttgctgagtcttccaaaggtgtgtgataatccatttccatgtcagaatcagggccatcatgcctttcatcctgat

SEQ ID NO: 4649 - DNA, 527 bp, Hordeum vulgare
ggcacgtggttggagtgctccccaacttatggtttttcaccgttagagtagcgcgggtgaggccggtcttcgtgggggaaaatgggtgtgtactggttctcggcgtttacttatgagataccgtacacgggattagtacacgtgactattgaaacccgtgggttgtgggtaaagagtacaccctctgcagagtcaaagctattcgagtagccgtattcacggtcaagcacaactggtggactagtcaagtgtcggtctgagtgttggtctttggaggaattagacttaaacaggataattcgtgtgaaccgggatgataagtattgctattattatgaattctgttatggactaatcctgtgtgatataaggatttattagagtgtccttgggacggttctacctccagggtactagatatatctattattttattatggcctttttgtggtgtcgctcaaacgcccgattgtggcgagtatttattttattatgccctttttgtggtgtcgcttagacgcgtgact

SEQ ID NO: 4650 - DNA, 552 bp, Hordeum vulgare
  UNSURE (29): n stands for any base
ggtaacaattttcagaaaacaggcccttnatgttcactagccccaggaatctgttagctagtggacactcacttgatacataaataccaagaaaaaaatacaaagtttgggtgacaagactataaaggtccactggtttgaaccaagtttgaggctgacggcggaagcgactcgaggaatctccagtgcccatgaactccatttccacaggaatagttgacctggataagttcctatctcacaaggctgctatcctcgactcatagattcgcggggttgatgacatcgtgctcctctccaatgaaatctggcgaagacaatagccagggacaagccagttcgtactttgaatgtactcgcaaacatctagaaaacagataagttaaagtaggtgagatgcatgcataattcccttaataaatatatcatgcgataagaattaattcatggatgcattcatgcagataaaccatttccaccaatgttgtataagcaagcaaggattggtaacagtaaattataagcttgttgattgggcatctgaggcgacac

SEQ ID NO: 4651 - DNA, 496 bp, Hordeum vulgare
cgatcggaggaggagtcggaggcagaagagaaggagtgaaggaggggcggcgggatgacgcggggaaagcagaagatcgacgcgcagcggaagagcgcggagaagaaccagaagtccaaggggtcccagctcgaggcccgcgccgtcggcctcaaggtcgtctgccccatctgcaaggcgcaactagccaacgagaagcaattgattgatcactatggatcaaagcaccccagggagaaacctccaggtccatcaaatgcagagtaactgatgggaagcggaagcatgagctatacggactgtttctgaggctgctcagtctgctccacacttggacgacttgagcttcagctttaccctatgtaatgtatgcatttcctcttgttccaggcaagagccttgatgagcatgtatttgccttctatgagtatcttgtcaaactgtcgacataccatcaaactgtatgtgctgcaatctttggataagagaatgctaa

SEQ ID NO: 4652 - DNA, 502 bp, Hordeum vulgare
  UNSURE (14): n stands for any base
ttagtttagcattntacttattccaggattgcagcacatacagtttgatggtatgtcgacagtttgacaagatactcatagaaggcaaatacatgctcatcaaggctcttgcctggaacaagaggaaatgcatacattacatagggtaaagctgaagctcaagtcgtccaagtgtggagcagactgagcagcctcagaaacagtccgtatagctcatgcttccgcttcccatcagttactctgcatttgatggacctggaggtttctccctggggtgctttgatccatagtgatcaatcaattgcttctcgttggctagttgcgccttgcagatggggcagacgaccttgaggccgacggcgcgggcctcgagctgggaccccttggacttctggttcttctccgcgctcttccgctgcgcgtcgatcttctgctttccccgcgtcatcccgccgcccctccttcactccttctcttctgcctccgactcctcctccgatcg

SEQ ID NO: 4653 - DNA, 459 bp, Hordeum vulgare
ggcgtgtgtgctcaatgcattgtgctatgctgaactggcatctcgttttcctgctgtggtcggtggagcgtacttgtacacatatgcagcgtttaatgaactcacggccttcttggttttcactcagttgatgcttgattaccatattggggcagcaagcattgctcgtagcttagcgagctattttatccaattcttggagctgattccgtccgtgaaaggcaatgttccaagttggattgggcatggagaagagttttttggtggtgttgtttcagttaacatattggctccaatccttcttgtcatcctaaccgtgatcctctgccgtggtgtcaaagaatcgtcagcagtgaatacttttatgactacattgaaaataatcatcgtcatagtcgttgtatttgctggcgtatttgaggtggatgtattaaactggtcaccatttatgccaaatgg

SEQ ID NO: 4654 - DNA, 343 bp, Hordeum vulgare
ccaaagctttcaatcgtgacttcaaagcttttccagatgaatctttggtgtgtgtgtgtgtgtgtgtgtcctgctaacaaaactatcgctgccatttcattggtaaatgatatggtggctgatctccaaaatttcatacagatgtacatatggaatggagaacgaactacacatagggcttcgagcaatacaggtaaaggggtacgaccatggcctcccctgatgatccgatggtacatacattcagataaatttggaggcttgcaatagatcatggggcttcagaaggcactccatggtatgcaacatatgagtggtccgaagtggatggaacagcgttgta

SEQ ID NO: 4655 - DNA, 553 bp, Hordeum vulgare
gtacccccgggcctgcagggaattcggcacgaggggagaactccccacaagaccatcaaattccccacccgcaaccctttgctcgactcaaaaccctcgacaagcgccgtcgacctcgcgcggccgccgcaacaatggcgtcccttttaaggacccgagcaagctgtcggtgtacagggaccggcggttcccagggacacaggaggagtttgagggggcgctgctggcgtcgctgacggtgtacgtggggaacatgtccttctacaccacggaggagcaggcctacgagctattctcccgcgcaggcgagataaaaaagatcatcatgggcctcgacaagaacaccaagaccccctgcggcttctgcttcatactgtactactccagggaagatgctgaagatgcagtaaaatatattagtggcacaatgcttgacgatcgcccaattcgtgttgattttgattggggctttgaagaaggcaggcaatggggccgtggaaggagtggtggacaagtccgagacgagtaccgcacggattatgatcctggaaga

SEQ ID NO: 4656 - DNA, 538 bp, Hordeum vulgare
aaacattaggtagctgacgctaggcggccccttaaattaagataggttggtctacagttctcggccactgaatgatctcacttcgactagtcataactttctggagattcatgttcctgtaactattcttaaaactaatagtcttaatcagcagcatacacatgcaagagtttcagggggtgcagagtcatatgcaaaggctgcactgtgctgatgaactgattctaaaacgcagacaaaatgtgaatggctcaagggaaaatcaagtcatatggcatacaggatagatagataatactactattgtagtcattgggcatttgaatatggcagcaatttgcttctcatgttcagcgccggcgtttcttatcatagtcctcgtcttcatcatcagaatcacctttctcccgaaacctgggattcttttcaggctcttgattagcatctctcttagaatccgagtcagttgctctcctggccatatctggtgctgatcgtctccgttggtaatctcctctgtcattccggtcaccatatc

SEQ ID NO: 4657 - DNA, 511 bp, Hordeum vulgare
gcagagcaattaaatgtgaattttgtgatccacgcatacacttggttcaggtgcacaattcagaatttttcatctacgcacgcagtatacctgtaggcctatttttgtatgttattcttggtgtgatccatcattttgttcaaggtttatttgttggatatattttctctctcctgtagttgagtcacttatgataatttctactctctccgtttcaaaatataagtcattttaaagatttcattaggagactacatacatatatatatatagacacattttaggatgtagattcactcattttgcttcctatgtagtcttctactagaatctctaaaaaaacttatatttaagaacggagggagtaagatttaggagggcaaggctgaggagagggttcatattcattgaagcaatttgtcttctagaaatagaaaatattctgatgcctaaagacgttattgaaggtatatgaatttatcaatttagggcctccttttgcattttgcac

SEQ ID NO: 4658 - DNA, 544 bp, Hordeum vulgare
gctaataactttctctatcctgaacctaacctcctcttcctacaggtttaactctgagaacttccctgtagctagagctagatcattgtaagcaactctagggaatttcttgtcaaaggaaagcaaaattgaatatgttcctcttgtcgtgctcttcccaaagaatataatgtaagccagcattacaagtgacgtgaatccaaataatggaatcagcgctctgaccaaatagtattgtgcctctaacctccaagaaacaacacgacacatgggcacgtggacccaccacgcctccacatagctcccaattaccctcaagtgaaacagctgtagcaatccgtctccaggaatttgaggccccggtgcaaaatgcaaaaggaggccctaaattgataaattcatataccttcaataacgtctttaggcatcagaatattttctatttctagaagacaaattgcttcaatgaatatgaaccctctcctcagccttgccctcctaaatcttactccctccgttcttaaatataagtttttttagagat

SEQ ID NO: 4659 - DNA, 486 bp, Hordeum vulgare
tcctcgctcaaggaaggacaaaggtctggatggtagcctagttggttcaaggatcaaagtatggtggccagatgatgagatgttctacaaaggtgttgttgactcatttgataaccattccaaaaggcataaggttgcatatgatgatggagatgtagaggtactgttgctcagggatgaaaaatgggatttcaccagtgaggaagaaagcaaaactcctgatgtaccatctgttataccccgtggcagaaaagggagaggaatcacgctgctgccagtgaaggaagaaaaaatagaaacacctaaaagtgacggaggggagcttccaaagaaaaggggccgtccgaaaggttggcgccccaacaatggcaccccaagcaaatcaaaggggaaaactgctatgaaggatgccaaggggacacctaaaactcccagcgagattaagaaggaagtcaaggaaaaagccaccactggatcagctaacaa

SEQ ID NO: 4660 - DNA, 557 bp, Hordeum vulgare
  UNSURE (26),(30),(38): n stands for any base
gggtcttgcaacattcacattcatgncatncccacaancataaagcccgactaacattacagctactgcagatgtttcctgccacagcccccctaataactacaacagacacagacgatgatgcccagtcagcagacagacaaattcaataggtaaggtaaaaacaacgaccaaggagttacaatccatacaacggtgccatgatgagagcgagcccatttacgagggaagttcacggttggtttaagcttaagccttccttctgcgcttctttccagttgaagacgcccccttgccagatgcctcctgctccatttcagatgcctccgcctcttctttctcctcctcctgcgcttctttctcctcctgcttctcttgaacagatccagatccactacccaccactggagcgctttttggcttccggccaggcctacccttcacagatccatcgccagatttgcttccatccttgcccttgctcccaacctccttaagcttctggttgctgctgtctttagctaaatcatccttcatcttgttagctgatccagtgg

SEQ ID NO: 4661 - DNA, 517 bp, Hordeum vulgare
atcgcaactccctcgtcaagaggttccgggcaaggccagcgcggcggctcacgctcaccgaggccaggcggggccttatcggcgacgttggctctgtgcgccgtgtgtttgacttccttgaagaatggggcctcatcaaccatggtgctcctccgctgggggcgaagcaggggaaagacaagagggaggaaggggcgacttctcagtcttcattgcctgctggaccaaccacacccaagaagctctgcgtagggtgccgcagcgtctgcggctctgcctatttcacctgcgagaaggcggatataagcatatgttgtagatgctttgtgcgtggcaactatcggcctggtcttactccagcagacttcaagaaagttgaaattagcgaagacgccaaatcagattggacagacaaggaaactcttcacctacttgaggctgtcttgcattatggagaagactggaagaaggtttctgaacatgttggtagtcgctcagagaaagactgcattgctag

SEQ ID NO: 4662 - DNA, 554 bp, Hordeum vulgare
tcattatctgaacttgttatagttttttacgttggacaaataataaaatagacaacaaaaattaaccaagcatgaaacaaattatccatcgcattgctaggtcacctcgggaagtttagatcggtaccactctagcatgttttcaagctccccctcttcaccaaacggatcagcccatttaacgtgaattccatatcagtctggtgtttttaagaacaccatttccattagctagactacaatgtaatcagacgacattagtacaacatccaaggcagccacatacaaacagaatacactaatctagagcctgcaaaagaagattaaatttagtgttcgtcacaggattccaacaatatgtatctcccttttgccgacataggaggaacagagttccaatcctcacagccctccgatgctaccaacgaaggcccacttgatctaactcgtggtgataataggtttcggtttctcctcctccttgttctcagctgctacaacatgcggtctgcgctgatgctgcacaaccgcaagctgatccatgaaaagcagtt

SEQ ID NO: 4663 - DNA, 215 bp, Hordeum vulgare
aattcaccgagcctttccatgattctaagagctcacagctgccaaagttggtagtctgggacaaagatgaggagtatgaagtggttgagggtttggagagtttggaagaaggtgaccatggaccccaaattagtcgttttctcgaggcatatagagctggaagaacaataaagaagacattgggcagacgttccccaacgctgcttggtatgaat

SEQ ID NO: 4664 - DNA, 229 bp, Hordeum vulgare
ttttttttttttttttttttttttttttgcatgggccaaaggagataactgacctgatatattctggggtgcaagtcaataacttcacatgatataaaatcaataacttcacatgacataaaatcgctaaacagaggggctagtgactgccaggtcggacaagggaaggtcaaaactaaggcatgtgaaatttaaaatcagaatatcctcgtctccaggttcccctttc

SEQ ID NO: 4665 - DNA, 519 bp, Hordeum vulgare
gcctcaccggcagcagcgcatattatccaactttgcagattccccctacaaagtccgaggtgggaagactgctccattatcacaaccctgtggatcagttgacactagtctttgggttgcaaaatctggacagtgccttctgaagtttgacagtcattatcttgtcaacagtacattgccctgcaagatgccaaaaataaagaacctgtctgatgcatgtaaagtatcattttctccagatggacccatatctgaagaaacactcgagagagttcgtgcactgttagatgagatcagacctttagatcttggcctagataacgaagcacaaattgcacgtaattggaatagttctacgcgtcaacagaatgggaggcgcggacgcggcgggcctaaccagtacgcgccctcaatcaaatatctccacattcatgaatgcgaaagtttctctatgggtatattttgtatgccaccgtcatcagttattccacttcacaatcatccaggaatgactgtgct

SEQ ID NO: 4666 - DNA, 544 bp, Hordeum vulgare
aagttttattccaaagaatgtttatgcgattgtttacataatgacaccgaataatcagttcaccacaccaaatcaatttttctgaaacaatcattaggtgagaagcccatgccacttgttctacctaatacagcatggcaagaactctccaatctcaaaagaagtatatactccaaggccttcatctgataaaagagccacgtgggtacatcacagaccagcagcattgctccagtaccgagcaggaacaatgaaaatggtctcaatcgtttcttcattcacccacaacaggtggtgtgtgtacaatgtaaaccacaggctgcttgcgggttgcctggatgatacttgctctactaagccacatacaactgatacgaggcgccctctgggtcctcaatccattggcaaaagtggtatcaaaacctaactatctccttatcacagggcctttgtacaaacctctagcaacaacaaagccctctggaggctgatggtcctccaattcctccaaccagactacctcagagctatctatttcactcgg

SEQ ID NO: 4667 - DNA, 519 bp, Hordeum vulgare
caccacccattatcactcgctcttgttattctctatccagccagaagaagaacaccacctcgaccagctcatactccccatcctgccaatctgatcttcctcttgatgctatttttcctggttccagcttccccctgatgaggacacggaggagccggtcaaaggatccagcgtcggcgactcttagctgctccacacgagaaggacgaagctcaattataggtctcgatctggccaacgaaagcattaaatcagtccaatctcgccaggtttagaactccacacaccccctcccttcctcccgccttttctttatctcttatgttcctattctttttaccttcatcattgattcacaacttttacgcatcctgttctccgttcggatgttgaacttggtggggatgaactgccggaggaaattttggatcgagatttctgtggtatagatacaccctctgaccacaaatgccatcacagacttaatccagcaagaaaggttgctttcgtatgtgcagt

SEQ ID NO: 4668 - DNA, 553 bp, Hordeum vulgare
  UNSURE (14): n stands for any base
tgcatgagtatgtntcatattgaaaaattgatataaaacatcaactcgaattcccaattgcacacttcaacataccatcgcattttcagctaaacttaagggtgaccgtataatcatcatacaatctgcagaagcagcttaatgcatcagctacacacttactactaacactacattactaaggagacaacacataagacatgactactactagagtaagaactaaagaacttgaggccacacacagcttagtgtgaaaatccaacctcctggccatcttaatttcagtgtccactataatgttcttgagattgctgaccacccgctcgtgctcggtctcgatattgcttctctcagtctagagctctaagtaaacctggtccatttctttcttcctattctccaacacatctgatctatcgcggtatagagcagcttgatcccataggtgcattattaagcgtgaaagaatagccccccatggttcgtcaatccacttcaaccaactgcatctcttgtttccctgaggatgtaaatagtgagggcatccgag

SEQ ID NO: 4669 - DNA, 520 bp, Hordeum vulgare
aacctccctctttttcgtcgaatccagccaccatgaaaccctaagaccaccgtcctgccgaatcctccattgccctcccagatgcaggcgttcgcgcgcctctcctcccccaccgcctccagaaaggtggtttcgggcgtctctgccgcggtcacaaagccgtgctaccggacatggcgatggaaggcgcatgcggcgccgctgtcggctccggacccacccaagggcaagaagagggaatacatatccaaaaatgaaaggaaggctaggatgaaggagtttattgagggttaccaggcatcaaatgacggtcgatttccgactagtcaaatgattcgtaaaagtgttggagggagtcactacacaattagggatgtactctcggaagtgaagtataaccagataaagtttccgtttgataagtctcaggcagcccagcttcaggagacagctgaaggtgctgagcagtcaaggccagaggaggagagtggaaacagttcatttaactctcacagcttta

SEQ ID NO: 4670 - DNA, 287 bp, Hordeum vulgare
atagcttacagcagtgcattatgatagaccagcctgtaaacattagatgcacccaaatatgctcctatctaactcctccgtcccataatataagaatgtttttcacactagtgtagtattaaaaacactcttatatatgggaaggagggagtagcttataagtcccatgacactgcaggaatcagaccaatgttcagtagtgcaaaaatataactttacagctttcttcaggctcacaaaaatgctaaacagggggcacttggatcattaactctgtagccttcaca

SEQ ID NO: 4671 - DNA, 440 bp, Hordeum vulgare
catgtttccccatcttcctcctccgctgctccaggaatagaagcggcgaacagaaggggggtcgaagctatcccagctttccaaaccccactctagctagacccgtgctgattgatttctggctgaaattctgtccaagatgagctccgagtccagggggctgctcggaatcgaccccaacgagctccgcttcgccttcgagttaaagaagcaaatctcgtgttcactgcatctaacaaacacaacggaccaatacatcgccttcaaggttaagacaacgagcccaaagaagtactgcgtccggccaaacaacggcattgtgccaccgcgatcaacattcgatgttctagtaacaatgcaagcgcagcgggaggcgccaccggatatgcaatgcagggacaagttccttgtgcagagcgccgtggtgagccaggacatcg

SEQ ID NO: 4672 - DNA, 407 bp, Hordeum vulgare
tactgtttacaggttccaaaaagatgcaaataatcagccatacagtaatattttctaaagaccgacttattgactcgctacagcagctaatatgaattaaaaaattataagaggcatcagatcctaagataagagaccatgagttgtacatatgtctaacgagaccgagagcacgtatgatatccaggtcttgacagagaactgaaaaaacctgcattcttacacaagctcatctcttcatgaaaaagcctagtaggatgcccagaatagcggccacgagcacaaaaagtagcgagaaaccgacattctgcctgctgatttcccgtcttaggagacgcagttcctctcgaagcttattgttctcttgaatagcaaaattcttctcctccttcatcaacttcgaaatt

SEQ ID NO: 4673 - DNA, 535 bp, Hordeum vulgare
aattcgtgacgaggccgcagccgaggccgggcaagggagtcaccaacacctgcgacgtctgcgagcgcagcctcctcgactcgttccgcttctgctccctcggatgtaaaattgtaggcacgtccggcggccaccggccgaggaagaaacacggcggcgtcggcggcggcggcaagaagaagaagagagcggcgctcaaggacgcgcggtcggactcggagcactcgtgcacgagcacaagcggcggcagcagcgacaagagcagcgtggtgcagagcttctcgccgtcgaccccgccggccacctccagcagctaccgcgccggaaacaagcgccgcaagggcatcccgcaccggtcgccgttcggcagcctcatcgtggagctctaggacggcacacagagccaagcgcatgtctggcctgatcaacgctctagcctactgtatacgtgacatagccaagaaggtaatagctgcgcgccctgaacggcgatgagccgccgtcgaggggcacacactaatactatagcgtggta

SEQ ID NO: 4674 - DNA, 570 bp, Hordeum vulgare
  UNSURE (23),(24): n stands for any base
tgtgcaaaaactttgggtccgtnncgtcatggggagttgcaagggttactttacaggtctgacactagggttttaccagtggtaactagctaaaactcgaaactggaagtaccacgctatagtattagtgtgtgcccctcgacggcggctcatcgccgttcagggcgcgcagctattaccttcttggctatgtcacgtatacagtaggctagagcgttgatcaggccagacatgcgcttggctctgtgtgccgtcctagagctccacgatgaggctgccgaacggcgaccggtgcgggatgcccttgcggcgcttgtttccggcgcggtagctgctggaggtggccggcggggtcgacggcgagaagctctgcaccacgctgctcttgtcgctgctgccgccgcttgtgctcgtgcacgagtgctccgagtccgaccgcgcgtccttgagcgccgctctcttcttcttcttgccgccgccgccgacgccgccgtgtttcttcctcggccggtggccgccggacgtgcctacaattttacatccgagggagcagaagcggaacgagtcgag

SEQ ID NO: 4675 - DNA, 525 bp, Hordeum vulgare
  UNSURE (1),(2): n stands for any base
nnaggcgggaaaccaccaccagccagcagcagcgccggcgagaggggcagaagagtagagggccggaggcgatggggctgggcgtgagggcggcgccgttcacgtacgtggcgcacgcgctggccgtggcggccgccgccatggtgctgtactggtgcatccacttccgcggcggcctcgccttcgaagccgacaacaagaacctcatcttcaacgttcatcctgttcttatgttgattggctttattattcttggcagtgaagctataatggtatacaaggtacttcctacggtgaaccatgatacaactaagttgatccatctagtactccatgctattgcgcttgtgctcggtgcggtcgggatatactgtgctttcaagaatcacaatgaaactggaattgcgaacttgtacagtctgcattcttggcttggaataggaacaatttctctatatggtattcagtggatatttggattcttgaccttcttcttccccaaggctgcgccaaatgtgaggaagg

SEQ ID NO: 4676 - DNA, 551 bp, Hordeum vulgare
  UNSURE (25): n stands for any base
taaatagctgcttacatagatgttntaattatacatgatacatcgaagaacaatatgtgcttgtatgtatttacatatacacaaggaagatgcatgacattttgttatcagatcattcattttcaatcggagagatactgttatcgcagcactatggtgacagctaactttgtgaatttctgtttatgcagtacacttcacacatactagttttctgggattggagcgtaaccctgtggttcttcaaggcgagctggggcaacagcagctacaacaactgaggcaccaaatagcacaacaaccaacgccgtgaagttcaccagaaatgactctggcccatatttgtcgatgcctgagctttggaggaaggtgagcttctccagaaacccaagttctgccgttgccagggctaaaatgtaaacgaagattccaagaagtacgtgccaaggaagagcacccttcctcacatttggcgcagccttggggaagaagaaggtcaagaatccaaatatccactgaataccatatagagaaattgttcctattccaag

SEQ ID NO: 4677 - DNA, 344 bp, Hordeum vulgare
  UNSURE (4): n stands for any base
gggnctgcaggcaattcggcacgaggcgaatcgctgctcgtcgtcgattttcgcttccgcccggttcctgccttccttcctgaagacaaaggatcaggtgtcgcaatggtgggaggaacgctgatctcggtttacccggacgacctcaccttcctcttcgagctggacaagccgtgctactgcaatctcaaggtggagaacaacatcgaataccttgtcgagttcaaggacaagacgacgtctccgaggaagtatttcgtccggccgaacgccaatgtcatccagccgtgggattcttgcacaataacaattaccctacaggcacagaaagagtaccctccaga

SEQ ID NO: 4678 - DNA, 547 bp, Hordeum vulgare
ggaataaatgtttttgaatacgaatcggtatcagttttttataaaaaaattaatactgttggtcaaagtctacgaacaaaatacgtcctacattttggaagagtcactaggacacataacacatacttcctttccagcctttacattcctaataggtgaacgcatacacttgtcttcctgatatatgccaaactaattatacagaaaaaatacacagtagaggaatataaatacaaatggaagacgaagcaaacacgggctaaacattgcaaacccgctgtgataaggcatgtatacctacaatgcaaagaacaaagaatgatagttgagactagagtaatatattttttccatctttctccccaaagcatcaggaaactgagctgaataatgttactctaggcttcaatcctggcatctaagcagtcgctggtggggaagagaagatgaggctcatcaagagcccaaccaggagacctatgatcccagcaaaagcagcaaaggtcaaagagaaaccagcatcacctttgcggcttctgcgcctcct

SEQ ID NO: 4679 - DNA, 552 bp, Hordeum vulgare
gtctccccgggtctgcaggcaattcggcacgaggggctcggtggcgccctgctccagcgagcgcaggcggaggagggacgcctgctcgccccaagcaggctcatgcgctcccgccacctgtccaccaaggtctccggcgagcaggcttgcaacatccagaaggaagaggaagacatctgggcggggttcaaggagacgttaaagaagttggaccagctccccaaaaaagagaaaccaagtgtctttcagcagcgcatgaaatctatcgaccgtgcggtcaaggctgtggtctatggatctttcaagctgacaattgtggttatggcagctgctactgctttctctggcaatggagtaaaagcctagcccaggcccttaccaaggaaaaccagtgaagacaatatggagaaatgagaaccaaagatggccgcccagcttgttttatgtttaattatcatgacccctgcactttggctacctagctcactatgctaacgtccgttgtgatatcgtgtgacatggtatcatgttattatacctctaaaaaaaaaa

SEQ ID NO: 4680 - DNA, 505 bp, Hordeum vulgare
ggaggttataacatgatacccatgtacacgatatacaacggacgttagcatagtgagctaggtagccaaagtgcaggggtcatgataattaaacataaaacaagctgggcggccatctttggttctcatttctccatattgtcttcactggttttccttggtaagggcctgggctaggcttttactccattgccagagaaagcagtagcagctgccataaccacaattgtcagcttgaaagatccatagaccacagccttgaccgcacggtcgatagatttcatgcgctgctgaaagacacttggtttctcttttttggggagctggtccaacttctttaacgtctccttgaaccccgcccagatgtcttcctcttccttctggatgttgcaagcctgctcgccggagaccttggtggacaggtggcgggagcgcatgagcctgcttggggcgagcaggcgtccctcctccgcctgcgctcgctggagcagggcgccaccgagcc

SEQ ID NO: 4681 - DNA, 479 bp, Hordeum vulgare
ggaggacgtgcggctgggcgccacaggtactcggagcggcagcccatcgggacggcggcgcagggcggcggggacgacaaggactacaaggagccgccgccggcgccgctcttcgagcccggggagctcaagtcctggtccttctaccgcgccggcatcgccgagttcatcgccaccttcctcttcctctacgtcaccgtgctcaccgtcatgggcgtctccaaggccccctccaagtgcgccaccgtcggcgtccagggcatcgcctggtccttcggcggcatgatcttcgcgctcgtctactgcaccgccggaatctcaggaggacacatcaacccagcagtgacttttgggctgttcttggccaggaagctgtccctgaccagggccatcttctacataatcatgcaatgcctaggggccatctgtggggctggagtggtgaagggcttccagcagggtctgtacatgggcaacgg

SEQ ID NO: 4682 - DNA, 477 bp, Hordeum vulgare
atcgggggagttgctaaatggaaactcagaaccataatataacttaaatcttcacacaagaacacacacaactgtcacactgaattacacacacgagtctggattcaggtaggagagaacatgttcaggagccagggatggagaatcgacggcagatgcgaaacaggctcgttattccgatcggctttggtagcggagtcggcctaggacctgctcttgttgaacggaattgctctgatgatcacctggtggtagacggctgccagggcggcgccaacgaaggggcccacccagaagatccaatggtcattccaggcatggtccctgttgtagatgatggcagccccaaggctcctagctgggttgatgccggtgccggtgatgggaatggtggccaggtggaccaggaacaccgcgaacccaatcggcagcggggcaaggataggaacatgcgagtccctggcattcctcttggca

SEQ ID NO: 4683 - DNA, 416 bp, Hordeum vulgare
cgcgcccatatccaccagtgccgtcgtcgtcaagctcctcttatcccattgcctgaaccacccctgtctccatctccacaactgcacaccggatgttccttccatggaaggtgatgtatgtgcttgcttcttcccttcccgggacgccattactccaacgccatggaaaaatgtttcaggggctgaaaaggccaagggaaaacattctggattaaacctatattcaaagcaatggggtcaaatggaaaaaagtagcaagtcggagatgttatggcttttgtacatgccatgcatggcgacctattttcttcatatggaagttggtgttgtttccgtgatcaaagacttggtctgtttcatagggtttgtatagtgactgaacacttagtctcttatgaacttagcccatatttttt

SEQ ID NO: 4684 - DNA, 544 bp, Hordeum vulgare
ttactatacaatacatatacaaacaattgtgctcttgtattcatcacaagacaccattgatgaatacaaccactaagatacaattgcgcacttgtattcaacatatagaagattcattagtttacttcactcaagttagctacaaccactaaggaaatacatatgttaatatacaagtggtagcttgttaaaaaatatgggctaagttcataagagactaagtgttcagtcactatacaaaccctatgaaacagaccaagtctttgatcacggaaacaacaccaacttccatatgaagaaaataggtcgccatgcatggcatgtacaaaagccataacatctccgacttgctacttttttccatttgaccccattgctttgaatataggtttaatccagaatgttttcccttggccttttcagcccctgaaacatttttccatggcgttggagtaatggcgtcccgggaagggaagaagcaagcacatacatcaccttccatggaaggaacatccggtgtgcagttgtggagatggagacaggg

SEQ ID NO: 4685 - DNA, 479 bp, Hordeum vulgare
gccgaattcggcaccgagggaagaaaaagccatagatagttcagaagccaagcagagatcaaccaacaatgctgatacttcttgaattggggatctggatcctcccggtggcgtgcatcttcacaccatgcaggcgcctagttcttctacttgccaacctccagcagctgaaggcgagcatcatgcgcacaagatcatcatctccagccctttggagtcgcctggagaggctgcagacgataaccgtcacattgtgaaggaaacttggaactagatccgcagctggagacgtccgaacaccaatttcatcaggtgggcagccccttgctagcatttccttgcctctggggtgggatgaacaactccccttgtccatagatactctgttttttagctttctcttgaaaccaaatgtattggccctcgctgaatgtaagatggagataaataaagaagcaagtgacactccaaaaaaaaaa

SEQ ID NO: 4686 - DNA, 473 bp, Hordeum vulgare
  UNSURE (25): n stands for any base
ggtgtcacttgcttctttatttatnctccatcttacattcagcgagggacaatacatttggtttcaagagaaagctaaaaaacagagtatctatggacaaggggagttgttcatcccaccccagaggcaaggaaatgctagcaaggggctgcccacctgatgaaattggtgttcggacgtctccagctgcggatctagttccaagtttccttcacaatgtgacggttatcgtctgcagcctctccaggcgactccaaagggctggagatgatgatcttgtgcgcatgatgctcgccttcagctgctggaggttggcaagtagaagaactaggcgcctgcatggtgtgaagatgcacgccaccgggaggatccagatccccaattcaagaagtatcagcattgttggttgatctctgcttggcttctgaactatctatggctttttcttccctcgtgccgaattcggcacgagg

SEQ ID NO: 4687 - DNA, 519 bp, Hordeum vulgare
gtggaactgggttcactacattggggattatcaagcatgtggacaacgacaatgtgaccctgctggaccagtcaccacaccagattgagaaggctcggcagaaggaggcactgaagggggtgagcatcatggagggtgatgctgaggacctcccttttccaactgacacgtttgaccgctatgtctccgctggaagcattgagtattggcctgacccgcagcgaggaatcaaggaagcttacagggtcgtgaagcctggcgggcttgcctgtttgatcggtccagttcacccaacattttggctatctcgcttcttcgccgacatgtggatgctcttccccacggaagaagagtacatagagtggttcaccaaggcagggttcgaggatgtcaagctcaaaaggatcgggcccaagtggtaccgcggtgttcgtcggcatggcctaatcatgggatgctccgtgacaggcgtaaagagagcttctggcgattcccctttgcagctcggtcccaaagctg

SEQ ID NO: 4688 - DNA, 552 bp, Hordeum vulgare
gctacccgagcctcctttgcatttcattcgataaatgggaatattacatccctagcttctacaattccgcaagtgcacaaagtccctttgcataaacaagattccggcgaaaagaaaagcacaaacatacatgagtagggaatcgcaagcactacgggtggctaacatagaagcctatcttcactactatcgcctaaataggctggcctttgggaacaacctgatccttgatccacatgtagataggcactagcacgtagtacgacgcgcatatcgtcccgatggcgaagcggaagaggaaggcaagaagattcaccggttcctcaacatcctcagctttgggaccgagctgcaaaggggaatcgccagaagctctctttacgcctgtcacggagcatcccatgattaggccatgccgacgaacaccgcggtaccacttgggcccgatccttttgagcttgacatcctcgaaccctgccttggtgaaccactctatgtactcttcttccgtggggaagagcatccacatgtcggcgaagaagcgagatagcc

SEQ ID NO: 4689 - DNA, 354 bp, Hordeum vulgare
gcttcgcacggcacacgcatacgcacctcacaccaaaaccaccgctaattctcaccctgcccatctcctcgattcgataccgccccccaaaaatcccgaattcagccgcacagtacagccacggatcccccatcggccccgttccgcgagcaaaccctcaaaattttgctgcctccgatcgatcccgtggttgggtagggttgcgttgtggcggcgggctgggctggtgccgcgcgtgctcgtgaggattggtccgggtgtttgtgagtttgggaggctcctccgcatgcggcggattggaggccggacgaccggttagggttagacctatggggagcaccggcgagcccgatc

SEQ ID NO: 4690 - DNA, 530 bp, Hordeum vulgare
caccactaacacactcatatacagtgattctacttaatgtatcggtgtaaacctgggacaacaaaccctacatggttgggacttcttgtagtaacaaacagcatttcaccggatatctaacactataagcaaagagccgactatggcaaatgtacaaagtacaagctgaaacgaacagccaaaacctacatactcgataccacctacaacaaaaagaactacaaccaacgaaattcctacaaccaatccatatatatcaatacaatctattgtatgcttctggagtcgccaactcctcttcctcggatacgtccgatcaaaataaatacagtgtatatgcaagctaagactaacagctatagcaacaagaaaattccacactttacaacggagcggggagccacacttgcatagcataagccacgggcattgtgccggcaacctaagatatgctatgggacctcttttgcagaaatttggtgagttataagctacatttccagctgaaggaaggatcatgaacgccaaac

SEQ ID NO: 4691 - DNA, 521 bp, Hordeum vulgare
  UNSURE (6): n stands for any base
gacagnagggttattgaagaaatcaacaaaagaccacagataacaaagatatcttttgttgcgcattccgttggaggattggttgcaagatatgccatcggtagactctatagaccacctagacaagcacttgcaaattgtcctcagagtttgagagacagcaacagaggcaacatacatgggcttgaggcggtcaacttcataactgttgcatcaccacatcttggttctagaggaaacaagcaggttcctttcctttttggagttactgcaatagaaaagtttgcgtgctgcatcattcacttaatatttagaagaactggcaagcacctatttcttactgataatgatgatggaaagcctccattgttgcaatgtatggtggatgattctggggacctgcggttcatatctgctttgcaagcatttcagcggagagttgcatattccaatgttggttacgatcatattgttggatggaggacatcatcaattagaggggcctccgaactacccaagtg

SEQ ID NO: 4692 - DNA, 553 bp, Hordeum vulgare
ctctaaaaagtggtgccccaacgtatcaacattgataaaacagtggtggagatttacattttacaagcacaaagccgatactatgctcacaccgcacacaacatacatattgcataataattgcgaaagattaaagaacgacatgacacgaccctatatatatatatatttacttatctacaaacacttctgactttctgaacgccttctatatgacacttgattcctgggattgccataaacgtgctcaccaggctcggcgactccgcggttagcgactcgtgtatgatcacaacacaatctttgtttccagagatcggggctgtccactatgcaacgaaatggtcgatcatatgctttatgacatcggcaccttcgctatgcatgacgggatcttttacctgaattacgctgtgtgcagcagatcttgctttgctattatggaagctgacgtccaccttttcccatgacacacgcttaagtcctctcaaaagccgttcttctagagtgcagttatccttgtccatgtcagcaacatcagcacattgatcaa

SEQ ID NO: 4693 - DNA, 483 bp, Hordeum vulgare
tccaggtccctttcctacgttaagtgacttctttctgaacatcggagtttttccggaaaggaggttgaaacccgggcctttgcatcattctgaacattggagttaacggagctggctttgtatggcttttcatatgcaagaatccagtcttgtgatatagatgtgtcatctctctcagcatgacaagttcttaggtattctgctgttgatgaacttccaccacacctgcagcgacaagaaaacgctgaagaagtggttcttcatcgacaagacagtgggctaagcaaatccagctgaaagagagacgaccaccgtactgaccccattttctcttcgtccggcccgatggatttgagcaacagctcaccggtcatcaccgacccgataggaatgagccagtcgttgatgggcgtgctgccttccaaatgatgccattttcagtcaggtccggaggttactccggcgctggtggcgcgggggtaa

SEQ ID NO: 4694 - DNA, 552 bp, Hordeum vulgare
  UNSURE (549): n stands for any base
gtaaagtgaggttccagtttatttatacgcattgaacgccaggaaaaaaggtctatcttgcttgcgaattacaatgtcaagagaccaacacagccaccgatcaaatttctcagtggtaaagaacatgactagcagtacaagaatatcaatcgacctaaacgaattaacaggggacacagcaacatcactcgatcctagctacggtttccagcgctgtaaaactgtcgcctcggaaactactgtcatctcctgtttgttcatagcgagtgcttcttccacctcactaaggaattcaggaactccatcacttcagacgggtccctgagcgagtagaaggcttcggtttccttgggcgcctgcgagaccagtatcccgtatccgcagttcctctcccgaagcaccttgaacgcgtcttcgtcggtgcggtcgtctccgatgtagatgggaatcacgttctcgcagtcgctcagcccgagcgactgaagcaggaactccacggccttccccttgtcccagtcgatcaccggacgaacctctaaaccattcgtncgt

SEQ ID NO: 4695 - DNA, 519 bp, Hordeum vulgare
cgcgcggctgcctcccggggccggccacctctacggcgccaccggcgcggccaacatggcactcagcctctcgcaggtcggctcctccctacatgacgcgcacggccaataccaccaggcatccccggatctcctcccttcatgggctcgtccgtcccgcagggccgcgcacccatgctcgaccagggacagatgcacctgcagagcctgatgaactcgctggccggcggcggcaatggtggcggaatgtatggcggcgccaacggccgcggcatgattgatccaaggctgtatgatatggatcagcacgaggtcaaatttagccagcagggccgaggcggcgtcggcgccggcggggacgtgacgcgggactttcttggcgtgggtggcagaggggagatgatgagggggatgtcagtggcaagaggagagaaccacagcggcagcgacatgagcttcttggaggcagagatgaagtcggcctcgtcggccttcaatggaggcaggatgcagtgaaga

SEQ ID NO: 4696 - DNA, 484 bp, Hordeum vulgare
tcatccctcacaaagcgagctacaaaccttacggtatatgcaactatctcttccggccggtatgaattaacccatttaacaaggttcaagtagaaactgtaacaaaacatgaaacatgaaagcagccactaaatatagtcgatctcgtctcacggttccggttgatctggctcttgatgatgacctggtagacgaagatgccctgcgtacccacacaccatgtgtctccggagtccggatcaccgaagctgacattatctcagcggaggaatttcaatcttgctctctaaagtcaaaagatttgtgctgccaaatgccaacctgtatgtaagtagcttgttccatgcatctatggtgtatgccaagttcccaactcgctctctataggatcgagcttaatgcctttccacaagctcttcactgcatcctgcctccattgaaggccgacgaggccgacttcatctctgcctccaagaagctcatg

SEQ ID NO: 4697 - DNA, 74 bp, Hordeum vulgare
aaaaaaaaaaaaaaaaaaaaaaaaaaaaaaaaaaaaaaaaaaaaaaaaaaaaaaaaaaaaaaaaaaaaaaaaaa

SEQ ID NO: 4698 - DNA, 321 bp, Hordeum vulgare
tttttttttttttggcagaaaaaggcttaaacttcacatgaataaataacaaacatcagctttagggccaaaaaccatgcgttgcatgtggtacaacaaaagggtgatcaacccaacgaaatgacagatttttaatgattcgtcgattacaatggagctccaaggtgtgagttagagccatcctttttgctaaatttgatattgtttcacaaacatgaagcaaacagaaaactatcttgtcataatcatcattgaagcttcgtaactcatctatgtaaacatcaatccactctgttcctcattctgccttgcgagcctttg

SEQ ID NO: 4699 - DNA, 386 bp, Hordeum vulgare
  UNSURE (360)): n stands for any base
tatgtttttttgctcctgccacactaaaatcaaatctcggaaaacctagacacaccatattatgaaatggagggagtacaatttttctttctctcctttccaattaatcatatactatgtatctctgcaaaaatgagttcagtagaaaggagaatgcagatgagttcagtgcagtacaccaaggtaccggatcgacctgcaacgcccacggagaaagctctcgtggttgggtgctgctggattctcacctcatctttctctctgcctttgccaagaaaatcaatgcgtcaatacagcctcacctgccacattaagacaaaaaaaaccctagccctggcttactagacttgctactaattntcgaaggagaaaatatgtgtggatgg

SEQ ID NO: 4700 - DNA, 345 bp, Hordeum vulgare
tttttttttttttttttttttttttttttgttgtatatatttcatttcagtagcacatcacatgaattacaatacatcacccgtcgattcctctacacataaagatttcaggcccaacaagtgcacaacaaaatagttctacaagtgtaggtgcacagcaaaagggaccaacaagtgcataatcacacatcaacatagttcgacaaatattggatgagaagcacaagtttttattaatcacacataacatcaatgacaaacgaagcttcttgtcccctcctcctaacctgtcctctacttcttctcggtgcttcagatcatcctggtaattcaaataatcaaaca

SEQ ID NO: 4701 - DNA, 549 bp, Hordeum vulgare
gtcccccgggtctgcagcaattcggtacgagggcaatctggttggacgctccgacgcctccgaggtgcagcctccgacttcctcccccgcccgctccgacgcctccgagggcgcagcctccgacttccccctcgcccgctccgacgcctccgacggcgcagcctcgggagcagaggggaatgagcgcaaggcctccgcagggaggagcacacaggtgctggtcaccttggcagccattggcgggcgcggcggcccctacggttgtaacggcggcgactcgcatggcaccctcctgcgcgagcagccggtcccgtccctggatccgcaaggcgccgtcgtcgctgtcccttcgtttagggtggaggaggaggtccgttgaagacattgcgcgctgaggaggaggctgctgagtcaagatataggaattgatggatctgtccacaacctctgttatggcggccaaggcctactcgtacaaagcagagttactggttaaggagtatcttcttgcagattcatatgtttcgtacaccaatgcgttcatgccac

SEQ ID NO: 4702 - DNA, 470 bp, Hordeum vulgare
tccatcacgtatatgtagcacataatatttttaggaaatcagaatcacctcaataaccaagaagttgatgctagatgcatcttcactccagataccaaacaaccatcttacagaacacattgagctcttccattccgccgccgtcgtagccatccatggtgaagcgtcgacttgttggatttgaagattaattcatgctattctccaccccatccatctgaatcgtaagccactaccaccatcattatcagcgtagaacatatctgaagtatcaacctctccttcccagtttctcatcgtgcttatcctcgtgtgaacaatgatgacaacccagtcatcacaatcaccacagagccttgttggttagggttgtcaagggctgcgttgatggtcggttctttggctagcggtgctttctgcagttatacccactccatgatcacgtccgccctatacagaagactcaccac

SEQ ID NO: 4703 - DNA, 457 bp, Hordeum vulgare
gaaggcaccggcgggcgggcgggcgaactccaaccaacaaaccacgcggggcggccggccaaatccacgccaccacccacgcctgcgagggcctcgccgccgcagtccgattcgactcccctcctcaccccgcctccctcgatccccgccgcggaagcgaaaatgagcgacaatctgatggagaaagtgaacgccctcggcgagcgcctcaagatcaccgggtcggaggtgagcaagcagatgcaggccggcatgagctccatgagcttcaagatgaaggagctcttccaggcgcagaccccggccgacaagatcgtcgaggacgccaccgccgagagcctcgaggggcccgactgggccgccaacctcgaaatctgcgacctcatcaacaccgagcaggtgaacagcgtcgacctgatccgcgggatcaagaagcggatcgtgctcaaggaggcca

SEQ ID NO: 4704 - DNA, 425 bp, Hordeum vulgare
ttttttttttttttttgacgacggaacaagagctattcattccatgagaaataaaaaaattcatcatctaacccatataaccatgaaacaggaagatgagaagtttgcagcaacttatcaactgaacaagctctggaggacaaagtatcatcgtatgcaaataaacaagcgacccaatccctaactgaatgtacgtgcagtgcagtcttctaccggatgaatacagacatcgttcagcagtataaaagcagcagacatgttgcgcatccctagaggaacttcccaacctgctgagacggtatttagaagttgattaggacatctttctttgggtcctgccttttggacacgtcctgggaactgcttcctcccttcttgccaaatatcatctcatcgagatcatcgaggatatcatcatcgccgcc

SEQ ID NO: 4705 - DNA, 319 bp, Hordeum vulgare
accacagttatgttgcagtgaaggttataaaaaaccagcctgccttttatcagcaggctatcgtggaggtctcattgttgagcatgctaaatgaaaaaattgatcctgatgatcagcaccacattgtccggatgctggatttttttccatggaaaaatcatttgtgcatcacatttgaaatgcttggtcataacctgtacgagttgttgaaaaagaacaacttaagaggtttacaactgcaatttgtccgtactttctcaagacagatattggatgcattgattgtgatgaaaggtgctggaattattcactgcgatct

SEQ ID NO: 4706 - DNA, 550 bp, Hordeum vulgare
ggtaagcggataaatataaaaccctcagtcatagctcagacagtgtcatacaaggtttgatgcttaacagctacacattttttccatccatgtgcatcgacagacagacctagagaaaatatatgatggtggactatactatcaagtgtctttttgtactcttaagtcctaaccgttaacactctcctcgagattaaatagcaagacttcaagatgttacaggtttgcaacgatggtatcatctaagattggaccagagcaagttcatacatagcattattacaggatcctgctttgctaatggcaggaatatgatagacatggcaatgtcaacaacgaaatcaatagaaaccactaattgtgcaacagtgaaatcattcattaccccaaggcatcccctcaaccatccgagggggcgaagtagaatctggcatgccatatttggaccaggcagatcgaacattttggagattccccgccgggcgtatagaggtggaactcatatggttgtactgctgaaatggttgtccgtgacgaccagggaaattgc

SEQ ID NO: 4707 - DNA, 423 bp, Hordeum vulgare
  UNSURE (10),(19): n stands for any base
gtcccccggngctgcaggngttcgcgcaccgcgtcgtcggctacctcgaggaggaggccatccactcctacaccgagttcctccgggacctcgaggccggcaggatcgacaacgtccccgcgccgcgcatcgccatcgactactggcgcctccccgccgacgccaggctcaaggacgtcgtcaccgtcgtgcgcgccgacgaggcgcaccaccgcgacgtcaaccacttcgccgcggacatccatttccaggggctggagctcaacaagacgcctgccccgctgggataccactgacgagtgacgactgaatgcccagaccgacctctgaaccgcctacttctgccattttgttactagagctccaagatttctgcagaacaaaagttgttgttaatatatgtgtcggataggtaaaaaaaaa

SEQ ID NO: 4708 - DNA, 372 bp, Hordeum vulgare
cacaacttttgttctgcagaaatcttggagctctagtaacaaaatggcagaagtaggcggttcagaggtcggtctgggcattcagtcgtcactcgtcagtggtatcccagcggggcaggcgtcttgttgagctccagcccctggaaatggatgtccgcggcgaagtggttgacgtcgcggtggtgcgcctcgtcggcgcgcacgacggtgacgacgtccttgagcctggcgtcggcggggaggcgccagtagtcgatggcgatgcgcggcgcggggacgttgtcgatcctgccggcctcgaggtcccggaggaactcggtgtaggagtggatggcctcctcctcgaggtagccgacgacgcggtgcgcgaac

SEQ ID NO: 4709 - DNA, 358 bp, Hordeum vulgare
tcgatgcagtcagaaatcaaatgtctcgtggctctagcacacattattatttcaaccgcattaatcacaatgccgaatacttcccatactgcaagattcacatagatgcatcacctgaagttcatagcatttcagagacacgtgtttttggatatgatctgaacaaaccatatcctgatgcatcaacagtaacagtttgttttggaccccacgagtattctgcacaaagtgatgagtgcacaagtactaacagaaggatcttctctagctcttgtcctgagaatgcatttactcctcaaactacaatcattaatgcatacccttcgtctgcacctgatcaaacatgctcttctgaaaa

SEQ ID NO: 4710 - DNA, 95 bp, Hordeum vulgare
tttttttttttttttttttttttttttttctttttttcttttttttttttttttttttttttttttttttttttttttttttttttttttttttt

SEQ ID NO: 4711 - DNA, 1484 bp, Hordeum vulgare
  UNSURE (426),(1040),(1062),(1278): n stands for any base
ttgttttttccccccctttttctgacggtgtgggggtgggcgcagtgggtttccacaaagaggggagaccacacaatatttggggggcgggtggcatgcccccccaagaccctcccggtgaccgttccattttttcatttcacgacataggttatcataaaaacacccccgcacgatgaaagcggtaacgcgttgcgcgtgctttgtttaccccctccactgcgcggggcgtgctttatgtgtcgcggaggtgttctcccgcgtgtcacgtcgtggtacgtgaggcgactatcagcagccgaagaaatagagggtagtcaactcgtgccgtgagtgaaaggtctggcgagcgtgcctgcgtaaagcaccgggggcgggcgtagcattagtgcacgcgccgatttcccgttttcctatcttgaaacnccgcattcgcaatgtgcagaaggtgagtatgggcctgtgcggttcgccattcatcgtttacgtatgccccctcgttttcgccgagaggcggcatcgcacgccgtgcatatctatcgttacgcgggctgtaccaccacgcattgtccgctttgttattggagacgtcggttgcccacgttgcccgaaacaaaattttttgcgccctgcgctcaacggaccgcgacgtcgatgttctcggcgcggcgaaacaaggaggaagtggccgtcggatcgacgagggcccgcgaaacacgttgcgcggggtctcgatgtgcggcctacacctgccagactccaattacaatagccgcacaaagatccgcgatcggttcgcgtacgaaatgggctagacgagcccaatctccccgtagtgcgagcagcatgtggacgacactgacatcagaacgcgttacggtatctattacgcgaactgtacgtacgatttgcggagatatatatcgaagactcgccaatatcgacatcgcttctcgcagaacgtacgcggtattatatggcgagcgtacctcgacgcgtttattttcgtcatctgctgattaatcgttgactacgtcgcntgctgtgtagtcaaagccatantgttagaaggatgtaggataccagaatttgttcggtgaccgcggcaaatataccgcgcgatggactacatacgtaggcggagcgtgcgcaatcggagttaagtgcgtccagcagatgtcttcgggcatattcgcgcatttgtagcgagcgtccgtatgagtacgccggttacgcattaatgccacgactcactcggtatatacagcgataccaaangagaggatttgagatcgaccatcgtcgtatatgcggcacgatgcatcggtcacacatgcagatttatatttgcgtgtgcctacggaccgacgacagatggtgtgtcgagagtttacacggtgcaggagtcagaccgtatggtactgtcgaagattacgcgccgcatgtcgaccggtatgcgcgtaacacctaggtgtcgcgagtcg

SEQ ID NO: 4712 - DNA, 540 bp, Hordeum vulgare
gatttctattaagcagacgctctgttaagagacggtttgacaaaaaaggttccagcacgaggtcaaatacttggacctgacatggcatatacggaaggaaaatgtacccatgcttgcctcagcatggacagaaggtgcatatatatatccccgacagactgatggttttcgatcatcatgttaacataaatgtctgtcgtactattgataagccgtagggcggatcgcgtagcatctgcagtccaccagctgaagatcacttccttaagccctccatgatgtacgaaccgtagaggtccattgagtacttgattgcgttgatggcatcttctgctgggaggaaatcattcactgcaacctccttattttcattcttcttgtagtcttcaaagaagcgacggatctcctgtaggcgatgcgggggaagttcactgatgtctctgaagtgacggtactcaggatcatcagcacagacagctatgatcttgtcatctttctcaccctggtcaatcataggcataagcccaatagcacgggcac

SEQ ID NO: 4713 - DNA, 428 bp, Hordeum vulgare
aggaggagaaggagaaggggagtggaagtgttacaaatgcagcacctactgctggcaatgggacccctgccaggcctcagtcttccaattcatccaagaagaaggctgcaaaatcacagcttgaatcggatgcttctgttggccccaatggcaaagcatcccccgaggaaggtgagagtgaggtcagcaagcccggaagccgagttggccgtcgccggaaagctaatgccaaatcacagaatggaacagaagatgctgggctcgataacccagaccttggtccatttcttcttaagcatgcaagagacttgattgcctctgataatccacggcgagcgctgaaatatgctctccgtgccaccaagtcatttgagaaatgtgcaggtggaaagccaagcttgaacttggtcatgagtttgcatgttgcg

SEQ ID NO: 4714 - DNA, 501 bp, Hordeum vulgare
gccttgcctttcacataatcgaccatttttgtgtctcatcctcaagcgctactactattcccatgtacccctatcaccaaatttgaataaaccaattgatacacaaattcttagcgtcatagtgttcccttttctctttcattcaaagctatagttcactcacgctgcaactgtagtcctctttccaacggtgtatgggttggtcccgagaagattttccagggattttgccttcctgcttctcccccggccagcctccttcagcaactcggcgagcctccgcttctcgtcatcgacgtctgggttcgccgtgcctagcttctcttcacgcatttctacgacgtattccaagatctcaatggcctcatccagtcttcccattgcatcataagttccagcaagattgctgtatactcctagagtatctgcatgatatggcccgtattcttgctccagaacggttctagcttcctcgaagagttctgcagcttcatttatgga

SEQ ID NO: 4715 - DNA, 515 bp, Hordeum vulgare
caccgtcaagctcaccgtccagaatcgccaggccaaggtgtccgtcgtcccctccgccgctgccctcgtcatcaaggcgctcaaggagcccgagagggaccgcaagaaggtcaagaacatcaagcacaacggcaacatcagcctcgacgacgtcatcgagatcgccaagatcatgaaggtgcgctccatggccaaggagatggccggcaccgtcaaggagatcctcggcacctgcgtcagcgtcggctgcaccgtcgacggcaaggaccccaaggatcttcagacggagatcgacgacggcgaggttgagatccccgcttaagaaggcttggctttggggaggttgttatgtgaggctgctgaagtagttttttctatctagatgcttcctgatacagttgagagaatggatgtgttatcttcacttgttctactcttgctgaagaagaaacttttgtcatgctttagtgcttccattgtgagactatttttttaccgctttaatgagtaccttg

SEQ ID NO: 4716 - DNA, 558 bp, Hordeum vulgare
  UNSURE (26),(42),(43): n stands for any base
gcctcaaaacatggacctgacaagtnattcaacatatgatannttctagctgcaataataacattgattccccaggtactcattaaagcggtaaaaaaatagtctcacaatggaagcactaaagcatgacaaaagtttcttcttcagcaagagtagaacaagtgaagataacacatccattctctcaactgtatcaggaagcatctagatagaaaaaactacttcagcagcctcacataacaacctccccaaagccaagccttcttaagcggggatctcaacctcgccgtcgtcgatctccgtctgaagatccttggggtccttgccgtcgacggtgcagccgacgctgacgcaggtgccgaggatctccttgacggtgccggccatctccttggccatggagcgcaccttcatgatcttggcgatctcgatgacgtcgtcgaggctgatgttgccgttgtgcttgatgttcttgaccttcttgcggtccctctcgggctccttgagcgccttgatgacgagggcagcggcggaggggacgacggacaccttggcctg

SEQ ID NO: 4717 - DNA, 969 bp, Hordeum vulgare
aatccgggtctaaaagctttcagtacgaggatcacagaacaccacacagccgcccgcataccttatgtgtggctggccgacgcaaaaagaaccgagatggctgctgccttatccttaccgtcggggctccggctactacgccgaccagctgcctcgggaagaagctgaagaagcaggtgacctccgtcgtgaactaccatggcaagagctccgaggccaactggctcacagtcatggcaactgggaacatcgacgagaagaggaacaccgacaagtggaagggtcttgcgtacgatatctgcgacgaccagcaggacatcacccgagggaagggcatcgaggactcgctcttccaggcgcccacgggcgacggcacccactaggccggcctcagatactacgagtacgtcaaccagggcctgcggttgtacgactttgacaacaccatgggaggcttctacatcgctcctgcttttatggacaagcttgccgtgcatctatccaaaaacttcatgaccttgcccaacatcaagatcccactcaacttgggtatctggggaggcaagggtcaaggagcattattcctgtgtgagcttgtggcccccaagatggtcatcacccccatcatgattagtgccccggccgctggagagtggtaacgctggagagcctgccacgcctcattaggcagtggcaccgacaggctgtatacatgttcaccgagggtaagatttcgttgctcttcagatcgatctttactttgttgccgtcaggatgggcggaaacatccaatattacgttatttaccagttggctatcgccctcccgatctaatattttggaggcccccactactggccccctcctggcttttccataagtgatatgaccccccgcccccccctgtgtacatgtacatatattttcgccccctccgtcactttgttctcgggacccctcgcatagctt

SEQ ID NO: 4718 - DNA, 518 bp, Hordeum vulgare
caccagcgtgtttggaggtgctgcagagccacccaagggcggcaacccagactcgaacacgctcatcagcgacacaacgacggtcatatgccttgatgactaccattccttggacagaaccgggaggaaggagaaaggtgtgactgccctggaccccaaggcaaacgactttgatctcatgtatgagcaagtgaaggcaatcaaagaaggcaaggctattgagaagccaatctacaaccacgtcactggcctcctcgacccggcggagctcatccagccccccaagatcttcgtcatcgagggtttgcacccaatgtatgacgaacgtgtgagagacctccttgacttcagcatctacttagacatcagcaatgaggttaagttcgcatggaaaattcagagagacatggcagagcgtgggcacagtcttgaaagcatcaaggctagcatcgaagccaggaaacctgattttgatgcctttattgatccgcagaagcaatacgctgatgctgtgattg

SEQ ID NO: 4719 - DNA, 120 bp, Hordeum vulgare
aaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaa

SEQ ID NO: 4720 - DNA, 367 bp, Hordeum vulgare
ttttttttttttttttggcagaaacaagtgatcaatttacaggctgaacgtagatcccctgacagaaggttaaaggaatggccagcacttgatgagtggcataaactgaaaataatcagtggcacagaaatcttgtgttttttgagaaactgaaacgactcgcctataatacgcatgcagatgaacctactacagcacagtactctgccgcatcacactgggactgggtagactttccacaaagcggcagcgcgacatgcaccgcccacagcatctaagcccagtagatccgacgggttagattacacgactcgtccttcgtccttcatggcgtgcactacctagttgcggcttcgcttaaccctcc

SEQ ID NO: 4721 - DNA, 403 bp, Hordeum vulgare
  UNSURE (387),(388): n stands for any base
aacccgacctttctcgaagccacgagccgccgcactcaggccgccgccctagccgccgcgccgtccacctccgccggattccagtggcaaccagcctccggtatcccctttttccaccctccgtcgccgacagtcactgaagcatctccttgcgatggctgcagcggcgatttccggcggccacctcgtcctctccacccctacctccacccggcgcccacagttgctccccatccatccgccttcagcgcgaccaatcgccgcatcctccgcctccgcggcccgccgcggggtcgcggccgccgcagtgtccagccctgccgcggtcccctccacggggaaagatggcaaacaggttcctaaggatttcctccatatcaatgattnntgacaagatacaatc

SEQ ID NO: 4722 - DNA, 273 bp, Hordeum vulgare
tttttttttttttttttgggttggaaaacatggaaatgcatgtatcatatttattcaggatgaccagacctgacacagtaccccagagtaatctgacatgttccaaaatctctaccctcacgccttcacggaaaccctccaaggcttacagtatgccgaaggaacctagtatccagtaataatgttgaacttcaataacgatgcgacactaggcagtctagcatacaacagagggtaatcaagctccgagcacgtgaagcatgattgcgtttt

SEQ ID NO: 4723 - DNA, 518 bp, Hordeum vulgare
cctcgtgccgaattcgatatcaagcttatcgataccgtcgacccgccgacgacaacgccttctcgaatgggggaggacgcggtggtgctgctgctggtggcggcggcaagtcgcagttccagtttcgccccacggagcccgtcggattcggcggcggcggcggcaacggggacgccgccgtcgacatcccccttgacaacatgaacggttccaatggcaagcagagtgagctctcgcagtggcaggcagatctcaagaggcgggaggcggacatcaagaggagggaggaagctctcaagagcgctggggtgcccatggaggacaagaactggccgccgttcttcccgatcatccaccacgacattgccaatgaaataccagccaacgcgcagcggttgcagtatcttgcttttgctagttggctcggcatcgtgctttgcctcgtttggaatttcattgctgtcacagtctgttggatccgaggaggagactctaaactgtttttcctggctactatc

SEQ ID NO: 4724 - DNA, 545 bp, Hordeum vulgare
  UNSURE (21): n stands for any base
caacatggccagtttatattnaggtaagatccaagggctttaaacaacagatagttgcagagataacactaatacaacggtgctacacttctacccttccaacaaataaacaaacttctgaatttctgaggcaaattattcccataactaccataacgcacaaagaatggcatgtactcatatgtatgcacagaactgcagaacgctccgataacactggtggacttctgtaaatttcttctgttgcccgcttcacttgtgccctctgaaatacatgtatactctctgaagaacccaaatgctcacaactgtctccagtgaaaacaaggcaaatccgacaaagtaaaatatcccaactaatgcatgatcagagaaggtatcgattgcagccagtatccccgttaatgatttcccacgaaatacgattggcggagcaatggcagcaattatacaaaagccaatgtggagcatgtaacagaggaaaaaccacccaaagctgaatgcactgtcagttctcatagcacggtacagaggcctataccaca

SEQ ID NO: 4725 - DNA, 525 bp, Hordeum vulgare
  UNSURE (108): n stands for any base
cctcgggtctggagggcatactgcagagatgatgaatattgtaactgagcttcagaaggatcggtttacgccaaggtactatgtggctgcacttactgataacatgangccttccaaaggcacaggtctatgagaagtcactgattcagggtgatggagaaacgatcatcgagaacgcccagttcatgcagatatatcgtagccgtgaagtgggccaatcctacattacctccatcgcaacaacactgtgtgctattttgcatgctatgtggctaattataagaatcaggccacaagtgatattttgcaatggtcccgggacatgtatccctctatgtgcttcagcttttcttctgaaggtgcttggtctgggatggtcctccattttctacattgaaagcatcgcaagagtgaagaaactttcattaagtggtttactcctgtacaagctacggatggctgaccagttcttcgtgcagtggccccagctgcaacaaaaataccctagagcacaatatgctggcc

SEQ ID NO: 4726 - DNA, 548 bp, Hordeum vulgare
ggaatacgaactaacaacacttactgatagaatgtggctggaacttacaggatgaggtttacacctggatctcgtcaaaataaagaggttttacacctggactctacagagttacagattacaaggtagtatatctgagagggagcattctatcccccgatcaacaggtcagtcttgaaagacaattttgaggagtatatcctaagaaatgtgcaagcttatgctcggcatgtagggtgtgtcaattcaagtattcaactgcccctcagcatgttcaagaacttcagagttggaaacgacggtgttccaaatatcatttacgggtgaatcatcacatcaaacggccagcatattgtgctctagggtatttttgttgcagctggggccactgcacgaagaactggtcagccatccgtagcttgtacaggagtaaaccacttaatgaaagtttcttcactcttgcgatgctttcaatgtagaaaatggaggaccatcccagaccaagcaccttcagaagaaaagctgaagcacatagagggatacatgtc

SEQ ID NO: 4727 - DNA, 542 bp, Hordeum vulgare
gggcctgcaggcaattcggcacgaggctcaaacacagagagttcctcgacctccactggacaaccttcgctgttgacccaaatccgccgccgcgtctaagatggcatctccggcgccgccgctcaaggacgccgtcggaggcctggaccgcgaccccttcgtcgccctcctcgccaagctgatcggcgagtcccagcgcctgcagaacgacccgccggccctcgttccgcaggaggacctcgtggcgcagcacgtggtcgacgcgctccgcccggtctcgacggaaaccgatggcggcccgctcgtcgtgcggaaggtgagctacaccgacggccggagcaacgtcatcgtcgagtaccccggcaccgtccccggccgcgtcgtctccttcgtcggcatgcacatggacgtcgttccggccaaccctagcgaatgggacttcgatcccttctcactaaccttcgaaggtgatgacaaggaaaagcttaggggccgcgggacgacggactgccttggtcatgtggcgctagtgactcagctca

SEQ ID NO: 4728 - DNA, 542 bp, Hordeum vulgare
ctgggggtgtattgccttcatgtatggttaccaaacaacccaagctcgtacgtctaaaccaatgcggtaaattgagcctgaatattatggtatgagatatggttgagcccaagctcaaaacactattattagatctccgggtagcaggaatatgtatctaataaggtaatatttcatccctagaaggcttaagcatcatcttccagctgcgaaatgatgcttacaaacacttgaaagccttgggccatatctgaaaacagacaatactcgttcttcgcgtggtacgtcttcagtaaaccatatccagctgtttgaacatcaaatccttcatcctgtaattcccgaatcagaggcaaactcccggtgatggaatatggctctacgtatccaactatttcctcagttgctttgcacaatgcttgaaagccccgagactcgagattacaggccaccccattcatcacatctccatcaaaagtgatttcaagccttcctcgcagattttcatccggaagaacatatttcgaaactggaccacgagt

SEQ ID NO: 4729 - DNA, 517 bp, Hordeum vulgare
ggggtaaggtgccgaccgagctgggttctccccaggacacgctggagtacgtcataaccgtcggcgtcggctcgccggcggtgcagcagatcatgaccatcgacaccgggagcgacgtgtcgtggttgcactgcaactccaactccacggccgggacgatgcccttcgaccccaccaagtcgacaacgtacaccgcgttcccgtgcggcgccgcggcgtgcgcacagctcggcgccgagtccaacgcctgctccaactcgcagtgccagtacatggtccggtacggcgacggctccaacaccaccggcacgtacggctccgacacgctggcgttgggctcggacaccgtcaagggtttccagttcggctgcagccgcgtcgaggaggggttcggcgacaagaccgacgggctcatggggctcggcggcgacgcgccgtcgctcgtctcgcagaccgcggcgacgtacggcaaggccttctcctactgcctcccggcttcctccgactccaaggggtt

SEQ ID NO: 4730 - DNA, 549 bp, Hordeum vulgare
ttcctaagcgtttgatttgatagattaccatgcatctcatatgttgctgctatcagagagaaattaaacgctccctttatgcgtgaacacttttatattatggaactgaggaagcacgatgattttggcccacttggtgtcccttacctcgcaactagaaacaagaagacaaccacgtgagagcagcctagctagccacccttcattcccgtgtcccgcgcgcgagcgctgagctctcccggtgatgagcagctagcacgcgttggacttgaacccgaagacgctctggcctacgtcgtagagcacctcaagggtcctctgctgcacgttgccgatgatgccggtgcttccgtcgtcgccggtgtccgtgaacgcgaggcagctgccgaatatgatcccgttcgcgtcgaggtcgacgaccttgccgccgtcgaacaccaaagcgacggtgggtatggtgacgttgtcctggccgctgaagtcgaagcacgtgtccaggatgctcctggccggcgccgtcgggtactgcttcatgccgtccttgaacgc

SEQ ID NO: 4731 - DNA, 519 bp, Hordeum vulgare
agctctctgggtggaagctggttgttggagatgttttcagagagccaacctcatcaaagctgttctgtgttatgattggcgatggggttcaaattctgggtatggcaattgtcaccattttctttgccacctttggattcatgtctcctgcatctagaggaatgctgttgacagggatgatattcctttatatgctacttggaattttggctggatatgctgctgtcaggctgtggaggactgtaaaaggaacttctgagggatggaggtctgtctcccggtcgactgcctgttttttccctggcattgtcttcattgtcctcactgtattgaacttcatgctgtggtcaagaaatagtactggagcccttcctatttcacttttcttcactcttctctccttgtggttctgtatctcggtgccacttacccttctaggtggtttccttggaacaagggctgagccaattgaatttcctgtccgaaccaatcaaataccaagagaaatccctgcgaaga

SEQ ID NO: 4732 - DNA, 532 bp, Hordeum vulgare
atttgttacaccgcaaagacaaataattctcccatgacaaacttatcttggagaagagaaaaatggaaccaacagttgcacaaggcgcaaggacgtggcaaaattcacgattttaagagagcatttgtatcaacgaatgctgaagcaaagagaagagaaaaagattacaagcttaaaatcacatctactagaacataccagatgtatcgtagtacaacagtatcaagactctcagtaatatgctacattaagagtggcacaaccgtgtagatggccttccaatgccggatcaaagcactgtacaatccttggggatttgcaagataatgccttcaatcaatcttgacgtttgagaaaaggtagtgaacgaaagagaatgatgtcaggaacccaacagtcccagtggctagcatgatggcaagagagacaatgaaagcatatccaatatagagcgtagcagaaactggcccactcaagcttctgagatcaaacaccaggtagttgatagagtagaggaacacataaaatgcca

SEQ ID NO: 4733 - DNA, 517 bp, Hordeum vulgare
caggtgtcctaaggacacaggggccacccaggcaggactccggaggatgatgattgtcgatggtacgatgggagagtcaggggtcagacaggtttcgttggagcaacgctagtccacccgaatgggatcacgaggctaggtgctccatagtgtgggtaaaaagtgctcaacctctgtagagtgtaaaatctattcgaatagccgcgtccacggtattagacagcccgtccagacctcactaggtggttaaccgtatcattgttagtaatcatggaagaactcatcttgtatgtacatcataggatgttgggaatatgacatgttagccaagaaatggctatatcatgagttgtaggatgaccatatgatttggatgctatttggatccatttaagttggatcacgagtatatcgagggttgtgggacaactcagaagagagtaagttgacattcggtaacagtaagtacttcaagtacctactatgaccatttccatgctatgtatgttagatgctt

SEQ ID NO: 4734 - DNA, 555 bp, Hordeum vulgare
ataattccttccaacgaaacttcaatagcattaccacaaaagagtaatcgacaacgatagagtagacgggatgaatagtgcaagtgtggcaccccgatagagggtcgacgcacgccagccacaagataagacctggcgcacgtgaaagacatgatacaacaattccaggtagaaaatggctttattgattatattggagtattacaatactgttgattacaacaatattacatagctccaaggctcactaaatggcagcagaggtcttggttcggcaacaatgacagctttggctgggcttcataactcataggactggctagattacgttctagcacgacggaccttctcctacaactcgccacgtgcaaggctaggtgagtactttgaatgtactcgcaagacaaccaaatacatagcatccaaataagaagatgacaaaactagccctatacttatataataagtattctaagcatgacatggaattaacagaaaaacagggataaggcataacataacatggattaagcatctaacatacatagcatggaa

SEQ ID NO: 4735 - DNA, 552 bp, Hordeum vulgare
gtacccccgggcctgcagggaattcggcacgagggccccaccaccctcctaaacccgcgagctcacaggaggcggcggcggcggcgacagcagcagcagagaaactatggggagcgacacggagacggagaagaagaagaccccggtggcgctggcgcccatcgccaagccgctcgccggcaagaagctctccaagaaaaccctcaagctcgttcgccgagcctcggaggccaagtgcctgaagcgcggggtcaaggaggtggtcaagagcatccgccgtgggagcaaagggttgtgtgtaattgctggaaacatctctcctatcgatgtgattacacatcttcccatactttgtgaggaagccaatgtcccatacatatatgtgacatcaaaagaggagcttgcgaccgcgggtactaccaagaggcccacctgctgcgtgttggtgatgaccaagccagccaagggggagatcactgaagaggtgaaggagaaactggaatcggaatacaagcaggttgtaactgaagtcgctgaggttacatcttctat

SEQ ID NO: 4736 - DNA, 544 bp, Hordeum vulgare
ttgcttaccgatattagttaataatgcactatcttttttatctaatcaccaaccgaacagcacagtaccagactcacgatgcttaaaactccctgataaacacgtcgatcactagcaacgatagggtgacaaaatcatgctacataatacagacagaaagatgttcatggttcctccaggctggccatggaaatgttctcagaacatagaagatgtaacctcagcgacttcagttacaacctgcttgtattccgattccagtttctccttcacctcttcagtgatctcccccttggctggcttggtcatcaccaacacgcagcaggtgggcctcttggtagtacccgcggtcgcaagctcctcttttgatgtcacatatatgtatgggacattggcttcctcacaaagtatgggaagatgtgtaatcacatcgataggagagatgtttccagcaattacacacaaccctttgctcccacggcggatgctcttgaccacctccttgaccccgcgcttcaggcacttggcctccgaggctcggcga

SEQ ID NO: 4737 - DNA, 513 bp, Hordeum vulgare
cgaggtctcgccgcagcctccatcgaagccgaaagaggagcagggcgaaaggaggccgtcggagatgtcggagaagaagcgcgcccccggccctcgcaaggacgaggtggtgacccgcgagtacaccgtcaacctccacaagcgcctccacggatgtaccttcaagaagaaggcaccaaatgccatcaaggagatcaggaagtttgcccagaaggccatgggaacaaatgatgtccgcatcgacgttaagctcaacaagcacatctggagcagcggcatcaggagtgtcccgaggagagtccgtgtcaggattgcccgcaagaggaacgacgaggaggacgctaaggaggagctgtactctctggtgacagttgctgaagtcccccaggaaggtcttaaaggtttgggtaccaaggttgtggaggatgaggactaaaccctctgtctgttgtttcaatcagttagaacttaatacatatctgctgagagcatgttgggaagtcttgctttagc

SEQ ID NO: 4738 - DNA, 553 bp, Hordeum vulgare
  UNSURE (20),(52): n stands for any base
ttgccaaatcctaaaatgtntcattaattttatgatattaaacaggcacagngtctctcaatttcacttcttgagctcctcttccacattaagaatcctccaataaacaaaagctatttagttcctagcaaggaattcttgacagagacaacaatcgagcatcacaaggatgtgaagaacgcccattaacatgacgcaagtcaacagcaagtcaaaacttcaagcacttgaacaaaatatccaacgtctcaaatcttctatcaagaagtcatggaacatcatgaacagtagataacaataagctaaagcaagacttcccaacatgctctcagcagatatgtattaagttctaactgattgaaacaacagacagagggtttagtcctcatcctccacaaccttggtacccaaacctttaagaccttcctgggggacttcagcaactgtcaccagagagtacagctcctccttagcgtcctcctcgtcgttcctcttgcgggcaatcctgacacggactctcctcgggacactcctgatgccgctgctccagatg

SEQ ID NO: 4739 - DNA, 520 bp, Hordeum vulgare
gtccaggtcagggacgcttctctcctaggagaggatcaatgtctaattatcacgacgatcatgtcgaagacatggaggatgattatgatatggacgaccccgctgaggacatgatcgacgcccaccatgagcgaggtttaagggactccgattcggaggatgaagagtatgcccactcgaatgataaaatcccagatacttcggcagcggatgcaagaaaaggaaaagacatccaaggaataccgtgggagaggctagctatcacacgggaaaactacagaaagaccagattagagcagtacaaaaactatgagaatattcctaattctggagaagcagcagccaaggaatgcaaaccgactgagaaaggtggaacatattatgaattcagacaaaatactagatcagtaaaatcaaccatcctacattttcagctgagaaatttagtatgggctacatccaagcatgacgtctacctaatgtcacattactcagtacttcactggtcagcgttgagtgg

SEQ ID NO: 4740 - DNA, 904 bp, Hordeum vulgare
  UNSURE (45),(904): n stands for any base
attaactggagtctaaaatatatgatgagatgcactctaccccanacataggctatatgcatctgtacatttgtttatatacacatacaacgatacaacatttattaatttgaattatgcaggtcaactcgagaagttccggttttggggagacgcctaacttatgccacaccaaccattcggtgcagctgagggggaggacaagcaggtccaacatccgctccgctttcgcctcaaagcagcgagtcatgataccaattgttatacaggcgcccaaactggaggaggctaccatacgttctatcccacacgcccacgaaaagggcgtctgtgtccgggctgaaggacatcccagatatctcaccaaagaagtccagctcttgccttctcttgtagtcgctcttcacatcgaagatgtgcacaaagtccgctggttccgccatcgacaggaactgcccgtccgacgtgaagcggatcgatctaatggctccaaggttacctttcaatacatggactgctttcgataggttcctcgcgtcccagattcggcatgtcttgtcttggttcccagtagcaaatgttcggccatcagggctccaggctgatgcgaatgagaagtcatgatgacctttcatggaatgaagagtctttcctgaattggcatcaataagtaaaccattaggatcatcccccacaataacaacaagctttccatcagggctcagtgatgtatgattcactggccaatcaaactgaaagtgcttgcataactggaatctctccatgtcatagtctcttacaccagagtcattattcgatgccatgaaatgaacagcaccgctagaagtattgaatatctcaactgcattagtaatggcattatcatcatatgttgttcgacagn

SEQ ID NO: 4741 - DNA, 517 bp, Hordeum vulgare
gagaggatgtcagggatgctggtgaagagcaggcggtcagctccttccgtgaggttttgtttgccaggagcctattgcctgaaaggcatgatgattaccatatgatgcttagatttttgaaagctagaaagttcgacgtcgaaaaggcagcacaaatgtgggatgagatgctccattggaggaatgaatttgggacggacacaattttggaagattttgaatttcatgagctagaggaggtactgcaatattatccccagggttatcatggggttgacaaggatggaaggcctgtctatatcgagttgcttggaaaagttgaacccaataaacttgtgcaaaccacaacagtggaacgatatatcaagtaccatgtgcaagagtttgagagagcattccgtgagaagtttccagcctgctcaattgcggctcaaaagcatatagatacaacaaccacaatattggatgtccatggcgtgggctggaagaactttggtaagattgcaagggatttagt

SEQ ID NO: 4742 - DNA, 546 bp, Hordeum vulgare
aagaattggttatatgagagccagcctaactgttctgacaatgaaaatgcacagaagcattccagtagagacaacagatcaggaggcacacattggcagagaaaacagaagacatagacgcaagatgagctgtgcgtcaggattcctcttttaactttctttagctgtatataagccgcgctatattcagttatcttccaggacactcttcttgactatcccctcagtttttctcgggtcaccaactatctatccttcttattaacatcacccatctttttgattgaccaaaaagaaaagcgagactgagcagccatatacaaagcaatgctgtttagtttttgtcggaaagcagtcatcaaagtcgccatctgtttttctttcttgttcatgtacattgatgtgagtgtactacgtacaaaatttccttcttctatgaccagactctgtcccggactccagtgtttcagccatctgcatttgtttgatcactgttgcatgcaataccttctttgtcttctccaggtcaaattcaatggattttat

SEQ ID NO: 4743 - DNA, 553 bp, Hordeum vulgare
  UNSURE (6),(12),(20),(45): n stands for any base
gtctcnccgggnctgcaggnaattctgcacgaggtatacaatganaaagctacaatcatacagggcatttacccatcagagtggcagagcttggaactgtctacagatatgagctctctggtgctctgcatgggctgttccgcgtaagagggtttacacaggatgatgcccacatattttgtctcgaggaccagataaaagatgaaattagaggagttcttgatttaactgaagaaatactggggcagtttggcttccggaattatgaggtaaacctttcaaccaggccagaaaaatctgttggcagtgacgacatatgggaaaaggcaacaattgctctgaaagacgcgctggatgataaaggttgggggtacacgattgatgaagggggaggtgctttctatggtccgaaaattgatttgaaaattgaggatgctcttggaagaaaatggcaatgttccactgtgcaggttgacttcaatttgcctgaacggtttgacatcacttatgttgactcgcatactgagaagaaacgacctatcatgattcatag

SEQ ID NO: 4744 - DNA, 541 bp, Hordeum vulgare
gtgatggcttttgtgcacaaaattgctggacctcatgctcggtttcgtcggaagcgctccgctccggcggtgtatgtgcagcagaagatctggtgctctacaatatgaactgaagttttaacagaccggggtatctacagcgaggatttgtcagcgacggccgattggattttgctgatgaaattgtcgacgggcatggtgcccatctccccgttatgcctggacctgatggtgagcgtcctggcctcgacttccttggggccaacgacagccatcagcggcaccttttgtgtttcggcgtttctgattaacttcggcagacgctcgccgtggcatacctcggcgcggatacctattgatttcagctccgaagccacctcgttacagtactgcaactcattgtttgtgacaggtagaatacgggcttgggttggagcaagccaaagtggaaaatcaccagcatagttttcaatgaggatgccaaaaaaacgctccaaagacccaaggatggctctatgaatcatgataggtcgtttcttct

SEQ ID NO: 4745 - DNA, 947 bp, Hordeum vulgare
  UNSURE (20),(676),(711),(762),(828): n stands for any base
gtacccccgggtctgcaggnaattcggcacgaggtgagagtagagagagagagagagagagagagagagagagagagagagagagagagagagagagagagagagagagggccccctctcccaccccatacatctacagtatatagtgtgggggctctcccgcggggggcccccgtctctatatataaaacgcgcgcgatatatggggggggagcgcgggctctctctcctcttttagagcgcgcgggagaatatttgcgcacatatctgttatattttcgctctgcacaatctatatatcctctctctcacgcgcgcgctgcttttctcccacacgcacactttcgcgcgcggagggggagagagacaccccccccccacactcacgcgcgcgcgctctctctatatgaacacagaggcgcgcggcgccccccccagtgtatatatataacacacacacgctctaagagagagtttatacttgggagaacactctcttctgtgtttagagagagatatacctcttgtggtggagcgtcacagacatctcccacacacagactgtgtcaatattgtcttcccgggagagggcgcgagaacgctctcacacaagggggggcacatcttcacagtgtgtgtgtgcgagagcgcgcgagagagacacaagaatattccncataaagagaagggcactctggggggagacgtgtntttagtggaggagatatatcacactgggggggctctctgagagagagacanagaggtgtgtgtgcatagcgccacacaagagagcgcgtctatgtatctgaggggggccccacaaanagatataagagctctatgagagtgatatttggggcgcgccgggagcacagttttcttttttgtggatcacgtttcctcgcccccagagggggagagccctccccccaccctcttgtggg

SEQ ID NO: 4746 - DNA, 550 bp, Hordeum vulgare
gtacaggtgtcgattgatgtatcctattagggccatatgatgaaaatttggtaagcacgaggtcgaaacctgacctacaatttcaatcgaatgcaaacgctcaggtttcgtacatgtcatgccatgtcaggaaattaaaacaccgacctggtctagagcattagaagcgaatacagaggaccgtacaggtgaatatccaatgccttgttttattatcaaaccatgggctgcttatgaaaagcttcagactcgacacaattagacaacccgaactcgctccacattatttgttctgctggagctggaaatgtaagctctacattcaggagcagcccatttcacagtccatgttcatatctgaagggcatcagcgatcgagctagcaaggctcaacacctcaaatggaggttgttggctgatggctttcaccgtttgagggcatgaatccgtgatccagaagtaagcaaactggtcacctggctcagcagaattagcagtcatgaagcgttcatatgactgattggggaacacagcatgagttacataggcg

SEQ ID NO: 4747 - DNA, 518 bp, Hordeum vulgare
gaagatactgaatggcttcctggatctcctgaggctataagaggttcctttgtttttgtctgctgccatggaagcagggataaaaggtgtggtgtttgtggtcctgctttgattacaaggttcaaggaagagattgaagcagaaggtcttgatgatcacgtggctgttagtgcatgctcacatgtgggaggtcataagtatgcaggaaatgtcatcatattcagtccaggtgccaagggagaagtgactggtaattggtatggttatgttgcccctgatgatgtgcctgagttactgcacaaacaagttggacaaagaggagcgattgtggaccgtctatggaggggtcagttgggtatgtctgaggagcagcagaagaaagctctggagcttaggcacatgacgaatggtgtgactggggaagaatcaagcgccaaagaatcccctaaagcaaatggaactgacggtgcacctgcaggtggatgctgccagggcaatggaggaggctttagctgctg

SEQ ID NO: 4748 - DNA, 550 bp, Hordeum vulgare
gaacaccagggcctagccttgctacaacaatatagccaggcgtcgaaaacttcaaaacctaggagtttcgcatgaggacattacgcataacagattttcgtcaccatctcagctactttttaagttctagcattaccactatgcactagtatataacttcggtagactctccttgatgcacaaaacctgcattgttttgaagattgcttcacaggcttcagttcatggtcttgtaggccctgaaagcgacgaacaccgttgcagcagctgcaacaacagcaagagtggtgtaggtgtcagacctatcccaggtctcgaaccaggtgggcatcgggcaaatcttcatgcgacccttgctgggggcaacactttctttgacactctctgccttggggctcttgtggttctgctcagctgtaatgctcttgtcctgttttccttctggcagatcactttggcagcagctaaagcctcctccattgccctggcagcatccacctgcaggtgcaccgtcagttccatttgctttaggggattctttggcgcttga

SEQ ID NO: 4749 - DNA, 338 bp, Hordeum vulgare
  UNSURE (20): n stands for any base
gtacccccgggcctgcaggnaattcggcacgagggctgtgaacctaatctgcgcgtttggaggttgtgatggatgatgcaatgttttgaactctgttatcggtatctgcatcttcagggctcgtctgaaggttaaggcttatcctggattagtttctgacatttacattcagttcgtgctgtcatgctatacgtctgtgtggatggtttcatttcccatggaaactgcttgcttatcctgtggataggaaacttattgtcacataggttgttctagctcttgaagctgcatgtggtccagtcattttaatcagtttccaggctaaaaaaaaaaaaaaa

SEQ ID NO: 4750 - DNA, 284 bp, Hordeum vulgare
gcctggaactgattaaagactggacccatgcagcttcaagagctagaacaacctatgtgacaataagtttcctatccacaggataagcaagcagtttccatgggaaatgaaaccatccacacagacgtatagcatgacagcacgaactgaatgtaaatgtcagaaactaatccaggataagccttaaccttcagacgagccctgaagatgcagataccgataacagagttcaaaacattgcatcatccatcacaacctccaaacgcgcagattaggttcacagc

SEQ ID NO: 4751 - DNA, 518 bp, Hordeum vulgare
caacccaggtgtcacagttgttgacattgatggggatggtagtttcctcatgaacattcaggagttggcgttgatccgtattgagaacctcccagtgaaggtgatgatattgaacaaccagcacctgggaatggtggtgcagtgggaggataggttttacaaggccaaccgggcgcacacataccttggcaacccagaaaatgagagtgagatatatccagattttgtgacgattgctaaaggattcaacgttccggcagttcgtgtgacaaagaagagtgaagtcagtgcagctatcaagaagatgcttgagaccccagggccgtacctgctggatatcattgtcccgcatcaggagcacgtgctgcctatgatcccaagcggtggtgctttcaaggacatgatcatggagggtgatggcaggacctcgtattaatctgaatttcgacctacaagacctacaagtgtgacatgcgcaatcagcatgatgcctgcgtgttgtatcaactactaggggt

SEQ ID NO: 4752 - DNA, 551 bp, Hordeum vulgare
tggcaagtcttattattgatatgtaggacaagaaacttgcatgacatcttatgacagcatatccctacaaaagagaacatagactacaaaactacagggttcggaactaagtagtacaagcttatatgaatgaaacaagtaaactagaaaaacgcatggttcacagtcgaacccctagtagttgatacaacacgcaggcatcatgctgattgcgcatgtcacacttgtaggtcttgtaggtcgaaattcagattaatacgaggtcctgccatcaccctccatgatcatgtccttgaaagcaccaccgcttgggatcataggcagcacgtgctcctgatgcgggacaatgatatccagcaggtacggccctggggtctcaagcatcttcttgatagctgcactgacttcactcttctttgtcacacgaactgccggaacgttgaatcctttagcaatcgtcacaaaatctggatatatctcactctcattttctgggttgccaaggtatgtgtgcgcccggttggccttgtaaaacctatcctcccactgca

SEQ ID NO: 4753 - DNA, 552 bp, Hordeum vulgare
  UNSURE (11): n stands for any base
gtccccccggngctgcagggaattcggcacgagggtgcttgagaaagttggagtacagccagaaattaacgaattggtcgctacaaaagtgctggagaccaacttgggcggaagagcatgtcaaatgaagttaaggagatgctgggtgcactgcttgataatatctatggaaactggctggatacagtgtcttccacacaagggaagaaaaaagaagaaattgaggaatttgtcaactcaggagtctatcaggtcgagaaacttaaggaagaaggttggataacggatctattgtatgatgatcaggtaatgacaatgctgaaagagagagtaggacagaatgacaagaaaagcctgcgtacggttgattacagtaaatattcaggtgtaagaaaatcaactcttgggataggaggaggaggagacttaattgcagtaatcagagcatctggaagcataacacgaactcgaagtggcctgagtatttctagttcgggcattattgccgagcaattaatcaagaagatacgtactgttagagagtcagacaag

SEQ ID NO: 4754 - DNA, 538 bp, Hordeum vulgare
tctcgcatttttcagtatggcggctacaggggttacaacgcttgcatatgcatcgatacaagcatgactcggtaccaaatgtattgtattctacctgaatttaggtagggtgggtgtctattgccatgttacttctgtgttctcctatctacagcttttcgtagaactttggctatttaccggtgatcaaccgaaataatttgtgatttcctttaccagcaagaagagctgattttctcctggcatgttttccagtctttcaaacaagatgccatccattctagcttggactccatttaaggaggtgacgtcctgcagcacccccttcacgaccctgtcaactccaagaattgaacccccaatacctgacaagatctccggtagcgtcggcgaggcctttgagatctcaactagccggaccttcttatcctgtggtatcttagctctctgttttgcaatagcaagcgcttgtgagaatccacctagcgaatcaaccaaccctcttgaagctgcatcttggccactccaaactcgacct

SEQ ID NO: 4755 - DNA, 485 bp, Hordeum vulgare
cacccggataaactaagagcccaatcaatcaccggcggctccgctcaacgatccctgattacctcgccaccggaggccaggaacctcgaagcggacagcgagaggaaccgatccagaggaggagatgggctcctgcgagatgacggccacggaggtagcggcgctgctggatctgaagccgcacccggagggcggctactacgccgagaccttccgcgactcctccgtctccctcaccaccgcccagctcccgccgcagtacaaggttgggcgtgctgtgagcaccgctatctatttcttgcttcctgcaggaagtgtttcacgcctgcatcgtattccttgcgctgaaacctggcatttctacaagggagagcctctcacggtctttgagctacacgacgatggccacattgacctcaccgtaattggcccacacctagacgctggccagcgcccccagtacaccgtgccaccaaatgtgtggt

SEQ ID NO: 4756 - DNA, 542 bp, Hordeum vulgare
  UNSURE (8): n stands for any base
aaggcacnctccttgtttaccatcaagctcaaactttattccaataattatggtacataaaatgttacaaccaggaaccagcaccggcacaatgagtgttctttagcagagtgataagacaaaaatacagacctcgtggagccaaagaaaatgatatccaaagccaatacaggcagggcggataaatgccataataggctgcttgcattcagtatgaacatctcgggtcctgcttacttgttggatggaataaggtagttgaggaagggttctgccttcggggcaatggttttcacatcatcaaaagaggccatttcgaaatcctcgtactcgaagccaggggcgcaagtgcagccgacgagggagtagtgcttctcggggtctcgcttccgagagttgacaagatggctgccatcggatgcaaacgactcgacatccaacgtagggaaagaaccaaaccacacatttggtggcacggtgtactgggggcgctggccagcgtctaggtgtgggccaattacggtgaggtcaatgtggccatc

SEQ ID NO: 4757 - DNA, 533 bp, Hordeum vulgare
  UNSURE (3): n stands for any base
  UNSURE (1)..(3),(8),(16)..(18),(23)..(26),(28),(31),,(33),(36)..(42),(44),(45),(52)..(56),(59)..(65),(69),(82)..(94),(99),(101),(103),(104),(110),(111),(112): n stands for any base
ggnaattcggcacgaggggcgacatcaagctcgccgccaagcgggtcgatgatggcgggaggaaggtcacgaagaaactggatgtcaagggggcggcatcggctgggacaactccacagttctgctcccgattaagggcaatgtgttccccgatgggcagtattacacctctatctttgttggcaatccgccaagaccttatttccttgatgttgatactggaagcgatttaacatggattcagtgtgatgcaccatgcacaaactgtgccaaaggacctcatcctttatataagccagcaaaggaaaagatagtccctcccagggattcgctatgtcaagagttgcaaggtgatcaaaactactgtgaaacttgcaagcaatgtgactatgagattgaatatgccgatagaagctcgtctatgggtgttcttgcaaaggatgacatgcatctaatcgctacaaatggtggaagggaaaagctagactttgtatttgggtgtgcatatgatcagcaaggccagcttttgtcct

SEQ ID NO: 4758 - DNA, 551 bp, Hordeum vulgare
ttggcctggaaattctattctacagctaataatacatacagtacattgattcttgcgtatatacatacaatgcggtgcattacaaacaagtattacaacagacagtggggaccatggctagtgacagtagatgaaatagggcacgcgatggcagctgctatccagcgtgcagctccaatggtactctctgcgtatcccttacacatctttatttcgcaaagatgatcgtcagaggaagaagggaaagcccttctgtgattgtggcttggtgcactctgaattggcccatccgatctgcctccgctcattgtcatacacaactagtttgccgcgcagagaaacatctccaactattatggttgacccatgattgatctctgttccatttagcagccccagacaaacattgcccttatcactgatgatcaagtaatcatcgggaacaatggtgaatgttttcggcacgacaaaccatcttctcccaaaatgaaggttcaagggcttgaagaaagacctaacagaaaaatcagctttccagcataaaggtaatg

SEQ ID NO: 4759 - DNA, 486 bp, Hordeum vulgare
tactggtattatgtggaacagatatgattttcccgcgtttctactttcagaggagagcacacagactctacgaaagattgcggacaagaatgagaagtctaacaatggatatcaagcaaatgtagcagaatttgaccttgttatgcagacaactaaagctgaaacacatggttcagaggcctgcctcaaagagcagtcgtgcttgcccttaggaggacagagtgtatgggcttcgttaccaccaatgagcaatgcatcaaaagagcatcagaaaccaataataatggttgttgcatcccaggattctgcatcattctttagggaccgtagtttgggtgctgattctcccatatcaggattgattgctttgctcactgctgttgatgctctttctcaccttcatgatctaggcaaactcaagaaacagcttgtgtttgctgcttttgatggtgaagcatggggttatcttggtagcagaaaattctt

SEQ ID NO: 4760 - DNA, 539 bp, Hordeum vulgare
ctgcaagatgatacgtacccgtaaaaaacctctcacggttccaatgtccagtatacaccctacctgctcgaggcgcatttccagaagcatccatccacctatctaccaaacaacatccgagcataccacggcaaccaaccaaagccaatatgctctgcaagtctgcatcgctactacgctcgacgattacacccatactcattggctgggaggaggctgcgtaggtactatccaccttgaaatgtttgtcaagtcaagttctatgttacacgatgtcatggctctcagtcccgcttcgtcatcttcgagatgtacgctctgccgacgaccaccccgaggtaggatgccgcggtgacggcgagcccggcgagaaggatgagcctatcggaggtcgtggactgcaccgcgtagactctcaggcctatggtgttccagtagctctcggtccatatggggtccgcagcacccatagggtccgaagagtttgccggaagaacgtgccaggcattgtcctcgaacttcagcctggttgaataggc

SEQ ID NO: 4761 - DNA, 453 bp, Hordeum vulgare
agccgatgctgcggacgcagtactgatgcagctcgccgaccaagtacccgaggaactgtgggcaatgagactgggcttgaggttgcttcaagagaggacaaaattcgattcgttttggtggccatatatcgcgaacctgccagagacctttaccgtaccaatcttctttccaggggaagacataaagaacttgcaatatgctcctctcctccaccagataaataaaagatgtcgtttccttctcgagtttgagaaagaggtaaaacagaagcttggcactgtgccctcaggagatcatcctttttgtggacaagatgtacactcgtcctcccttggatgggctatgtccgcagcgtcttcacgagcattccgtctgcatggtgaaatcccaatgttgttgccccttgttgatatgtgcaaccatagttttagcccgaatgctatgattgtcca

SEQ ID NO: 4762 - DNA, 551 bp, Hordeum vulgare
ggtaaaagataaaattggggatttatttgttcatatccaggaaagatagtagttgattgtccaaaagagagttatcacaaattgttaacatcctaggcagtagatttctccggagacagcgtcttgattctccgactaagattctgcattatgtcgacgagcatcagcttcttctgcaatctaaactggacggccagttcagtagtaagagggggttctccctttaggatggcctggtcatccattatcttggtgtggaagtgttggagggcaatggcgcaaagcgcgagaacagttcggaacgcagaggcttcgacagtagggcctagaggagctttcgcactaagtgacatcaaagttttcagatcgtgcttacccacagcctctgggtcagctgcaagaagaactcgcagcgcagctaataagcgcccatctactatgtccggacctcctaagctgacctttagaatggcaccctctccgtgtagatttagctgtgacaagatttcctgttgccacttggctggtgttgagaagttgggattagaaac

SEQ ID NO: 4763 - DNA, 519 bp, Hordeum vulgare
gtgagtacttctataggcacgtatccaccactcggagcaggcgctcccgcccagcaacgccgccgcccggagctacgccggcgacctgtccatagggaatcaatattgtcaattggagaggcttggagctgcttcggcatccagtagagcaaacaagaaggtcaaattggaaacataatttaatccttggacggacttctcatcttgcaatggaagccaagttctttcggtttctgaagcttgttggagttgggtttaaagcaaggacagagcgtgaaggccgcgagttgtttctgaaactgggctacagccatgaggtgcagttcaccgctccacctgctgttcgcgtcttctgcttcaaacccaacataatatgctgtaccggcattgacaagcatagagtgcaccattttgccggagctgtccgatgcagcaaacctcctgaagtgtacaaggggaagggcatactgtatatcgatgaggtcataaagctgaagccagggaagaagcagcagaaga

SEQ ID NO: 4764 - DNA, 422 bp, Hordeum vulgare
gaaagtaggttacatgcatctagccggcccaaaacaaaaacacaaatgtttgaatgtgctgattcgcccccacggtatgcaagtcatacagcacatgctcaccagatgattcacatagcatacggagtattattacgaagtccagcatggtactggggctagccataatccgacacgagaaaactaaatgaaatccacggcaccacaaatgtgacgcacatcttaatatgctggaagtcaaatggggaggtttacccgtgtgttacttcttctgctgcttcttccctggcttcagctttatgacctcatcgatatacagtatgcccttccccttgtacacttcaggaggtttgctgcatcggacagctccggcaaaatggtgcactctatgcttgtcaatgccggtacagcatattatgttg

SEQ ID NO: 4765 - DNA, 1201 bp, Hordeum vulgare
  UNSURE (1)..(3),(8),(16)..(18),(23)..(26),(28),(31)..(33),(36)..(42),(44)..(45),(52)..(56),(59)..(65),(69),(82)..(94),(99),(101),(103)..(104),(110)..(112): n stands for any base
nnnaaaanttaacctnnnaatgnnnncnaannntgnnnnnnncnnaatcccnnnnntgnnnnnnntttnacgaaggcccctnnnnnnnnnnnnnttgtntngnnatgggnnncccaaaaaaaaagccttctcctcttaaaaaaaactataggagggagtgatttacttctcaaccgggggttttcacccccacaaaaaaacgtttatctgtccctccctcttctccatcccttctctttttttcgctccttcccatctctcttcctcctcctttctcctttcttcgggtgggggggcgatctctcttcttcctcctctcattcctatttttccttcttcctctcaacatcccgtcccttccattccttccttaccatttccataacccacccccacatttccactcattcattcaattccccacatctcccccatccccattaattttcttctatcaaccaacaatcaatcatacctttcctccctaaatattcctcccaacacatcaccacctcatccctatctgtatttcatcacttctatccattcccctccaacatcccttcccattccactctatttcttccccctctattttcccctctttcccctttacccccacccccccacacccactcagtacaaatatcctctttccatccctctcccattttatcccccctcttacatcgcatatacctttcccccttcccctttccccatatcccccctccttttacttcaccctcacaccccagttattttctccttctcctcccaacctccatttcctctattgtctcttcaacatcatatcctcatccacttatcccttttattttccccgtatttacacaacatctccccccaaccctacaccctttatacccccaattccgcatccatgcgtagtacatatctcttacatcatcaccttacttatcccccttcattcactttctttgatcaataatatgcatcatttacctcctactctctcttccccattctttcaacaactccctcatcttactttatacttcacaaacgtccatataccacccaattatacctcatgttccccataatctcattcctctcctactatatgattaccctcccccctttcctaattatttccgctcaatcctttctttctttcccttccgctataataaccccctccaccacacctataccc

SEQ ID NO: 4766 - DNA, 551 bp, Hordeum vulgare
ggtaaaattttgctaaagtggagtccataaccaacgttaagctattttgtgaccttcttatacagagcacactttatgttaatgttcattcatgtacacttgtacacgctcacatcctaaacagaaagcacagccaatcctcacagaactctcattgatatcattcagtttacaaccaggctctcgttgatatcatcagtttacaaacagacgggaatcacaaggcttctcacttgccgcttgctccaggatgttcatgcatacagaccttgagtatgaaaagttacgtcagtgtaagtcctcggcgagccttcagttttcactgcctttgagaatgttgtacttgcaaagcggacagtttgcgtgcattcgtagccatttcgtgatgcacattgagtggaagtgatggttgcaagggagggcagatagctccactccgtcttcgtatgatgagagacatatgcagcattcagcatcctcacgaagaagaattcgttcgcttgttgatgttccactattattaaggataggaatcataaccccctcgtctg

SEQ ID NO: 4767 - DNA, 553 bp, Hordeum vulgare
  UNSURE (20): n stands for any base
gtacccccgggcctgcaggnaattcggcacgagggctccctccctgccctcagtcgtcagccgggttcctccatccctcccgccatggcgctcctcaccgatctcctcaacctcgacctctccggctccacggagaagatcatcgccgagtacatatggatcggcggatctggcatggatctcaggagcaaggccaggaccctccccggcccggtcaccgaccccagcaagctgcccaagtggaactacgacggctccagcaccggccaggccccgggcgaggacagcgaggtcatcctgtacccacaggccatcttcaaggacccgttcaggaagggaaacaacatccttgtcatgtgcgattgctacaccccagctggagagccaatccccaccaacaagagatacaacgctgctaagatctttagcaaccccgatgttgccaaggaggagccatggtacggtattgagcaggagtacaccctcctacagaaggacatcaactggcctctcggctggcctgttggtggcttccctggtcctcagggtcctt

SEQ ID NO: 4768 - DNA, 546 bp, Hordeum vulgare
cgtggtaccacggtctgcggtacggaccattttattaccatatcaatcgatgattacacgagaccatagcatccagacggcaagggaaaacaatcaaccaaatactgtagtaatcttgtgctttgacacgccccttgccacccatcacccaccacccacccaaagacgagaacgagaagagatgaccatgatgatgtgacctacctaagcggactaggagtagtatgcaaccaaacgtaaaaggaaaatgctggaagaattttcgcccaaggcacgaatcctccaatggccaccaccggaccccatcaccgacggtccatcacacggcgaccggagcttcagggcttccacaggatggtggtctcggcgatcatggaggtgaccacgtaggggtccatgttggacgccggccggcggtcctcgaagtagcccttgccgttctgctccgtctcccggcccacgcgcaccgacgcgccacggtttgccacaccccagctgaaggtgttgatgtcggctgtctcgtgcttgccggtcagacggcgctcg

SEQ ID NO: 4769 - DNA, 256 bp, Hordeum vulgare
agttccaagtcagatggcaaacttgtctcccttgatgagtatatttcaaggatgaaatcagggcagaaggacatctcctaccttacaggaagcagcaaggaacagctagagaaatctccattccttgagcagctaaccaagaaaaactacgaggttatctacttcaccgaccccgtggatgagtacctgatgcaatacctcatggactacgaggacaagaagttccagaacgtgtccaaggagggcctgaagctcg

SEQ ID NO: 4770 - DNA, 522 bp, Hordeum vulgare
gatcctatgtaaatgggtcagaacaatgaaagaacataatgtgtctggaggagaccggcggtcgcaaaggagaagataattatcaactgccgactagtgagtgaactcatgactcggtccaggtccagggccagaccgggaccgtcgtcgcactggctcgctcgtcgcccctccttgaacgacacggtgagaaggaaaaaaaggaatttcgtactatcatcatgatttattgaatgaggtgcagcaaaggttcccactgttcgtttctaaggtccgggcgtaatcacaagtggaaggaagtatggcggaaaggaagggcgccgcgagggggatcggatcggagacagggctgcggcattcagttggagaccatgctctccgtctccttgacgaacccgtcgccggtccagtccttgtccgactgcaggcccatcctgatggccttgcgctgcttgatcgcctccttctgccgctgcaccaggtccgtgtgcgtcgtgaagtaggggagagacgcccctcgga

SEQ ID NO: 4771 - DNA, 551 bp, Hordeum vulgare
gtacccccgggcctgcagggaattcggcacgaggaagcgatctccggcgaatcggaaggcgagaggtccggccgcgcgatggcgctggagtgggtggtgctggggtacgcggcgggcgcggaggccatcatgctgctgctgctgacgctgccgggtctggacgcgctccggcgcgggatgatctccgtcgtgcggagcgcgctcaagcccatgatgtcggtggtgcccttctgcctcttcctgctcatggacatctactggaagtacgagatgcggcccacctgcgacgacgagcacgcctgcaccccctccgagcacctccgccaccagaagtccatcatgaagtcccagcgcaacgccctcctcatcgccgccgcgctgctcctctactggatcctcttctccgtcacctccctcgtcgtcaagctcgaccacctccagcagcgcgtcgacaagctcaagaagcgcgacgactgatctcgtacccctgccctcccgtcgcgtcaccgccccggccgacggtgtcgttgctccgtctcctcccgcgttta

SEQ ID NO: 4772 - DNA, 556 bp, Hordeum vulgare
gtaaagcatgattcagcatggctatccaaatttatggggttctgagtcacattcggaacaagattttgtaggaacagtgttcattatgatctttatcgcataaagacctattttactcgaactagatctgaagcagataaccgagcgctagcgaaatccggatcacgatctcaaacatccacactagaaaggaagaaggacacgaaacacatgcatcacagggtgtatctaggaacataaacgcgggaggagacggagcaacgacaccgtcggccggggcggtgacgcgacgggagggcaggggtacgagatcagtcgtcgcgcttcttgagcttgtcgacgcgctgctggaggtggtcgagcttgacgacgagggaggtgacggagaagaggatccagtagaggagcagcgcggcggcgatgaggagggcgttgcgctgggacttcatgatggacttctggtggcggaggtgctcggagggggtgcaggcgtgctcgtcgtcgcaggtgggccgcatctcgtacttccagtagatgtccatgagcaggaagaggc

SEQ ID NO: 4773 - DNA, 464 bp, Hordeum vulgare
gggcggtgaacgccacctttctcgtcgggaaatacactaggtttccggcatggcagcgcgacgggaagaggtttttggcggtgatttattacccccgccccgttccggatacgcgcgacgcaaggatggatggatggatggatggatgcgctagtgagggagtaccatattcgtaccggcagtactacgttttgtcctgttgggggagaggatctctgcggtggcatcctctgccgcccgcccccggtccctcccctgcgccacatggccccggcccggcccggcccggtcagatgctctgctcctcctcctccatgaatttcccagatgatcttcagcatgtcaccgagatcgatattttcactgagctcgggaaaaaaaaccgttgtgaacagtaataaaaccatgcgcgatcgtgagtttcggttgtgctggtatattcaccgtgtatttattttggattt

SEQ ID NO: 4774 - DNA, 551 bp, Hordeum vulgare
gcaagcggcgtggtacacggctgcggtcggaccttttattacctatcaatcgatgattacacgagaccatagcatccagacggcaagggaaaacaatcaaccaaatactgtagtaatcttgtgctttgacacgccccttgccacccatcacccaccacccacccaaagacgagaacgagaagagagaccagacaccctgatgagatgaccatgatgatgtgacctacctaagcggactaggagtagtatgcaaccaaacgtaaaaggaaaatgctggaagaattttcgcccaaggcacgaatcctccaatggccaccaccggaccccatcaccgacggtccatcacacggcgatcggagcttcagggcttccacaggatggtggtctcggcgatcatggaggtgaccacgtaggggtccatgttggacgccggccggcggtcctcgaagtagcccttgccgttctgctccgtctcccggcccacgcgcaccgacgcgccacggtttgccacaccccagctgaaggtgttgatgtcggccgtctcgtgcttg

SEQ ID NO: 4775 - DNA, 457 bp, Hordeum vulgare
  UNSURE (34): n stands for any base
cacaagttgacaaaaaccgtgagaagcagctggngcaattcccccaagcagaacagatgcggatgcaccatactgtgatacggcaccccccctgatgatgtacgatgcacctagttgtagaatttctcttgtgcttttgttgcgtccacggcgcggtgtgtattcattttgacatccagttcctggagccattgaaactcgatctagaatcgcatgcatgtacttgacactcctgaaagcatgcttggaatctggtgggagtgggactggctgggagtaaaggttcctccttgggatgttgctgctgtagcgagtgtgtgcaggagtcaaggaatggattggatgcttgctgttgtgtaaattgtaatgtggaaacaaccatcatttcattttcttttgcctttggctatgtttgacattatatcgattctttttagcgctgcaaaaaaaaaaaaaa

SEQ ID NO: 4776 - DNA, 430 bp, Hordeum vulgare
aagaatcgatataatggtaaacattagccaaggcaaaagaaaatgaaatgatggttgtttccacattcaatttacacaacagcaagcatccaatccattccttgactcctgcacacactcgctacagcagcaacatcccaaggaggaacctttactcccagccagtcccactcccaccagattccaagcatgctttcaggagtgtcaagtacatgcatgcgattctagatcgagtttcaatggctccaggaactggatgtcaaaatgaatacacaccgcgccgtggacgcaacaaaagcacaagagaaattctacaactaggtgcatcgtacatcatcagggggggtgccgtatcacagtatggtgcatccgcatctgttctgcttgggggaattgcccagctgcttctcacggtttttgtcaacttgtg

SEQ ID NO: 4777 - DNA, 516 bp, Hordeum vulgare
ttccagcgcatcgcgctctaccggccggcattgtccccgtctcctaccgagggtggcgtgccagaagaagggcggcatcaggttcacgatcaatggccactcgtacttcaacctggtgctggtcaccaacgtgggtggccccggcgacgtgcacgcggtgtccgtcaagtcgacgcgctcggcggcgtggcaggcgctctcacgcaactgggggcagaactggcagagcaacgcgctgctcgacgggcagggcctctcgttccgcgtgacggcaggcaacggccagtccgtggtctccaacaacgccgtcccgcgcggctggtcattcggccagaccttcagcggcgcccagttccactgagcccctgcatcatccgcagacgcagtactatctggttgtagtagttgttttagcgagtggtggtcgtcgtcaacctcccgattggagcgtgctgggaagcgccatggttttatggttggtccttcctcaggcatacgttcgtggggattcgagtt

SEQ ID NO: 4778 - DNA, 558 bp, Hordeum vulgare
  UNSURE (14): n stands for any base
tccaaaaggcccgnagggctcaaattaactcggtctgaggttaccatcacagccagcacacaccacacacacaaacaaggaacacaccaaaacatcctcgagacaaaggccactacccaagaggcccattcgctaatcggcgggtgatacaaggcggcatcggttaatcaaaccagcctttaccaccgctgccatcctagccaaaacctcgttcaaatgttcagctagcacacacaccacaccaggacaattaaaagcccatgataataccaggcctaactacctgctactaactcgaatccccacgaacgtatgcctgaggaaggaccaaccataaaaccatggcgcttcccagcacgctccaatcgggaggttgacgacgaccaccactcgctaaaacaactactacaaccagatagtactgcgtctgcggatgatgcaggggctcagtggaactgggcgccgctgaaggtctggccgaatgaccagccgcgcgggacggcgttgttggagaccacggactggccgttgcctgccgtcacgcggaacgagaggccc

SEQ ID NO: 4779 - DNA, 543 bp, Hordeum vulgare
ggactgcaggcaattcggcacgagggaagttccaggccgccacccgcctccgcgccaaggacaagatcgagggcggcaagatcatccgcgtcgaggctcaccccatccccgagcaccccaggcccaagagggtgtcggggcgtgtgacactggtcggcgacgcggcggggtacgtgaccaagtgctccggcgaggggatctacttcgcggccaagagcgggcggatgtgcgcggaggcgatcgtggcggggtcggcgaacgggacgcggctggtggacgagagcgacctgcgcaagtacctggcggagttcgaccggctctactggccgacgtacaaggtgctggacatcctgcagaaggtgttctaccgctccaacgcggcgcgggaggcgttcgtggagatgtgcgccgacgactacgtgcagcggatgaccttcgacagctacctctacaagcgcgtcgtgccgggcaaccccatcgaggacatcaagctcgccgtcaacaccatcggcagcctcgtcagggccaccgcgctgcgccggg

SEQ ID NO: 4780 - DNA, 523 bp, Hordeum vulgare
tttgaaattggcgtgcttcaacaatccagacgaactgttctgaagtctgaacatcaccgtacaagaaaatgggacaggttcgaccaagacacgacctctcgatcgacgccattacctctttattctcatctcctctgcctcaaatccgttcgatcggccgcggatctctgctataccgatcgatccgccgcagcttcgagcaacccaagcaggatgtcagggacgtttccggtgtgtcggcgatcacaaggtgagcttccccatctcccggcgcagcgcggtggccctgacgaggctgccgatggtgttgacggcgagcttgatgtcctcgatggggttgcccggcacgacgcgcttgtagaggtagctgtcgaaggtcatccgctgcacgtagtcgtcggcgcacatctccacgaacgcctcccgcgccgcgttggagcggtagaacaccttctgcaggatgtccagcaccttgtacgtcggccagtagagccggtcgaactccgccaggtacttgcgcagg

SEQ ID NO: 4781 - DNA, 520 bp, Hordeum vulgare
  UNSURE (11),(12): n stands for any base
cgggagggggnnctggggcccgcgagggagggagcggggatgccgattggggtgtcggacgagctgctcggcacgttcgtgccgatcgccgtctactggctctactcggggctctacgtcgcgctggacggcgtggagcgcctcgacgcctaccgcctgcaccccaggggcgaggaggccgccaggaacgtcgtctccagggccgccgtcgtcaggggcgtcctcgtccagcaggccttccaggtcgtcgtcgcgctcacgctcttcgcggtaatcatcctcctcctcctcctcgccgtctcctgtcttgtatcccttctggtggcttgcagatagaccacccgaatacgtagctttggcctttcttgtattggcaaccatgattgtaagctgcgaagtgccttttcccctctttcatagtagatggtactactagtagatagagggacggtgcttgataggctatggcctgatttggagctaaagcgactggcttaggacgtcgttgtcttgggactgt

SEQ ID NO: 4782 - DNA, 548 bp, Hordeum vulgare
gcccacaatttgctctatgtggaatgaggaatgcgctagttacatgccaaaaacagtcccaagacaacgacgtcctaagccagtcgctttagctccaaatcaggccatagcctatcaagcaccgtccctctatctactagtagtaccatctactatgaaagaggggaaaaggcacttcgcagcttacaatcatggttgccaatacaagaaaggccaaagctacgtattcgggtggtctatctgcaagccaccagaagggatacaagacaggagacggcgaggaggaggaggaggatgattaccgcgaagagcgtgagcgcgacgacgacctggaaggcctgctggacgaggacgcccctgacgacggcggccctggagacgacgttcctggcggcctcctcgcccctggggtgcaggcggtaggcgtcgaggcgctccacgccgtccagcgcgacgtagagccccgagtagagccagtagacggcgatcggcacgaacgtgccgagcagctcgtccgacaccccaatcggcatccccgctccctccct

SEQ ID NO: 4783 - DNA, 523 bp, Hordeum vulgare
ccccctccctggcttaagcgtcgccgcgcagccgccgccgaccggcgcttcgatcgggagttcagacttgtggcatgcaggtgacactatttgacgctctctgtctcttgacttggatataacaagttatcgtcgctgcgagtaagctttatttgtcaaacaaaaataagctagtagtatttgctcgtgattgggcaaattagtcaagacgggcgctctttgctgcgtggccgctaggccacatgggacaaagtctaatcctgctagcagagactgttccatggatcctacagagcctcgttggcggatgaattcgagcttctctcctccgtcgcggggatgggactgcatgtactcatcagacggattgcctcataggactcctgatgctccacacgatcatccaccttatgtgtcatcactatcatctcatagtaaaggaagtagaagtgcatttggcagtgaccagtacctgaatcaccaccattctgtatctgatggagcactttcttattttggtagt

SEQ ID NO: 4784 - DNA, 543 bp, Hordeum vulgare
aacccgttctcgtctgttaatactcagaccagccgggcctgcccattgttcgatacagtgacacaccccaaacaaaacaacaggcggcaaaccagtcatgatgaaagcacagcacagttagttcacgcactcatggtgccacatccaaggcagaggcaccgtcgaatcaaaacaaacaagctccgtcctggacgagtactcgcagcgcactggcactgcatttcacagcttatggatacatctactacagatttggacagggtagaagggtagagtaacggcggcgcggcacaatataggggcggcgcgccttcgctctagcttacttactccatggattggtcaggcttattagctgctggcggctgacgacggtcgtccttttggcccccggaagacgaagacgagccggccttcctgaaaaccctgccaccaaagaggtccttgccgagcctccccttgaaggggaactgcttcttgaaacggttccggaacagcgagccgctgcgcgctggcgcgagcgcagactgatttctcttcagc

SEQ ID NO: 4785 - DNA, 552 bp, Hordeum vulgare
  UNSURE (20): n stands for any base
gtcctcccgggcctgcaggnaattcggcacgaggcggcagcagaacgaggttcgacagtagttcaggaaaaggtggcccatcactggagcgtgaaacttctggcagtgtgtctgtattgccttctggtcgcaaacgtctcatgccatcatcgcagatgagagatgatgcatcacatggagaggctaatgatgcaaatcctccatcaaagaaacctaaggaggatcctgcacaaaattccagtgagttaaaaactgatcaatcggcccctgaagatgtaacaactgaggctcctatggttatttcgatggacaaccaagatgtgcaacaacagcctggagaagagatgggtacggatcagggttccttgccagttgaagaggttgaggacatcagggatgacgaagtgggtaacaatgatgacatggaagaacatacaggtgcatcaatggacattgaaggccaggatgctgaagttaatatggacagtgatgcagctgctgtggaagatgcgcctcttaagtcagaggcagtagtggaatcattcgatgaag

SEQ ID NO: 4786 - DNA, 543 bp, Hordeum vulgare
gtatacgcctactcgacgggctgcaagtcatgcaatgctttactcgggcaacaaagtagctcagtagttaatggcaaagagtagtctatgtagctggccaaaaagacacaactacgagtttctagcaacgaggacttgaactctttctaactcactattactggccacctcgccgagaacgtccccgtagtggtccgcgcccaccagcatctcgagaacgagccctggaaggctgggtggttgtccgtacaagtctggttggtctgcttgttctcaagttgattgttctacccacagtctctgctccagtactgggattctgttgttcagaagatgcaccagcatgggctgggtttgaaggggaaggttcacgtgcaggggatgcatctgtggttctgcttggtgatgcatcggctccgcctgattgtgctattacagggctttggtctggctccacctcagcacgttcagcggtaccatcaccttctacaatctcctctgacatatctgcatcgctctttgctgccggcccacctggagatg

SEQ ID NO: 4787 - DNA, 553 bp, Hordeum vulgare
gtcccccgggtctgcaggttgaatttgagatgcggtcaagattcaatcaatgagctcggaaaacacgaacagtacagcattgttttggattctagttactgtaaatgtgaattcatgtttgaggacccaataataaagcaagaaaaagcaagctgagattgaagctgagagaattggtgttggtgtcaccccagaagctcaaagattatttgatgcattgtcaaagacgcttccagttcattgggacaagaccgacattgttgtaatgaaggaggttcgtgtatgcagtccctacctgcctgaaaatgtcagcggcggaacatcagctgctaatgaacgggttaagaaagtgctggactttgagaggaaaagacaacatgtgcgtgtacctggccaattctaacttattcgacttgacaatttttcacctcaactcctgctgtgatctgtttctaaatccgaccttattcattcagtttcgtcagttgaatcttttaaaaatctgtttcagcatgttgttctcacaaactaccacaccagctagcttattgat

SEQ ID NO: 4788 - DNA, 535 bp, Hordeum vulgare
aaaagcttacaaagtctgacagactaattttcagttttgccttggctccgcatcttttcttagtttgttatacaacttcctattctttcagtgtcaccaatctattttcttaccttggtttgcttcagccacacaacctttcactatcagccatatgaattatcagcacggtgtgctgcaattattcaccaccaccacatatggcatctaacgcagagtatcaataagctagctggtgtggtagtttgtgagaacaacatgctgaaacagatttttaaaagattcaactgacgaaactgaatgaataaggtcggatttagaaacagatcacagcaggagttgaggtgaaaaattgtcaagtcgaataagttagaattggccaggtacacgcacatgttgtcttttcctctcaaagtccagcactttcttaacccgttcattagcagctgatgttccgccgctgacattttcaggcaggtagggactgcatacacgaacctccttcattacaacaatgtcggtcttgtcccaatga

SEQ ID NO: 4789 - DNA, 533 bp, Hordeum vulgare
ggcaattcggcacgaggaaggagggcgcttttccgggcaatgaagcgaaggctggttcgcgagttgttccgtatgaatgtggtggtaacttggaagagatttctgaggttgaaggtggttcagagagggctcagtcaggcctcaaagacgagggcttgtcagagatcaggacacagctgcttcagattgagaaacagcagagtggtttgcttgatcttctccagaaatttatggggaaatctgagaatggcatgaactctttggagacaagggtccatggcctagagatggcattggatgagatatcacgtgacctagcagtttcttcagaaaggatgtcaagcagtgaaccccgtgtgaacacctgttgcattctgagcccaaaattctggagaaggcatgatggtgttagaaactcctccagattttctgcctccagtgttccaaacagctcggaggggagcagaacttcttacaagtgggaaaggcagaaatttggagttcagggtggatttgtcaccaacccgttagcc

SEQ ID NO: 4790 - DNA, 547 bp, Hordeum vulgare
ggccagccagctgtttattatccaaaacttatacatccataagttccttacggtgatacattgtgactgaattcttacaccgaaatagccgttccggagtagggcaagtagtctggagtggaacggaaataagacaacagtcgttctcatctcatgccccacctcctcggagacaggttttggttaatagaggagcttcagccactgtatcttcaaccccaagtgaggatgcagctcaagaagccgagttctacttcagacataatgcccagctcagtgactttgacattgcaagcaggatctctgtgattcatgtacgccacatgctttgagctgcgatagaggagaaaaaaccctccaaaagtcgcagcagaagatggaaattttacctgcctcgatggttatatgctctaactggagcggttcatacatcaaacgaaatatcttcatctcacctaaccaacccttgacttctgtaaagccaaatccttccttctgccttcttgagtaaccgcagttctcccaacagaagaaatatttggctcgg

SEQ ID NO: 4791 - DNA, 542 bp, Hordeum vulgare
gtcccccggctgcagaattcggacgaggaaattaggctcaatggctctgaggctgtgggcgagctcagctgccaatgccctcaagatttcaagcagcggcgccagggccgctgcccccgcctactcgatctccagatacttctccactgttattgatggcttgaagtacacttcctcccacgagtgggtcaagaacgacggctccgtggccacgattggcatcagtgaccacgcccagggccatctcggggaggtggtgttcgtggagctgccggaggccggcacgaaggtgagccagggcggagccttcggcaacgtggagagtgtgaaggccaccagcgacgtcaactcgcccatctccggcgaggtcgtcgaggtcaactcgaagctgtccgaggcccccggcctgatcaactcgagcccgtacgaggaggggtggatgatcaaggtgaagccgagcagccccgcggagctggagggcctgctggactcggccaagtacaccaagcactgcgaggaggaggacgcccactagggtttct

SEQ ID NO: 4792 - DNA, 552 bp, Hordeum vulgare
aataattttaaactattttgatttttttttatatgaagtgcatatacaacctgcaagaaccaaagtgcatttccctgcacatgcttctcttttgtcatggttactgaaatggtataacaagccggtggatctgtgcgtggctcgcgcaccatgtacacaaacacaagaaaaactggaaccgatgaactgaacgcatggtaaagctggtttaattattgtagataagagtagtcgacatggttgcaacaaaaggaatgataagcgagcaagaaaccctagtgggcgtcctcctcctcgcagtgcttggtgtacttggccgagtccagcaggccctccagctccgcggggctgctcggcttcaccttgatcatccacccctcctcgtacgggctcgagttgatcaggccgggggcctcggacagcttcgagttgacctcgacgacctcgccggagatgggcgagttgacgtcgctggtggccttcacactctccacgttgccgaaggctccgccctggctcaccttcgtgccggcctccggcagctccacgaac

SEQ ID NO: 4793 - DNA, 552 bp, Hordeum vulgare
gtacccccgggcctgcaggcaattcggcacgagggtcgtctggaacctgcgggccggctcctcgtcgcggatgctcttcgacgtcggcaacctcccaaagcacgacggcgacgaccaagatataagagatgatatggctgatgaattatctccatcagcacaaattgattatgacagacttctgggaggccttctgatcgagggatttgatgaaagatcatgtcgcagcaggtaccagtttgcacgttatcagaggaatgcagcaagagtaccttctccatacctcatagaaagattaaggagacaagaagcactacagaagaagtgtggtccaggtaccaaatcatacaacaatgctgcaaaacagctcatgtccactcagagcatcaacggcacatcggattgcaactatctcttcctgataatccatgccgggatggggaaccggatgcttgagatcacttcagcgttcctttacgcgcttctgacaggcagggttttgctcgtggaccgctacaagcagattgcgagtactttctgtgagcctttccc

SEQ ID NO: 4794 - DNA, 502 bp, Hordeum vulgare
tatctacagttatgatcaaatgcatgagggtaaaaaaataaaattacatctgtggaacaccttttcctgtaaattaaaaagaagcctaccctatttttgtagtagcaaacaattgcgttaccgtgtgattgtgaagaggaaaaaacttacagctacaaccgagtttcatttacaatcttgagcccccagctgacgtcctcgcagtgcctcacgtacggcaccaccttggccaggtctgcgtccctcttggccttacagtcgtagtagggggcctggtggaagcacggctcgatggacatggcgcggccgcacggcggctccggcacgacgtggttctccggcctgtacatgatccacggcgtcaggccggcgaggccctgggcgacgtacccgaaggtggagaacccgctggtgatgagcacgtcgctcatgctcagcaggtagatctccgccagcgccttcatgtcgtgcttcctgttcttcttcttctggtactcctcgt

SEQ ID NO: 4795 - DNA, 135 bp, Hordeum vulgare
tgtggattcccgaagagtgtttgtacttcagtgaatgaatgcatctgtcacgggataccagattctcgtccacttgaggatggcgatatcatcaacatcgatgttactgtctatctcaatggttaccatggtgat

SEQ ID NO: 4796 - DNA, 555 bp, Hordeum vulgare
gagtatcaataaagcaagcagaccttcatttttttttcctttctgccacaaatgcggcaaaacgtggctttcatcaaccccagaaccaccaactcaatcagaatccagacagtcaatcagaattcaggcctacccgcaacaaccaagggagctgatctgccctgcccgctcaccctataatcccaacaacaatgcaaaactttgtgtataatctatgcatcatcgacctactgacgaatcgagataaataaaaaagtgtagttttgcacttggagtttgattgggcgagtgtcgtcccagaaaaattgcaggttctgtcccagccatccagccttgcactcactgacatctctgttctccggccgggcttaacactgtgtcagtatttccacaccgtcttcagtgatcagtagcgtgtgctcaaactgtgctgacaggctcccatcctccgtcaccgccgtccagtcatcggaccatatgctcgagtttgtgctccctatggttagcatcggctctatggtaaatgtttggttcaaaatcatgcggcctttttca

SEQ ID NO: 4797 - DNA, 416 bp, Hordeum vulgare
ccgcttgcatccatccccatcgccgccggcgcttcctcccgggcctccttcccctcacgcacagcgtacgatggcggccatgaaggtggtgaggaacctcgacctggagcggtacatgggcaggtggtacgagatcgcgtgcttcccgtccaggttccagcccaaggacggcgccaacacgcgcgccacctacacgctcggcccggacggcgccgtcaaggtgctcaacgagacctggaccggcggccgccgggggcacatcgagggcaccgccttccgcgccgacgacgccggcgacgaggccaagctcaaggtcaggttctacgtgccccccttcctccccgtcttccccgtcaccggcgactactgggtgctccacgtcgacgacgcctaccagtacgcgctcgtcggccagc

SEQ ID NO: 4798 - DNA, 352 bp, Hordeum vulgare
ttttttttttttttttttttttttggcccaaccctggcacgcaaattattccgcaaagtgtgttgtacattttgaacacgaacaagcaaacacacgggtaactaaacatcttcatattccctgcagccacgaacatagtactagactgaactgtacacggcacaccagctggtacgggagcgagcggcacccactttctttgtgctttggcatgggcaccaacctactttccaaagagggatttgatccaccacagcccgccgtccttgggggcatcctggctctccggcgtcggctccgggtgcggcgtcctcctgagcttgctcacgtcgtacccttcctccttggccct

SEQ ID NO: 4799 - DNA, 1936 bp, Hordeum vulgare
  UNSURE (1),(2),(7)..(14),(20)..(25),(28)..(30),(846),(1057),(1104),(1249),(1264),(1357),(1430),(1827): n stands for any base
nnttttnnnnnnnnaaaaannnnnnttnnnttattttgtgatctcatcttctttatacgcgggtggggtctttcttgggtattgttggtgttggttacataaagtttgttaccggtgagggtgcttatctcgtgccgctgtgataagccacctatggttctcatatgtttcctctatctctggtcagtcgattgtcccacatccacgcgtctgtattttgtaccgccatgacagttgtgtgttaccgtgttttctctataggttacggcccatgttactagtggtattatattactctgccaccaactgctcccaccccgctctgctgtgtcctccaacctatgtggatcagttttagatctttatcaggcttacagttcttgtatcatatgactgatactgaacgtcagatcccccggagttttcgtgttattctccgtcccgtatttgccatgtatcttgtccactctagttaatattacactgtccactcatcaccgataaacgtctttgtgtctctctgctcacgacggtatgaatgtttttttattttgtattcttgttgttatctcccctatagtgtttatttacccttccttcactcttattgtttctttttattttatcttccgtctttctgtttgtaatataggctcttttcggcatcattattcttttgttcttatattgtttcgtcctgatgtgttgttttatcggtggttggttcctgtttacttgtttattacacacgctcttagattttatgtttcgctcatatattattctaccctatgcgttgttgtcttggtcggcgtatcgttcagtcacttcttatatgttaactancagacaccgataccgtctcgcatgttgtacgatttgtttattagtttatttcatctgtctcttcactgtgcctttgtcgtctatgtctgttcgttcttgtcactttatattaatatatatgtgtttcgacgagcatacaacgtagcggtgttgatgtaatgatttcctggtgctattgtctggttggtctgctgtcttgtcctctacgcancacctcgctctttagatgcttgatcgtagtatctgtgttgtttccancttctacctctctctgtatttcgacgctcactcatcgtatgctgtgtcatgtcgtccgcgcgtctcgttggtaattttattcctttgtgtgtagacagaagaccaagcacacgtgtggtgttgtgtgtgttcttccaatctttgnatatgagcagctacngtatcttgtctagcgcctgcgagtgggattcctgatatacattctgttgtacacacgacgcgtgttcatatattacattgtatgactatctancccccgtcttttggttctacatatatattcgagataaagatgactcttcttcagctgtccctatgaattgagnattaatgtattgtgtcgccaccgattacctattttttatgtcattagtttattggccttctgctcctacacactcttccccctctaaatatacttcgtcttagtcacgggctttttgtcacgcgactaatctactgctagctcgtggtcgtatggtagcgactacagctaccgctttattattagatattttctaccttatgtaatatgtcgtattttatttttttcgttatgtagtttatcttcatcgatatcacttcgttgatcatttgctcctcttattatatatacgtcttatttccccgtttaacgatacttttgcttcgttatttcgtcttcatacatggctacgcgtgatctctcgtccgtgtaagacatgcctacgattgtcatgttcnccaacgagattgtcatagtcagttcgagtgtggagtatttgatgtgatactggttatccactcgctatcctctctcgactgactagcatcattttgtcactatctgttc

SEQ ID NO: 4800 - DNA, 539 bp, Hordeum vulgare
acacacccttatatttctctgattttaattcgttacaaggtacgtaattatttggtggtagctttacaggcaactccggatcatctagacacttgttacatcccatatatagcgcaccgtgatattatatcaggtccgcaattaatccagcgacccacgttcacggatactatatgcaccttgcagtgaatctatgagttgacgacgttgcatttgttcctgatctggccgctggcgccggtgaggacgtcgatctggcccatgcgcttgatggagttcttgaagtggtcgaagaagacgccgttgtcctgcagcttgtcgacgagcgcggcggcgcggccgttggtgagcagcgtggcgtcggaggtgaacatcccctgccgcgccttgaggttgacgaagtagtggctgtcgaaggaggtgctgctgccggggtccatgggcaccaccgtcgtgttgtcgttcgggtcctgcaggttacgcctgcactgcccctggaggaacttggcgtagggtgggttgagggaggggtcgatgtc

SEQ ID NO: 4801 - DNA, 1338 bp, Hordeum vulgare
  UNSURE (1)..(3),(28),(29),(39),(45),(72)..(77),(99),(100),(1040): n stands for any base
nnnttggccaatgccacacgtagaggcnncaccagtagntggggncccacacacagaaaaagtttgttcttnnnnnnccaccccccccccaaaaacacnnttgccgtgtattcctttctatattggggggggggtcgacccccacccaaccacagaaacggccgccctccttttcaatcatctttcattatctctgcgtcgtggctgtgttttttcttatctaaaaacaaatattttatcccccctccttttccttataaatatctccatttttcctccttccgctcaatcaccacctacccaaccttgaccagcgcccctcctcccctacttttttttaccatttttcttcttgtaggttttctttacatccacgtcctttcctacctccttctctcttttactttctccttattagtagtgaatccgcccatcccgcacctctcacggccctctttattattagcttgtctggtccacccccgttctctactcctctttccttacctccttttatataccaatcaatcaatcccgctgatttcgtcctcctccgtaccagtgtgaattgccattgtcgtattaaagatctacgcccacccagccgatcactatctatttctgtcaatttaccctatatttgtctcactcttctaccgtagccctatgtttcccgtttgcgctgtacgacggtttttttacgcgttctcttttcttctgcatctcgcgccatcctctgctatatatcctctctctcttctcctccattatctctattctactacgtcgcatacatattacgatatacgccaccctctctgccacgcccctattatccacacttttacgcttctcattcatcccgccactctccatccacttaatttgttccccgcccttttgtgtttctcctccccctccattccgctatttcgctactttctcccccactgttctcacctccatatttacacaacttcctctttttacctccaccttcacacctgttcccgcccctttcttcttccgccccacctcantaactccttctactcacccctacatatttctattttctccaaagcctattatccattcttttccacccattaccactataatcccatatttccaattctttctcccaccatccccatatcacccttcctcctccatcctttctctcccttctcctctttattctctctttctcctaatcctcgtctccacttacttctctttttccttccacccccatacctatacaatatccccatttacaaacttatctctttttttacataatttatccacctatctctttttatcacatatact

SEQ ID NO: 4802 - DNA, 461 bp, Hordeum vulgare
agttagtactacctacttgggcagactgtcaccccctctgtccaggctgaaaggcataatgagaccgtgtatccggtaaacattcgtgttcttcactcggccttgatctttcagctcgctttagtcgtctcttacgatacctccatgcgacttggatgcgcgctgcagcgatggtcctccagtagggtgattcatacctgattgccccctgcactcttggattgcgcaagaaccgtgcaaattgtgcagtaacttgttcaagatcacttgctctaagtacaaaagcttcaacattcgttaagcatcgcacagtacgtatagcaaccaaacgcataccatgaaatctacttttcccgccatctttattcgttgaagagtgttccaagtaccatgtgaggagttcctctccacatacatctccatcttgtaatggagccctgcttccatctgcactgatgctt

SEQ ID NO: 4803 - DNA, 517 bp, Hordeum vulgare
cgccgcagcgcaaatcggcagcttcctctccaagaagccctacgcgccgccgtcctgggcctcgcacctcgccctcgcccctccccacaccttctccctcggccatttcccaaccccgattcacaagtggaacctgccaaatctgccggagggcactgaagtatggatcaagcgggatgatctgtccggtatgcagctgagcgggaacaaggtccggaagctcgagtttctgctgtcagatgccgtcgcgcagggtgcagactgcgttatcactgtcggtggtatccagagcaaccattgccgtgcgacggcagtggctgccaagtatctcaatcttgactgctatttgatactgcgtacttccaagcttcttgtggatgaggaccctggtttggtcggcaatctccttgttgagagactgctgggagcacacattgatcttgtctcaaaagaagagtatgggaaaattggcagtgtggctttagccgacttgcttaaaaagaggcttttggaagaa

SEQ ID NO: 4804 - DNA, 550 bp, Hordeum vulgare
tctactagttctttctggaattacaagactgtatattatataactaaacacagagattacatagaacaaaaaagaaacagaaggcatttaaataagaaatacagatagctttattttcaaatggcagaaagatgcacttcactcttgtatatcaacaatttcactccacgctagccgtctattctgaattttctttcacaaacgtaagagcatatactcttaagaataatgacatttctggaactccaacgcataatggaagcggtttctggagcatagcaatcaaaacatcttaccagtgccatctttgcgcgggactgattcttcaagatccattctgcgccagctcccagccaaagatgacatctgatcaaccttgtcatacaacccaagaagaccgcctgtgtggacaaagaggactttccgcccattccacttggaaggattagcagccatgtctttcagcattgcatatgctcccttcccactgtagactggatcaagcacaatgcctgttgctgcagctatatctttaacaaacttaagctcc

SEQ ID NO: 4805 - DNA, 552 bp, Hordeum vulgare
gtctccccgggcctgcaggaaattcggcacgaggggaggaagatgggtgagggcggaggcggcctacttctgggacgcgtcggtgccggtggagatgggcgagatccacagcatggaggccctcgacgccgcgctcgcctcctccgtcgaccacaaccagcccatcatcatcgactggatggccagctggtgccggaaatgcatctacctcaagcccaagctggagaagatagcaggagaattcccaggagtcaggttttactttgtggatgtcaataaagttccacaggccgtggtgaaaagaggcaacataagtaaaatgcctactattcagttatggaaggatggagaatggaaggaggaagtcattggaggccataaggcgtggctggtgatggatgaggttagagaaatgatccagaagtacaagtgactgattacatatactactgtatatagagatttgagatgatctcctaggacactgtaaactcaccaatggagttgtatatttctgctcatcaatgcaggagtactacattgaacacttca

SEQ ID NO: 4806 - DNA, 507 bp, Hordeum vulgare
tgtagtacctcctgcattgatgagcagaaatatacaactccattggtgagtttacagtgtcctaggagatcatctcaaatctctatatacagtagtatatgtaatcagtcacttgtacttctggatcatttctctaacctcatccatcaccagccacgccttatggcctccaatgacttcctccttccattctccatccttccataactgaatagtaggcattttacttatgttgcctcttttcaccacggcctgtggaactttattgacatccacaaagtaaaacctgactcctgggaattctcctgctatcttctccagcttgggcttgaggtagatgcatttccggcaccagctggccatccagtcgatgatgatgggctggttgtggtcgacggaggaggcgagcgcggcgtcgagggcctccatgctgtggatctcgcccatctccaccggcaccgacgcgtcccagaagtaggccgcctccgccctcacccatcttcctcc

SEQ ID NO: 4807 - DNA, 1074 bp, Hordeum vulgare
  UNSURE (1)..(6),(15)..(18),(23),(26),(28),(29),(32),(33),(36),(37),(44),(45),(50),(54),(55),(60),(78),(98),(101),(111),(118),(120),(121),(124),(127),(131),(132),(135): n stands for any base
nnnnnnttggcaaannnntgagnacnanntgnnggnnacaccannacgantggnnggaancatgctgatcgcaagggngccgccgcctttgggggcgncgnctccgacatnggccgtngnnttnctnctgnngtncagccgcatccactcctcccatacctggtgcctccttcgcatccaagttcagcccctctggccaccgcttgaagatctgcgtccggccaccaagatccaacctccaccttctctcggcttccgctgctgcgggggcgatccctggtgatcttttttttccccccggacatacccagtcattttagacgggcgggcgaggccaatacacccgctctccaccagcgttttgttccccttacacccaccatacccgcgaggaggcgaggaaagaacacgccccgcccgcctgagacgccgtgcgagtgcagcaggggtgcgagcgtagggggggcggcattagggccgcttgtgataggttgtatgttgtggtgtacgagcgcggtggagagtgaaagtagggcgagcgcgttgacgttggattggtatgtcccgttgtctttcccgggtctgtgtggaggtggtgggtgcgcggggaggggagggggagcgggaagctgtgcgggcggcgggcaggatcgtgcgttcgcccgcgccttatggcctagttatcttcgccgcgcggcccttgatcggaatctgcctggataaattcttaaatttcttgccgcgtgttcctcgacggcgccgccttgaggaagttgcgcgttcccggtagccgcgagttccgccttttggtagtggagctacgcacgggagggttagagttcggttcttacgtagtgcgaccgcgggtgtgcgccgcccgttagtatcgttgcggagcacactggttggcacgtgtgggtcttggcgcgcgctgccgctattttttccgccttgcccccaccataatacccgcaccacaatgcctggtgaggcctatgataaagcgctgattctcttaggcagtttccggctgtaatccgctgcgcgtcaagtcgccgtcgcaaggtaccgcgt

SEQ ID NO: 4808 - DNA, 548 bp, Hordeum vulgare
ggaagcatgacatattttcagcccgcaaaaaactgtgttgggatatcctcctaatgccgacataagctaaccaaaattacacaattttcatcagtcaatcgaaacaggttcggttttcccatttcatgcagctatctactaaacctagttatgaaactggagcccgcggtccaaactattttcttcctccacttggcttcgctgcgtctgaattaaccatacggctaatgttctcttctgctatcattcttttgagctcaatgattctagattcggcatcctttattgtcttcactgcttcaatatattggcattctcggtcaccgccttgcgattcaagtggacaagcccatctcaaatagaattcaggccaaagggtgggagcaagcgccggagatggtgggataatgggtccattatgtttgcttggtttatagaagggatttctgtgctcatgaaagatgccgccggaagcccggaggtcagccaagtacttccaaatgcaaggacaagagctctcgacttcagcttgctccctttcccattca

SEQ ID NO: 4809 - DNA, 516 bp, Hordeum vulgare
tcgcacgaggctcctcagcccacccgctcagccaggacctgggcagcccgagacgctcaactaccgcgtcttcctcatcgacggcggcggccgcaaggtgtccccgtggcacgacgtgccgctccgcgccggggacggggcgttccacttcatcgtggagatccccaaggagagcagcgccaagatggaggtcgccaccgacgaggcctacactcccatcaagcaggacaccaagaagggcaacctccgttactacccgtacaacatcaactggaactatgggttacttccccagacatgggaggatccgacagctgcaaatgctgatgttgaaggagcacttggagacaatgatccagttgatgttgtcgagattggtgaaagacgggccaatattggggatgttcttagggtgaaaccattggcagctttagcgatgattgacgaaggagagcttgactggaaaattgtggccatttctttggacgatcccaaagcatctcttgtgaatgatgt

SEQ ID NO: 4810 - DNA, 553 bp, Hordeum vulgare
ttgtgaaaaacttggcttaggaaatccttattcgcgccaccagattgattattcaatcattatttcctgttttaacaggtacacggaatgttttgcagatgaagaagcatggtcataggtaggtgtcacaaaagagcagcacacttatgggtatgtcactgaaagaatgtgtcgtcggcttctcatggggcctatgaaaggctactaggctagcgagagctctcccgccgggattttcctcttcaccaatttctcccatgactcgttggtttcctctatcaccttcagggcatattccttgcttgtgggcttgtcgcccaagccgaatctgttggcgggcttcccgtctgggatcttgtagtctctgaaccagtctctgattgcagtcaacgttcccggaaaatgctcctcgacatcatctacatcattcacaagagatgctttgggatcgtccaaagaaatggccacaattttccagtcaagctctccttcgtcaatcatcgctaaagctgccaatggtttcaccctaagaacatccccaatattggcccgt

SEQ ID NO: 4811 - DNA, 407 bp, Hordeum vulgare
ggctgtctcggtctctctgtctgttcctctatctcactctcccctgcctctccatctctcttgaggcagacactcaaacgcacacacagaggggctactaagctgctatcggttttgactggatttgagctcccttgaccaaaagataccagctgcaggaactttctatggaggtagaagctatggcggactctactgtcaaggttcaaaatggcgaaacagccagaacacacttgcatatgctgatgtagaattgcaatcactggtttgtggttgggcgctggcatcttcgatagtgacacggcgatagactgccttggaggcgaaagagctagttgaggaattgagagacctgggaactccaacaaggatttaagcaatgtatgggctccgccgagggcaactcc

SEQ ID NO: 4812 - DNA, 359 bp, Hordeum vulgare
tttttttttttttttttcaggatatgtcaaatttctcattcatagtttgatcactcttacacttgtttacaacttccattatatacctagaagaatccatctggcatcaaaccaactgttgcagcaatgcagcatcagatcagcaattcaactgccgctatgacaaaccgacagtacattttctgaagtagtgtactcccaaaagtgactactacctcttacaaataacgagactatggttacttcaaagtatcaagctttgaaagaactcgtgctctaatccaaggctgacaatgcctaatcctagacgaacacagccccatgctgtttggagagcttgaaagaactttgtcagcttt

SEQ ID NO: 4813 - DNA, 903 bp, Hordeum vulgare
  UNSURE (11)..(13),(27),(29),(100),(210),(558): n stands for any base
ctggaataggnnnagaataactatctngngctcgtgcgaagggttctcggttccaggtaattctcttattactacttgcggggggtctaaaaaaaacccnaagcgtatcagtaagaatcgactccatgttgatattcagtagcgataatgccttgctgtgtcggtagccgtgctgcgctgagtcttcccggtggcacagcgagcaatctntgagcaggaatcatcttgtgattgatggctcgctcattacgattgtgtcggggggcagcagagatggcatgttcgacgtttggcttcggttgacgtgcgcgagtggggcgcacatcgcttgacacgctcgcctctccatgcgatatcgcgcgatgcgtgcgtagctctgagcgtggaacaaaccgagtcaacgctcatagacgattttaaactcgtgtaatgatggggaactcgaagctacaaatatggcagcggtgcgggtagatcgaggtagagcgtgacgcgtagtacggaggcactgcgcagcgccgcgatttctcgctatgactctcgaggctgactatcaanatgcagtaaataagccgcaggtcaacgtcgacggtaatgatgttttctcgttctggtccgagacgaaacattaggatggaacgctgagaagcatcaagaacatgatgagttggacggaggagacggtggttgtacacagtagtacagtaggtcgataatgagacgacttagaccttgagtctgacatgtcggacgttatattgcgctcttcctctgcatataacaacatgttagagggtggatagtcttcgtgcattcattggcgtggtaccagctagcgtcgtggcgccgcggtgtattgaagactgtgcgttgagtgtcgttgtttcgtgttgtaggcgaact

SEQ ID NO: 4814 - DNA, 349 bp, Hordeum vulgare
gggccctcaaagagaatagatagaaatgtagttccaatggtagtctaacaacaccacatggttaaacagatcttacatacaaacgctctctactgacatggaacagctagaacctataagatcgccggcagtctactggcctaggagtctgaactctcgagcatcggatcagtggctgctctacaggcgcaactcctgggcgattctgaaattcacctactatatgtatataaaccgcgcacgtcgaaagtagtttgttctagttacgggtcttcagcttaccaaggacccgttagcgtcctccgcaggcagatcctcttcgacgtaggcccagcttgccggctaacct

SEQ ID NO: 4815 - DNA, 547 bp, Hordeum vulgare
  UNSURE (31),(39): n stands for any base
gtacccccgggcctgcagggaattcgcacgngggctcgnactaccttgcaacactcgagcccctgaattgacacaagaagcatggaaccttgccaatgatagcttgcggacaactctttgtgtacggtttaagagtgaagtagtagcatgcggagttgtgtatgctgcagctaggaggcaccgggtccccctcccagaagagcctccttggtggacagtctttgatgctgatgaggcagcaattcaggaagtttgcagaattcttgctcacctgcacagcctcccaaaggcacagtatataccagtgtataaagataatgattccttcagtgttagaagggccttggatacacacgcgtctaaggagagtccagcaagtgctgttgctagtgataggggtactcctgtaccttcgagttctagccaggagaagaattcactgaccaaggcaggacgagagaaagtgaaggaaaacagtgataccaaggataagccgttgcctgctgagctaaatggaaaaggaggccaggcagcaaattcgaagagt

SEQ ID NO: 4816 - DNA, 502 bp, Hordeum vulgare
  UNSURE (22): n stands for any base
acatatcccatattagtccggnaaacaaattacaacaatatcaatgcatatcagcctaggaagctgcaaccaaaacaacacgaaagtttttcatgtgcccccaggccacaagaaaccaggttatcatgctgtgacaatcactcactgtcaaaagcccttcatgtcaaaagtggcaggcacggatgtactcgggagacacctgtctttgttccctctgataaactacaggtaaattattgacaagcgctctgtttctctgttgcaaagtgataaagattggtctgatttgttaatggaataggtagtgtaacaccagatgaaaccagatccttctcacgctccgtcaggaccttcgtgctctctctgcggatgttcttacaacacggaagctcagctggatcaatggcgcctgtgccgatgatctttgtctccagatgagtagtagccggcacggtcacgtgacgagcggtgccttgatttctccttgtccgagtatcctgaa

SEQ ID NO: 4817 - DNA, 378 bp, Hordeum vulgare
caaatgagaactttgaaggccgaagaggagaaaggttccatgtgaacggcacttgcacatgggtaagccgatcctaagggacggggtaaccccggcagatagcgcgatcacgcgcatcccccgaaagggaatcgggttaagatttcccgagccgggatgtggcggttgacggcgacgttaggaagtccggagacgccggcgggggcctcgggaagagttatcttttctgcttaacggcctgccaaccctggaaacggttcagccggaggtagggtccagtggccggaagagcaccgcacgtcgcgcggtgtccggtgcgcccccggcggcccatgaaaatccggaggaccgagtaccgttcacgcccggtcgtactca

SEQ ID NO: 4818 - DNA, 363 bp, Hordeum vulgare
ttttttttttttttttttttttgaaccaaacttagaatgacgtacactaggctgttaccatcagaatttgacagtacagtggcagcaaagaacaaacccaactctgaacagaacagggttctaaacaaagaacaaacccaactctgagcagaagaggattctacacttaaatgtagactcgatcataggtgagaattaggtaccagtatttgtgttgcggttttcaactgcttgggtgagtgatgtactctacactccgtaatcaatcaggtaccggtatttgcggtatccaacaatttaacttggttcatgcttgcctcgtgcttactactttcctcccttatgacccgcttgaagtttcca

SEQ ID NO: 4819 - DNA, 517 bp, Hordeum vulgare
caagaccctaatttaccttgcagggtcagcttctgccgaggtaattgctgacatcgctctgtgcccctttgaagctgtcaaggtccgtgtgcagacacagcctggatttgcccgtggcttgagtgatgggcttcccaagttcatcaaagccgagggtgctgctgggctttacaagggcatcgttccgctctggggtcgccagattccttataccatgatgaagtttgcgtccttcgaaactattgttgagcttatctacaaacacgctgttcctgttccgaaggccgagtgcagcaagtcttcccagttgggtatcagctttgctggtggctacattgccggtgttttctgtgctattgtttctcatccggctgacaaccttgtctcgttcctcaacaatgccaagggtgctacagtgggcgatgctgttaagaagattggcatgttgggccttttcaccagagggctcccccttcgtatcgtcatgattggtactcttactggtgctcagtgggga

SEQ ID NO: 4820 - DNA, 546 bp, Hordeum vulgare
gggtaacaagatatatgggaatccctagtacaggtgatggcagaacctgcgctctaacagccttgctgtcctaaaacttattatgtcaagcatcaaactttcccggggggcaaaaaaaggcctatttcgcctgcttaatgagttcctctcatctgatagagacaataaccatctgctacaataacaaaagattttgggtgctaaacaagtaactgatacagtcccatccaccaataaccacaaccaggaatacatcgtcatagcagcaaaaatcaatcaagctgattcctctaccggagcaactggtggagcaccgccggtggtcgggagtcccaccataactttaaacgcatcatagattccccactgagcaccagtaagagtaccaatcatgacgatacgaagggggagccctctggtgaaaaggcccaacatgccaatcttcttaacagcatcgcccactgtagcacccttggcattgttgaggaacgagacaaggttgtcagccggatgagaaacaatagcacagaaaacaccggcaatgta

SEQ ID NO: 4821 - DNA, 517 bp, Hordeum vulgare
gatgttttgatgaaaaacatgccgtgttattacttcaaaagtgacgggatcaatgggatatgatttgctagaagtttttctcagtggaataatcacattcagatcagacatatacaatcttagtctatatatcaataatcatggagatattgatggggacgaagaggtattttgaagttgattacgtatgaatttttatcacccttcaaagataaaagatactcaaaatttggaggaatagattggactggacagatcactggaaggcagacaactggaacaagtacgaatttgctccgagtgatggagtgcattgacaccgagtcagcaaggaaaccaagtcattagcatatgagcaagagaagagaaagaaaaagagaacccaagcacaacaagaatcgtgtgggcttcacggtacttggtaacgattgagaagcgacgagcaaagaacgcggacactaccgctacagtaaacagaaactgtgggtacagcgcgacactattttagagaacagtc

SEQ ID NO: 4822 - DNA, 536 bp, Hordeum vulgare
agtatactttttacaaatgttaacactccaaagagagcctggtcagtgccatgaaacatgagagcaagcgcaaaggctgaatttaacatattagaataagtaaacaagggcatgagaaactagaacacactgagagcttccctgttttgtccctgcttccagtatgtgctttgaaccatgtgacgggttttgcagagatgaaaatgaatgaaacaaacgaacagactgttctctaaaatagtgtcgcgctgtacccacagtttctgtttactgtagcggtagtgtccgcgttctttgctcgtcgcttctcaatcgttaccaagtaccgtgaagcccacacgattcttgttgtgcttgggttctctttttctttctcttctcttgctcatatgctaatgacttggtttccttgctgactcggtgtcaatgcactccatcactcggagcaaattcgtacttgttccagttgtctgccttccagtgatctgtccagtccaatctattcctccaaattttgagtatcttttatctttgaa

SEQ ID NO: 4823 - DNA, 518 bp, Hordeum vulgare
cctcgtgccgaattcggcacgagggctgcgcgctaagttagaggcccagaacaaactcaccaaaaacagaaagccctacctccatgagtctcgtcatcttcacgcaatgaagcgagcaagaggctccggtggacgtttcctcaattccaaacagctccaacagcagcagcagtctggcagtgcctgcacgaaggccattgcggatggcgcaaattccttgggctcaacctatctacggctgggtagtggcgcagccggagatcgacccacctcggcatccaagacgatatcctcgcaggagaacaacaagagagtggccgcaccggctcccgccttcaccatgattcctgcggcgcagaaagacgacgacttcttccaccatcacggtcaccatgtcagcttctctggccactttggccagtcaagcgagcggtatacgtaataacgggtctttggtgacccggtgtggtctgatgatcaggcaactcatccttggctttatttctggcgtgttagga

SEQ ID NO: 4824 - DNA, 550 bp, Hordeum vulgare
  UNSURE (41): n stands for any base
gttccgcaacaaattttcatgtaaaccataaaacttttgtntcaacacacaccattacaccaacatttgcatactgaacataaagcccagaattatgggctgcaaagcagtacaacagtagtactatgagatacactatctctgaagtcctaacacgccagaaataaagccaaggatgagttgcctgatcatcagaccacaccgggtcaccaaagacccgttattacgtataccgctcgcttgactggccaaagtggccagagaagctgacatggtgaccgtgatggtggaagaagtcgtcgtctttctgcgccgcaggaatcatggtgaaggcgggagccggtgcggccactctcttgttgttctcctgcgaggatatcgtcttggatgccgaggtgggtcgatctccggctgcgccactacccagccgtagataggttgagcccaaggaatttgcgccatccgcaatggccttcgtgcaggcactgccagactgctgctgctgttggagctgtttggaattgaggaaacgtccaccggagcctcttgc

SEQ ID NO: 4825 - DNA, 521 bp, Hordeum vulgare
gggatttattccccaaatccaccgtcgccaaggccagccgagcgccgacgctagaaggaggagccgcgctggagggcttctttccttcacgcgccggaaggcgtcaccatgccgtgcaccggccgttggccgctgccaccgctgtgcgttaggcggcaagcgccgcgcttggagcagcctggccgaaggatgcagccacggtgtagccgtcccgcgaggaacttagccgaggaggcgtcttccgggccatgggtcgtcattggagcttgccttggacaacattgatacgccgtcctggagggatgcatgatcttctttgccgtgaagatggaggggctgttgagaccgccggagatgctgcctcgattcttgctcggatggtaccattcatggcttgacgctgaagattccgtagccggacgaccgccacgctccggtcgtattgccaccagatgcgagagatagcctcgacgcctcgctgctgttaggctgcctccccgtcgctttcttcttgtgttggg

SEQ ID NO: 4826 - DNA, 548 bp, Hordeum vulgare
tgggtataatacccaacattcataatgagaagactgttattttaatcattcgctctctctctcttttacttttacttttaacacgttatcagcacgctcgtatgcgagagcgttttggccaacccaacacaagaagaaagcgacggggaggcagcctaacagcagcgaggcgtcgaggctatctctcgcatctggtggcaatacgaccggagcgtggcggtcgtccggctacggaatcttcagcgtcaagccatgaatggtaccatccgagcaagaatcgaggcagcatctccggcggtctcaacagcccctccatcttcacggcaaagaagatcatgcatccctccaggacggcgtatcaatgttgtccaaggcaagctccaatgacgacccatggcccggaagacgcctcctcggctaagttcctcgcgggacggctacaccgtggctgcatccttcggccaggctgctccaagcgcggcgcttgccgcctaacgcacagcggtggcagcggccaacggccggtgcacggcatggtgacgccttcc

SEQ ID NO: 4827 - DNA, 521 bp, Hordeum vulgare
ggtccacttcgactgccatgaatcactaatgcgcaccgtggagatcctaatgccgccgagatatctctaaagataggaagagtcagcgaatgcggaattgatgacagcatggataaagtaggaccaaaggttttaatccttggagctggaagagtttgtcggccggctgctgagtttctaacatcttaccaaaacatcgaccaagtacatgttgttgtggcatctctgtatcaaaaagatgcagaagagacagttgacggaataaagaatgcaacagcagctcagctcgatgtttcagatactgaaagtctttcgaatcttgtttcacaggttgatgtcgtagtcagcttgctgcctgctagttttcatgctgccattgcaagagtatgcatagagctcaagaagcacttggtcacagcaagctatgttgatgattccatgtcaaagttggagcaagctgcgcaaggagcaggtgtaactatactctgtgaaatgggccttgatcctggcatagatcacat

SEQ ID NO: 4828 - DNA, 546 bp, Hordeum vulgare
cggcgacaggattcggtatatatatacacaatagatagaccatacatacatcagttattatttacttacaacagcgagaatcatcattttatttactcgctgcctctgttgcagcagcatatatatatatactcggtggactctcatgatctcatcccatgctgacatcctcaggtctgcactctctcgatcagcttgatgcccgacgcatccaagatctccagcgcagggatgtagatctccggttgcagaggccggatcacgcctttcctctgaaccttgttctggagcaagagcagggctcctatcgctgccggtaccccgacggtgagggccatggcggtggttgacctgccgttctcggtctttccgaactccagcagcgttgcttggtgcttctcggtgggtcgcccgtcggggtactccacctccacttcatggtggagcagtaccatatcctgctcattgtggccataggccattctctgttccattcgttggcaaataacactgaatgcacttgaacaatccttaggaatctctgtc

SEQ ID NO: 4829 - DNA, 434 bp, Hordeum vulgare
tattggcactgagacagaaatgcaaatgattcgcacccacctaggtgatgtccaggtagagactgatatgcacatgagagatttggtggagagaatcagattaatggaggcggacatacgggctggtgaggcagtgatgaaggaacttcaccaagtgcatatggaggcaaagcgacttattgctgaaaggcagaggcttactaatgatgtagaggctgcgactaaagaactacagaagtactctggtgacaatagtaaccttgctgaattggttgcggagctagatggtctacggaaagagcatcatggtctaagatctgccttcgagtatgagaaaaacacaaacatcaagcaagttgagcagatgcggaccatggaaatgaacttgataaccatgactaaagaggcggacaagttacgagctgatttggcaa

SEQ ID NO: 4830 - DNA, 385 bp, Hordeum vulgare
ttttttttttttttttttaattctaacatccctgatattagccaacagttacgtctatatcagttcaaccatccagcaaaacaagagatacaaatcaattcaagactccgaccataaactgcgactctcagcggccccatggtgtgcataaagctacagggagtgaatgaatgtacatgaaggaaatgagagccatgagaatttttggataaaattttgcgggcatacaggccatcttcaggttacgaccccggatttttcacctctgggctgctttggttgggtcatacgttgcaggataaggagctggcggtgcttgccccgcattggcagccccgctgcttgcctgaaccggtgcagcaggatatcccgtgctaccagccgc

SEQ ID NO: 4831 - DNA, 551 bp, Hordeum vulgare
  UNSURE (20): n stands for any base
gtctccccgggcctgcaggnaattcggcacgaggctctgctagtcctgcccacagtatggctgcgagatcttcgagtgctatcatacctttcagcgggtggtgtgatagcaactcttgtggtttttatatctgtcgctttagtcggcactactgaaggtgtagggttccatcagaccggggaagcagtaaagtggagtggcatgccctttgctatcggtatttacggtttctgctactccgggcattcggtatttccgaatatctaccaatcaatgtctgatcgcacgaaattccctaaggcactctttatatgcttcgtaatttgcacagcaatatatggctcgtttgctattattggctatctgatgtttggtgacaagacaatgtcccaaataactttgaatcttccaaaagagtcatttgcctcaaaagttgctctgtggaccacggttatcaaccctttcaccaaatttgccttgttgttaaacccattggctcggagtttagaagagttgcgccctgaaggatttttgaacgaaacaattgtctc

SEQ ID NO: 4832 - DNA, 550 bp, Hordeum vulgare
  UNSURE (55): n stands for any base
gtacagtagtgcattgttgctagagatgctgtctttataaatcgactatactagngtcgaaggatgtacatagagcacggtaaaattcgatgatacacagcaaaaactcttggcaagagtgacggcgccgagagccgtctaagagattgccttggaagaatcagtagtatccgattatgctggccacagaggagtaggttccaagggcggcactgacgactccgacaactattatagcgacgcttgcaatcacctgcgtgcgtgtggctttattctgtgcgatcttcaagaagcacaaggcgggcattatgacagccacaagtatactgagcagggatccaatcagagccatcaccaaaccgaagaatggaagaagaaatgcaatgacaacagttgatgccacaaggctcgtcctcagtataatagagacaattgtttcgttcaaaaatccttcagggcgcaactcttctaaactccgagccaatgggtttaacaacaaggcaaatttggtgaaagggttgataaccgtggtccacagagcaacttttga

SEQ ID NO: 4833 - DNA, 496 bp, Hordeum vulgare
gaggctctcgccacgcagccgagccagacaccgccagcgcccgccgccgagaagacgccatggcgccggagccggaggacgacatcatggcggagaagaacccgcgccccctcgacgaggacgacatcgccctcctcaagacctacgggcttgggccatactccacgagcatcaagacggccgagaaggagatcaaggagttggccaagaggatcaatgacctttgtgggataaaggagtctgatactgggctagctccacctagccagtgggatctagtgtcagacaaacagatgatgcaggaggagcagccactgcaagtagcaaggtgcaccaagattataaaccctaataccgacgatgccaaatacatgatcaatgtaaaacaaattgcaaagtttgttgttggattgggtgataaagtttccccaactgatattgaggaagggatgagagtcggtgttgatcggaacaagtaccagattcagattccgtt

SEQ ID NO: 4834 - DNA, 551 bp, Hordeum vulgare
tacaaataaatgtatgcaattaaattctgattagcagacaagctgaaaactgtgtttcgacaaagctttatgaaaagctagagtgatttcactggggttcccagattacagtgacatacatgaaccgaaacaccaccgtgctgtttacaaccaacgagcacacagaaaggatgtgaaaaccaaagcactgctgctacggtatggatgcaaacatgcactgaaacaaaaggaagcctgcttgctcaattgtacaccatgtatttcggggttgcgctgaatttctgataccccttgataaccttgttgaccgagtcgaggaaatccttctccgtcacagtcttcctgcgggcacggatggcgtacatgccggcttctgtgcagacactcctgatgtccgcaccggtggcgttggggcagagtcgcgccagtagctcgaatcggatatcacgctcacagttcattgtgcgtgtatgtattttgaatatctgggtacggccttccaagtcaggtaagccaaattccacctttcggtccaggcgaccaggacgtag

SEQ ID NO: 4835 - DNA, 525 bp, Hordeum vulgare
gaggcaggtccggcgagaagaagggtggcatggagaacatgaaggagaagctccccggtggccacagtgaccaccagcataccactgagacctacgggcagcatcggcgcactggagtggccggcacggagacgcatggcaccacggccactggcggcacctacgggcagcaggcacagaccggcacgactggcgctggcacacacgggaccgacggcacgggcgagaagaagagcctcatggacaagatcaaggacaagctgcctggacaggactaagctggggccgcccgccccggctgcctctgaagaataagtaagatggcgaaggtccaccgtatgcacattgcacctagctcactttcggtggtggagcgagatgtatcttggcttaagttttcacggacaacagtgtggcaacagttttcgttcgtttacagtttgcatactgtgatgtgcagatttcctttacttcaatccgtgtatgtatgttatggcatctaatatatataagtggggtattacc

SEQ ID NO: 4836 - DNA, 519 bp, Hordeum vulgare
  UNSURE (27),(28): n stands for any base
ggtaatacccccacttatatatattanngatgcctaacatacatacacggattgaagtaaaggaaatctgcacatcacagtatgcaaactgtaaacgaacgaaaactgttgcccactgttgtccgtgaaaacttaagccaagatacattcgctccaccaacgaaagtgagctaggtgaatgtgcatacggtggaacttcgccatcttattattcttgagaggtagccggggcgggcggaccaagcttagtgctgtccaggcagcttgtccttgatcttgtccatgaggctcttcttctcgcccgtgccgtcggtgccgtgtgtgccagcgccagtcgtgccggtctgtgcctgctgcccgtaggtgccgccagtggccgtggtgccatgcgtctccgtgccggccactccagtgtgccgatgctgcccgtaggtctcagtggtatgctggtggtcactgtggccaccggggagcttctccttgatgttctccatgacacccttcttctcgccggacctg

SEQ ID NO: 4837 - DNA, 528 bp, Hordeum vulgare
ggaattcgtacgaggcttaaatctggacaactcgccgtggaaagcatccatggggtgatcttaaaccggattatcttgaaaagagaggttttgttgaagctcattcagacgacggtttgattgaaatatttggtctgaaagaaggctggcatgcttccttcgttatggctgagcttatcaaagcaaagcacatcgctcaggctgcagctatcaagttcgaaatgaggggaggcgagtgggatcgagcatatgttcaaatggacggcgagccatggaagcaaccactcatccaggatcagtcgacaattgtggaaataaacaaggttccctatcactcccggatgataaacggggattcatgagatttccctatgtcaatcagggttacactctagatcgatagtctatgtacagtttaggagcagctggagttagattcttagagatggctcgctcagctgcagcgaagatgtatgtttattgcccttcaccatgccatggtctgagtcatggcaggagcacaatgtg

SEQ ID NO: 4838 - DNA, 552 bp, Hordeum vulgare
ttaggttgttttcatacagacaaataataataataataatacaaataagcgtaatttgatttacctcgaaaggagctagggtacaacataacttacaggatacaatattacattacatggcggtgacacattgtgctcctgccatgactcagaccatggcatggtgaagggcaataaacatacatcttcgctgcagctgagcgagccatctctaagaatctaactccagctgctcctaaactgtacatagactatcgatctagagtgtaaccctgattgacatagggaaatctcatgaatccccgtttatcatccgggagtgatagggaaccttgtttatttccacaattgtcgactgatcctggatgagtggttgcttccatggctcgccgtccatttgaacatatgctcgatcccactcgcctcccctcatttcgaacttgatagctgcagcctgagcgatgtgctttgctttgataagctcagccataacgaaggaagcatgccagccttctttcagaccaaatatttcaatcaaaccgtcgtctgaat

SEQ ID NO: 4839 - DNA, 401 bp, Hordeum vulgare
caaccacgagctgcagagtaactgaggaagacaacacaccagatttctgaggcaaccaagatcaacaccacctgtgctgtgcaagatggagcacggccacgcgaccaaccgcgtcgacgagtacggtaacccggtggccggacatggcgtcggcaccggcatgggcgcgcacggcggcgtgggcaccggcgcggctgcaggtgggcatttccagcccacgagggaggagcacaaggccggagggatcctgcagcgctccggcagctcaagctccagctcgtctgaggatgacggcatgggcgggaggaggaagaagggcctcaaggacaagatcaaggagaagctccccggtggccacggtgatcagcagcagaccggtggcacctatgggcagcacggac

SEQ ID NO: 4840 - DNA, 407 bp, Hordeum vulgare
ttttttttttttttttgggcaaaatatattgtattatacatatataatataatcatacatatagtactaccaaaagaaaacacacactcgacgttcagagaacaaaacgtcccggcgggtacatacaagcaacccaaattcaagtccaccaaactcagaactcaggtattacaagtgagcaagctcactttatttgcggaagttttactgcatctccatcttattattctgcaaggtagccagaccggcacctcaagtttcaagtagctgccgcaggccgggctcagtgctgtccgggcagcttctccttgatcttgtccatgatgcccttcttctcgccagtcccgtcggtgccatgcgcccccgtgccggtcattccggtgtgtccttgctgcccataggtgccg

SEQ ID NO: 4841 - DNA, 439 bp, Hordeum vulgare
caaggatgaaggacctccagaaatgtccgagatatctgatgccataagagatggtgctgaaggattttttaggacacaatatggggctatttctaaaatggctggcatcctggcacttgttatccttttcatttatctctttcgcactaccaccccgcagcaggaggcatcaggcctaggaaggacaacatctgcatatattacagttattgcctttctccttggagctgtgtgttctggattagctggatatgttgggatgtgggtctccgtacgtgcaaacgttagggtttcaagtgctgctcgacggtctgcaagggaagcattgcagattgctgtccgtgcaggtggtttctcggccatcgtagttgttggcatggctgtatttggtgtggcattactctatgcaacattttatgtttggcttggagtagattca

SEQ ID NO: 4842 - DNA, 488 bp, Hordeum vulgare
gctgaaagtaaatctaaggatataaacaattaagagatctgtgcgtacaaggcatatgaattttcaagtccattctaatctctgtcacagcatatatatatattctccaacgtctgcatccttttgtccaaatagcaagggtaaaatacgggcaccatcaaaatgggcagcactgaacctctcctttcaatgtggcaaaacaatactaaaagcgaatcattacatcccattcacgttaatgcctcatctacaataaccatagatatttctctgcggggttaactgcgagctcaaccgatgattacaagaagatcggagccatgaccagtgtgatcgtggcgagcatcttgatgagaacatggatcgaaggccccgccgtgtctttgaatggatctccaaccgtatcaccagtaattgcagccttgtgagcctcgctgcctttaccaccaagtgcaccagtctcgatgtacttcttagcattatcccaa

SEQ ID NO: 4843 - DNA, 1084 bp, Hordeum vulgare
  UNSURE (728): n stands for any base
agtcctcaccggctgcaggaacattcgctcgagggatccaagaacttgtgaccgccgcgccgcgccgcgccgtcccccctattcttgccctcctaacccaacccctgctgattctttatttacgaccactcccggatcaaacattgctagtaccatggatggatggatcatggtcaagctttagcagcattcttgtcttgattctttttgcggcaatactaccttctacggtgcagaccccacggcgaagaaaaaaagacaaatcccggatcaaattctttccttttcttgccgccgttgacttgcgtccgcgactacgatagcttcgaagcgacacccctctctcaatcgtttatccttcccagttgccttctcttaccaactattagtctctcggtatcaaacgtgagaacgacttgtcggctctcccgttcccacaatttccccctttaccgttttgacttccgcttcgaagttctatcctagaaccgttctctttgtttcccacctctttaatttctcttttccctcgggctcttcccacccggtttgctccactattaactatcccgtttttgtaatacccactgcaccgcatggttacaaaatcgtacagatgtacctacctttcacccacttgactccccccctcgttctactcctttcctaacgaccttcctgttcactttcgatcttcccaccctttcgactcattcgttaggatctcntcgtgccctcacgcataatcgccctatcatcccacagcttccccctctgcgcacttccttccctccggcctacatacttacacccactcaacatcttgattttattgccccctttctttaccacgggccgcccactatagaccaccgtctcttgcgccgtctgatgctcccattcatcatagtccttattgctcccgttcatcaattctttataacgttccactctctccattttttcacttgcctgcacccgatcgtaacatatctcctttactactatatgtttcaactatgcgctacctcttccgtactatcgcacccttctcacgcctatcacgtgcctcaataacaacgct

SEQ ID NO: 4844 - DNA, 359 bp, Hordeum vulgare
  UNSURE (14): n stands for any base
gcttccactttgtnctttacagagtataaaaaatcgaaaaaataaacatgagaaaaggtttcgctccattgctttcgtcttcgtcggcgctcggcggcggcggcaaggaaaggaaagaattcgatccgggatttttctttttttcttcaccggagaacaccaccctaaaacgtagtattcccgcaaaaagaatcgagacaagaatgctgttaaagcttgacgatgatccatccatccatgggactaaaaatgtttgatccgggagtggtcggaaataaagaatcagcaggggttgggtgaggaggggaagaatagggggggcggcgcggcgcggcgcggcggtcacaagttcttggatc

SEQ ID NO: 4845 - DNA, 542 bp, Hordeum vulgare
  UNSURE (27),(44): n stands for any base
gtcccccggctgcagcaattcgcacgngggagccttgctctaanaagtatgccattcttcgtggcctctgccataaggtaggacttgagctagttaccaaagactacgacatggatacaccacatgcattcagaaagtctgatatcatcagtattgttcccatctacaagcatgttgcatgctcatcagcagatggtcgcaccctgttggagtcatccaagactttcctggacaaaggaaaacttgaggatgctgttaactacggcacaaaggctcttgcaaaactggttgctgtttgtggtccgtatcatagaatgaccgcaggagcatacagcctcttggcagtagtgctttatcatactggggacttcaaccaggcaactatctatcaacagaaggctttagatattaacgagagggaacttggacttgatcacccagatactatgaaaagctatggagatcttgctgttttctactatcgcctgcaacatacagaattggcactaaagtatgtcaaccgtgccctatatcttttgcac

SEQ ID NO: 4846 - DNA, 549 bp, Hordeum vulgare
aaatggatagtgtctatggattcttgtacaagcaaaattgtccaaaagcacggcctgattacagggacacttgatacaaacttcctgctcagggaagtgtcgattttctttacagcagtctaatttatcaaaattcagaagaaataactacagagatgtcaagtcggcagtgtgtccagtttatggataaaggaaataaaaatgccaagcaaaacgtgtttaccacctctctgatcttcccaagctcctttgcaatgacaaagcaaactgaaacaaggccaccatgatgacagttggacattctgaagatgttcaaagttccatggcaatgcaagcccttgcaataccgtagcaccactgagaggctgagaagaccatcttttcttagctcgcaacctgaacggccatgacttccccgtcgctgtaatcagcccaggacttcggcttttcagtcaagcttgaatcatcttgagcatcctttggggttgaagcgtcatctcgagcatctttcggggctgttgcgtcaacttcagcaccttcagaaactat

SEQ ID NO: 4847 - DNA, 517 bp, Hordeum vulgare
ctaagcttcatgaaaaccttcgagcgggcccacgccgagaacctcaggcaggctgaggcggagaagaagaaagcccagatggaggccgagagagagaaggcgaaggccgccgctgctcacaagaaggccgggtcgccggagccaggggtttccggccgaagctagacatgacagatttccactaatttcttaccatgtgaaagtggaggccaggaagacaaagctcggtgtaaaaaaaaggtaaagaaaagaaaagaaaagtcacaggcagtagtgcataccaatgtggcaatgtgattgataggtagacttgatatagcgacgcattttgcacatagccatgtagttcaccgctgctcactgtccatagggaagtaaaaaaggtcatacagttttgtactgttgctcgctgtccatagggaaagaagttcatacatacagtactacagttgttgtatattttggggggttcccctggcgacaaacaaattttgtaaatggttccttccatacgtga

SEQ ID NO: 4848 - DNA, 534 bp, Hordeum vulgare
  UNSURE (31): n stands for any base
gtaggttttttacgtatcggaagggaaccanttttacaaaattatgttatgtacgccaggaggaaccccccaaaatatacaacaactgtagtactgtatgtatgaacttctttccctatggacagcgagcaacagtacaaaactgtatgaccttttttacttccctatggacagtgagcagcggtgaactacatggctatgtgcaaaatgcgtcgctatatcaagtctacctatcaatcacattgccacattggtatgcactactgcctgtgacttttcttttcttttctttaccttttttttacaccgagctttgtcttcctggcctccactttcacatggtaagaaattagtggaaatctgtcatgtctagcttcggccggaaacccctggctccggcgacccggccttcttgtgagcagcggcggccttcgccttctctctctcggcctccatctgggctttcttcttctccgcctcagcctgcctgaggttctcggcgtgggcccgctcgaaggttttcatgaagcttag

SEQ ID NO: 4849 - DNA, 553 bp, Hordeum vulgare
gtacccccgggtctgcaggcaattcggcacgaggaagtcactgctgcatctgagttatcgggggagaagttctggagattgcccatggaggaaagctactgggagcagatgaagtctggtgtggctgacatggtcaataccggcggtcgacagggcggttccatcacagctgccctgttcctgaaacagtttgtcgacgagaaggttcagtggatgcacatcgacatggccggcccggtgtggaacgacaagaagcgtgccgcgaccgggttcggcgtgtccaccctggtggagtgggtcctcaagaactcatcatcatcatcatcgtgaatgaacttcccccctgatttccattggttctgataacggcgtcagagattcatcgtctgcaccagtgaatgaatggtttttatttgcttttggctggcgtaaggactgtggagcgatagaataaggaagggtttcatggaggaaaataaagcagcatgtcattgaacacttcccttgtcagattagactggcgtttcatttcatcgttttcatattgtgcccg

SEQ ID NO: 4850 - DNA, 556 bp, Hordeum vulgare
aaaaggttcagcagtgcttaaaagaaccacatacatagcataccaacaagcaaaattcaaagaggctgcaattgagggcaggctcgcattgcacgacacaacagaatatgacaacacacgccagtcacgggcacaatatgaaaacgatgaaatgaaacgccagtctaatctgacaagggaagtgttcaatgacatgctgctttattttcctccatgaaacccttccttattctatcgctccacagtccttacgccagccaaaagcaaataaaaaccattcattcactggtgcagacgatgaatctctgacgccgttatcagaaccaatggaaatcaggggggaagttcattcacgatgatgatgatgatgagttcttgaggacccactccaccagggtggacacgccgaacccggtcgcggcacgcttcttgtcgttccacaccgggccggccatgtcgatgtgcatccactgaaccttctcgtcgacaaactgtttcaggaacagggcagctgtgatggaaccgccctgtcgaccgccggtattgaccatgtcag

SEQ ID NO: 4851 - DNA, 519 bp, Hordeum vulgare
catggtcctgccttgatgaaaataaggcttttctatccactgccgattcggctgtgaaattgctcacagatgccaccaagccaatttcaggatggaaggggcttgagtatcgtgcagcatttcctctagataagcctcgtggcgcgaacttctatcctgctgacatggacaaaatggagtttgatttatggaaaagtggactgactgataaggaacaaaaagatgcaactggattctttactgtcataaaacggcctgacgctttattgactacatcagtagcacagtcagatggaccaaatcaaaccaatacttcagatgatctttttattgttccatattccaaggagtataaaacatcccttgagaaagctgccgagcttcttcttaaagcatcagattgttctgattgtccaagcctgaagaatttgctcaaaaccaaggcaaatgctttcctttcaaatgattactatgaatctgacatagcttggatggagttggactccaacatagatatca

SEQ ID NO: 4852 - DNA, 498 bp, Hordeum vulgare
ggacaaacctgtgtaccagcaaaagttcagcggcatactgatagtctctgttgctccttcccgagtgaatatgttcaaagattacagcaaacattgctttctaaaaacacctcggtaaatagacagtgatcctttacaagttcatccatttaggcagtgatgctaacaccatccttttaaaaggtcattcatttatttgtgttattttccatttgtgtcgctcaggatggtgcttcgtcttgtctcaacaatttctactttctcatataaaaatacaggttgtcgtttctcaggtacacggtaggtggcacaaaactttctgaatcgcgtcctctggtgcttaattgtttgcgagcagcttactggctgtgccaaatataggggctatatcaacgggcacctgcatatgttcgattttctccaatgccacgcgcaacggctgtgtcaaggttgcacgggactgaaggagagactgcgcagcaggcttgtcgccctttg

SEQ ID NO: 4853 - DNA, 486 bp, Hordeum vulgare
ggctcatttgctttctcgggtctactctttcactggttcactccatcgggacaggactgcggactcaatatgttcttcattgtctccacactgattcttgtttttgtattcgctattgttgcgctgcacccaaaggtcaatggaagcttgttgcctgcatcagtcataggcctctactgcacatacctctgctacagtggactctccagtgagccaaggaattatgagtgcaatggtcttcacaatcactcaaaagctatgtcaaccggtagccttacattgggattatgcaccaccatcctttctgtggtctactctgctgttcgtgctggctcttctgcaactgtgctctcagcaccagactcaccacgggccggtgccgataagccactgctccccttcagcaaggcagacgaggaggaaaccaaggatgtgcccaagccagtgacatactcctactcgttcttccacctcatcttctccctg

SEQ ID NO: 4854 - DNA, 543 bp, Hordeum vulgare
  UNSURE (43): n stands for any base
gatccgtatcttactgttgaaatactggcaacaatgccttagngtacacattatgcaggaccagactcgacaacgtcacaaacaccggctccttgccacgggtttgctcacacaatattacagaccagatacagatagtcagcttagctatcacagccgaaacacgttcgatatgatacgtaggtgctcacggacgatgcactctcagcaggtaggtaaccaggttgatctagaactccctgtctgggaacaggaggggagcgacaagggaccagatgaacagacctgccgttgcccactgggtcgcgatcctgacccagacagacggccacccgacatcgacaagcattccgctctcaccaaccgaggtcgaccagccagtcaggagcatggcagagtacatgcttgccagggagaagatgaggtggaagaacgagtaggagtatgtcactggcttgggcacatccttggtttcctcctcgtctgccttgctgaaggggagcagtggcttatcggcaccggcccgtggtgagtctggtgctg

SEQ ID NO: 4855 - DNA, 547 bp, Hordeum vulgare
ccgggctgaggaattcggacgaggcttgagagagagcgcgagcgagatggagcctcatgatcacctcgccgattgtggcgccgacgagcctgccgtccctctcccgccggggctcctccttcgccgtcgtctgcagcggtggcaagaagatcaaggtcgacaagcccctcggactcggaggcggcttgaccgtcgacatcgacgccaacggcaggaaggtcggcaagaagggtgtctaccagtttgttgacaagtacggcgccaacgtcgacggctacagcccaatctacacgccagaggaatggtccgaatctggtgaccgctacgccggtggaacgaccgggcttcttatctgggccgtcaccctcgccggcctcctcggcggcggcgccctcctcgtctacaacaccagcgctctcgccggctaagaaagcatctacctgtaacacggggccgagtttctactctgtaatctacgtagctaccatgtgaatgtatgtcatcaacgatgcaaagtaattcatccgaacagatggtttgtacgtaa

SEQ ID NO: 4856 - DNA, 557 bp, Hordeum vulgare
tacccctaatattttttgttggtcgcagtatgataggaggtccccgtgcatacgggctcaaaatgtccacccgattatacatttaccaaagtaggaagtgtatagtaacagcgttacgtacaaaccatctgttcggatgaattactttgcatcgttgatgacatacattcacatggtagctacgtagattacagagtagaaactcggccccgtgttacaggtagatgctttcttagccggcgagagcgctggtgttgtagacgaggagggcgccgccgccgaggaggccggcgagggtgacggcccagataagaagcccggtcgttccaccggcgtagcggtcaccagattcggaccattcctctggcgtgtagattgggctgtagccgtcgacgttggcgccgtacttgtcaacaaactggtagacacccttcttgccgaccttcctgccgttggcgtcgatgtcgacggtcaagccgcctccgagtccgaggggcttgtcgaccttgatcttcttgccaccgctgcagacgacggcgaaggaggagccccggcgg

SEQ ID NO: 4857 - DNA, 948 bp, Hordeum vulgare
  UNSURE (794)..(808),(814),(815),(842),(855),(858),(865),(875),(876),(884),(885): n stands for any base
gacccccgggcctgcaggaattcggcacgagggcctcgtgccaaattgcgagcgagggcttaggagagagcgcgagcgagcatacgatggcagcctccatgatcaccttgccgatcgtggcgccgacgagcctgtcgttcctctcccgccggggctcctgcttcaacatcagaggtgcagcggtggcaagaagatcaagggcgacaagcccgtcggactcgacggcggcttgaccgaggacatcgacaccgacggctagaaggtcggcgagaagggcggctaccacgttgacgactagaaccgagcctacgcgccacgggtacaggccaatatacacgcaacaggaatggggcgaatctggcgaccgctacatcggtggaacgaccgtgcttgttatctggggcggcaccctcgtcggcctcctcagtggcaggcgctctcctcggctacaatagcatcgctctggccgagctaagaaagcatctacctggaacacggcccgagtatctactgtgtgatctacgtaaatataacgtgcatgtatgtcatcaacggtgcaaagtacgtcatgctgacagaaggcacgtacgacacgctgaaactatacactggctactcaggtaaatgcataatgcgctggacatttcgagcccgtatgcacggaggcctcctagtttattgcgactaaaaaaacaatgctgaggggtattaaaaagggggaaaaagaaacaaaactcgggggggggccgggactaaaaagggggccttatagggagcgttaaacaaatcccaannnnnnnnnnnnnnncccccnnccccccccccacaccttcctccccacncaccaccaccacnccncccaccnactaatactnnccccacannctacccttctctcacttccacatacacatctttatttttttattctcccctccacccttattt

SEQ ID NO: 4858 - DNA, 549 bp, Hordeum vulgare
  UNSURE (56): n stands for any base
tacccctcgcattgttttttttgtcgcatataataggaggcccccgtgcatacggngctcaaaatgtccacccgattatacatttaccaaagtaggaagtgtatagtaacagcgttacgtacaaaccatctgttcggatgaattactttgcaccgttgatgacatacatgcacattatagctacgtagattacagagtagaaactcggcccgtgttacaggtagatgctttcttagccggcgagagcgctggtattgtagacgaggagggcgccgccgccgaggaggccggcgagggtgacggcccagataagaagcccggtcgttccaccggcgtagcggtcaccagattcggaccattcctctggcgtgtagattgggctgtagccgtcgacgttggcgccgtacttgtcaacaaactggtagacacccttcttgccgaccttcctgccgttggcgtcgatgtcgacggtcaagccgcccccgagtccgaggggcttgtcgaccttgatcttcttgccaccgctgcagacgacggcgaaggaggagc

SEQ ID NO: 4859 - DNA, 446 bp, Hordeum vulgare
gacagtgcacggtacttctcaagctgaggagtattacaacaaattaccaaactctgcttcaagggaagctgcctcattccctctgctccattgctatgttgctgaaagaaatgttcagaaagcagagtcctttatggctagcctgcagagcattgggctgcccgtcgatcctcactcgttcaatgaaatgatgaaactctatgttgcaacatgtgagtatgagaaggtgtttagtgtaatcgatctgatgaaacgcaacaacattcccaggaatgctctctcatataacctttggatgaacgcatgttctgtctctgatgttacgtctgtacaatcagtcttcaaggagatggttaatgatggtacgattgaggttggttggagcacatactgtacattggccaacatcttcatgaagcatggactgaatagtaaagcctttgctt

SEQ ID NO: 4860 - DNA, 552 bp, Hordeum vulgare
  UNSURE (131): n stands for any base
aaggaaaattatccacggaagtacaacactactcatccctataaagctataagaaccaccttatcccgttcttatagaagtatgaagcactccaaattccccaggattgtctacatacatacaacaataantcctccacaataaaagcatataatcatcctttgttaagaaacaattacttcacaaagcaaagccacaaattaaccttgccttctgaataacgaaatgttgttttgtcatgtgatgttctcgatctaatctgcagctctgctttgccacgtcagctgaaatgctatttaccatgtgactggttcacaggttgtcacatttcatagttacacgttgcctgtgaagtctatcttgctagcacgtatgatcaagtggtccatttcttcatccataactatgtcatctcttgctatcatctcggaaatgtttgttggcagcatggtgtcagctttaatatatgctcgaagcacggacttgtacaagggcaagcttgtcaggttaaacttttgaagaaccttaatgtacctgttagcatcatccgta

SEQ ID NO: 4861 - DNA, 514 bp, Hordeum vulgare
ctgagctgagtgaaatagtcacgaaatggctaaaaacagatcagtggacaagcaaccttgatcttctcactgggcttcggaaattcgcagatgatgaaaaactacatgctgagtgggcagcagccaagctggccagcaaaaagcgcctagccaagcatgtattggatgtgacaggaatcacaattgacccgaacagccttttcgatatacaaattaaacgcatccatgaatacaagagacagctaatgaacattttgggagctgtgtacagatacaagaagttgaaggaaatgagcgcagaagagaggcagaaggttacaccgcgcactgtcatggtaggagggaaagcatttgcaacatatacaaatgctaaaagaattgtgaaattggtaaatgatgttggtgctgtggtgaacaacgatgctgacgtcaacaaatatctgaaggtggtgtttattccaaactacaacgtttcagtggctgaagtgctcattcctggcagtgaactgtcaca

SEQ ID NO: 4862 - DNA, 553 bp, Hordeum vulgare
tttaacttgaacattttattgggaacctggatgattccgccattccagttccggatcaaaatagtacggttacagaccaaaaaggaaaaataacaaaagaaaagccgcatcctctatgcacttcaaaagtgcagcagaatacacaacacaacaggcttcgtacgttgcttcattcttctcagctacaacggaagcaggggttattcaccgtggatcatataagatccttattactgccaagcatcatcgtccaatgcctcttgatcgtgcctcctcttcatggaacagggcaggccgaaatgccccagatctccttcgcgtactggtcgatggtgcggtcgctgctgaatttgccgcttccagccgtgttcaagatggacatcttgatccatttcttcttgtccttgtaggcttcatcaacccgggcctgtgcctcaatgtagcttgggaagtcatagccaacaaggaagtagtcaccacgcccaaatccagtgttcccttcaagggaatccaagagaggagtgtagtcataggtgccgaaagcaccactcct

SEQ ID NO: 4863 - DNA, 1930 bp, Hordeum vulgare
  UNSURE (1)..(39),(44),(49)..(56),(71),(702),(722),(831),(910),(924),(956),(1034),(1130),(1162),(1217),(1250),(1270),(1357),(1362),(1373),(1378),(1408),(1410),(1422),(1450),(1485),(1596),(1609),(1613),(1618),(1638),(1651),(1660),(1662),(1703),(1730),(1764),(1790),(1800),(1845),(1848),(1857),(1860),(1865),(1871): n stands for any base
nnnnnnnnnnnnnnnnnnnnnnnnnnnnnnnnnnnnnnnttttnttttnnnnnnnntttccctccccgggntcttgggaagggataatttcgggccgcgagggggtgtgcgagtatcgcgcgtcacggctccctctgttcggctcgtgatgcacatgctagctcgtcactcgccacttgcggtctagacgactcccatatagccacgagatgtagagtattactgaagtggcgaccgagcagtggtagactagaaggattcaatagagagagacattgcctcgcacataagctatcgcacgctgtatgagtctgctgcagagcggtacactgactaagagagtggcgcgtggctcgacgtagtcccacagatcgccgcatatatctagttcgcaccagttggcattgatgtattacatatgagccagttctcacagtaggttggaggtctttctaatgctgcgttgcgtgcagccgcgttctacgccgtagccgtggcgcggcgctcgttcgaaggtgtgaaggactaggcgtggcgaggcggtagtaagtggacgtatagactactctgctcacgtagggtctcgtgtatagcgacttctaacttcttaagcggaggactgagtacgtcatccgtggacgcagactttaatataggtctgtcctcaatacggggagcatgttacgcactacttgcaggccncaattacgcccacacatcgntcggaccgtcctgagtctaaaaacggttacgtcacgacaaacaacatgagcgcctcgcgccgggactagcatcgctcgtgcctttatgtctgttggcgctccttaattntattcgttagttagctcgattaggtttcccctcacgagtgcctgagtgtgttctgcctgtagcatcttacgtatacctncagaccataatccncgcgctcgatctacgttcgaacacgcagaggntatgatcggtattagtcctgtacgtatcgtgttcgtgggtgtgtacgactttgtctagtagcgtgttcgtcgcagatntatgtgatgactccacatcacgtcaagctagagtcgcaagctgcgacgcggagactgcgtacagacactatgtgctgcgatggcttcgaccgagantcgccacctcccgtttctatgctctcgttganctcacgagagtgtgtgtttgagcgttagcacaacgtgagcggagcgcggcgtgcnggctgtcatgtcctgcgcactcgtttcaccagntctctctggctgtcgtcacnctgtctactcatatatactgctatactacgctcttcgagacgtatacgtctccagaatcacaccgacagctatttactcagcttacnctacnatatctttacngcganagatggagactagactaggcagcatgcgtntnagagagatcagngaatagggaatatgtgaagaattgaganacatcgatttaggagtataggagctgacgatgccnctagcgacggaatagcgagtaatctatatatctctagcgcatcaataatggccagactgtgtgtcgctctgtgcgtctctcgatgcgcgctatagatagtgactgcttcgncgactaattacgncgtnctgtngcacgcgtaggagacctcangggcacgcgtacntgactgtgntncagtgcggatattataatatactagaactcgttcgagcggntaggcgcactgcactctagctcagatngtcgcgtttcgttgctgtgaccagtgacagccgnagcgcttcgtgagcggcaggtcttangcgcgccctntgacacgcgattcgcgctacacaacgctgcaacagatgcacatcnttnatgcacgtnatngtganggcgtnctgcagcatctagagcacactcaagtcgcacacagagagctgactaacagccactgcgt

SEQ ID NO: 4864 - DNA, 516 bp, Hordeum vulgare
  UNSURE (16): n stands for any base
gtctgaaatgaaaaantacttgctgtgttggcggcatgtgttgtacaacaagtagaggtatgtacccatactgcatactttcaccacctccaactccaaagcttgtccaagaaaagcacaagctcgatacaaattgtcgggcaggttggatcaaacaaaattgtatgtagtagcttagttccggtcgaaccttcgaacctcaggtaggtaataagcataagattacatcagtttcccatgccagggcgtacatatcatacatatactctctgtatgtctgtgtgggcatcttcccttatgtcctgtcctttttccaggtttatgtcgtgagcatcttcttgtactccttgaacgtgcccgggaacggggcaaccttgccgtccgtcaccgcccagagctcgtccacactccccgtgatcagatgctcgtcgtgactcaccatcagcactcctccctggaatatgagcagaccctggatgagcgcctccactgcgtcgagatcaagatggttagaag

SEQ ID NO: 4865 - DNA, 517 bp, Hordeum vulgare
agactggacatctactggagtttatcttttctatcgaaggtcaagatgaatcaagcccgttctattctgttcgcttcatgcttccaatgctatcacaaataacgacgacagctgatggatgtagaactttggtgtcatttggaggctataaagcagttatagactgcctcattaaaatgaccgaggagaatggaatgatgatcgacgatggtagcatgtttttggcatgtgatactatcataaacatcatgtcaaatgggaagaattatcctattaaaatggagccttgtttcatccgcctcatgcaagcacttattacatgggctggaacaacagatgcttcatcagtcatcatgacagcagccagcttatgcacaatggtgatggagttgacatcagaagagtttctcttgagctgctcaggttttgaccccaagacccttgggagattgtctgacctcattgccagaagcttgcatcaggatatccctgacgacgatagtgaacagcttaacca

SEQ ID NO: 4866 - DNA, 543 bp, Hordeum vulgare
tatgtgtattgttacacctaaaatagttagttttacacaaaatggcagagaaaacagatgtggtctaacatctcagccagcctgtcacttaatgtaatccagtgtagtgagaaacccatgccagctagccactgagggttcaagtgatgtttgcaaccctaccctgcctgccctagcagcgcgttcaagtaaggcatcggccgttacacagaataacgagtcagccaccgacggctacatgtggatgccggcgaggggaacgggttacgcaaccccgcatgagattacacctgatgcaacaggatgcttgcactatgggttccccatctgtatggctacattcgcaacagagaactctttgggcagagaagatcagacagatacatgctgatgtacgacatttctaacactcgggaatcgatcagcccagcgcctataacctgatgcaatgatttgcttttggttaagctgttcactatcgtcgtcagggatatcctgatgcaagcttctggcaatgaggtcagacaatctcccaagggtctt

SEQ ID NO: 4867 - DNA, 518 bp, Hordeum vulgare
agagcacaacgcaaagaaaaccgcagcgaatcccacacatcctccgcctgccatctccaacccccgatcaggctggtattccggcgaaccctccactcggactccaacccgccccggtctcggccgcgtcccactcccccccttcaacccctcttcgtcggagccagaggtccccttcggcggcagttcgagccgaatcgctccttctccctcgtcgtcaggcacagcaacagagagacagagctcaccggcggcggcggcggcgaaccggacatgtgcgtggagggattcgaggacgcgcagatcgagaggccggcagatttcgtgatggagagagtttgtgagaacacagtgtccattgatttcaagcaaactacaatggtgactgtgattggagagagttggcacaattttgtcccaactatccggtcaggggactggtctgacattggtggccgtgactacatggaagatgcgcatgtgtgcatccccaacctagccaagaattttggttttaa

SEQ ID NO: 4868 - DNA, 451 bp, Hordeum vulgare
  UNSURE (4): n stands for any base
tctnatctcataatgagcctagagccccctggatgcacgctactgactctgttaccaaccctaagctcccaacttatatttacaggtgcctacaattacaatggcgggtgagaccttcttcaggttcgttggttttattcttcccaggtaacaatagagccaccactggcttgtcgacgacgatggatgaccaaacggacggacaaacatgagcagcagcagggaggccgcaatcggtacttacagttgacgctcaacaatgtagaacaaggcggcgacaatggcgcgccgccgaagatcactggccttccaggagcaccctgaggctatggagcccctcggccgagatgctccgctccaccctgcccatcctgctcaccctgatctggggaggggcctcctggtggaaggcgaccatcaccgccgtcagattgtcggtggcgccccgcct

SEQ ID NO: 4869 - DNA, 520 bp, Hordeum vulgare
ggaaaatgatgcagatttaaagaagagagcgatccaaacttatgaggaggatcacaaagatgatggtccatttatgttcgagcattgttgggaggttcttaaaaagcaaccaaaatgggacgcgtatttggaacgcctagaagatttggagtcgggcaagaggaagtttgttgttgatgatgaagtgggaaagcatttcactctcgatgatgttcaagatgaacgaccaccaggtggcaagcaagctaaggggaaaccgaaacggaaaagaaatgacgaaagttgtataatagatcttgaagatgagcttagcaagtttgtagaagctcagactgcagcaaatgaaggccgcaaagaaatgttagagacacaaaggcgtgtgtcgagtgagaatctggaagctcggaagcttgcatgccttgcagcaaaagatcacaaggagtcagtcatgctagaaacgtatcgctcattgatgatgcaagacacgactgggatgtccgaagacgtgagatctgagcat

SEQ ID NO: 4870 - DNA, 553 bp, Hordeum vulgare
  UNSURE (28): n stands for any base
tagtcacatttgccctcattacctggtncgcacacaacacaccatgacaacaacaattaagcattacactctttctgatacaagcattaaccaaaagtacttcaaataagtctttcaaacaaaaacattaaccaaatagactgccaaacaagccattatctattgatcttggtagaaagaagcttcgaaccagtttgcactgcagcaatcaccacatcatagcatagtccttagtcagtttttccaaacagcttctccctgaaacacttcagtgccaacacatgctcagatctcacgtcttcggacatcccagtcgtgtcttgcatcatcaatgagcgatacgtttctagcatgactgactccttgtgatcttttgctgcaaggcatgcaagcttccgagcttccagattctcactcgacacacgcctttgtgtctctaacatttctttgcggccttcatttgctgcagtctgagcttctacaaacttgctaagctcatcttcaagatctattatacaactttcgtcatttcttttccgtttcggtttcccct

SEQ ID NO: 4871 - DNA, 484 bp, Hordeum vulgare
tcggcacgagggtccagaataacccccgcgtgctaaggctgcgggattctacgcctcaccatgctatcgtgctcaagatggaagatgggagcgatcttctgctccccattattgtcatggagacaccaagtattatgctactggccgcccttcggaacattcggattccaaggccaacaatttataatgtggtaaaggagatgaccgaaatgatgggatacacggtacgtttggtgcggattacagaaatggtgcatgatgcttactactctagattgtatcttgcaaagactggaaatgaagaagaggttattagttttgatctcaagccatcagatgccatcaacattgctttccggtgcaaggttcctatacaagtcaataagcgcattgcatacaacaacggtctgaaagtgatacagccaaagccaactgggagctacgtgaactctgaccaaatccaatacgcgagactggacaagcc

SEQ ID NO: 4872 - DNA, 543 bp, Hordeum vulgare
  UNSURE (2),(48): n stands for any base
tncgatgttctgactataatcaattgtacagctttccgtacgacatgntcttcaaagaggaaaaatattaaaagttacagtcattagctatgtacatattcacatcgtgcatcttgatgtttgccgaagcttctatttccttggcaaaggtcactatgtacacccccatctggctctgttatatcgtgttctttttgtttgcccggaacatgagaaggcgatctctgtattgagcagcatctttataacgttcctcaacagcagcaacaagcatgccgcgcaccaaatcaaactcctgggcttcaaagcaaggctggtcgccgggcttgtccagtctcgcgtattggatttggtcagagttcacgtagctcccagttggctttggctgtatcactttcagaccgttgttgtatgcaatgcgcttattgacttgtataggaaccttgcaccggaaagcaatgttgatggcatctgatggcttgagatcaaaactaataacctcttcttcatttccagtctttgcaagatacaatctagagtagt

SEQ ID NO: 4873 - DNA, 396 bp, Hordeum vulgare
  UNSURE (24),(33),(34),(47)..(57),(59),(63),(64),(76)..(98),(110),(111),(120)..(123),(125),(131),(143)..(147),(149),(150),(155)..(158),(166)..(174),(176),(178)..(180),(185)..(187),(189),(192),(193),(197),(201),(209)..(211),(232),(237),(244),(248),(264),(268),(275),(279): n stands for any base
tcatatgccaatgtggcatgtganttgaccaannttgttggccaaannnnnnnnnnntntttnngggccccaaaannnnnnnnnnnnnnnnnnnnnnnaaaaaaaaaaannaaatttttnnnnanaaaaanggggaacccccnnnnncnnccccnnnnaaaaaaannnnnnnnncncnnnccccnnncnccnncccncccncccccccnnnccccccccccccccccccccnccccnccacccnaccncccccccccccccccncccnccccccncccnccccccccccccccccccccccacccacaccccccccaccaccacccaacccaccccccacccacccacaccacccacccccccccaccaccccccccacccccccccccaaaccac

SEQ ID NO: 4874 - DNA, 502 bp, Hordeum vulgare
tagccgatgataacattcagatcatcgatatagatagcattgctatagactggggaattgttggagatactccaaacaccttaattttgcaaaataaatcctcgtcacacaccctatgtccacaaaacccaagccatttattttgcaagaaaggtccagtagtagtccatggcaaattacatttattctcaccactacaaaggccaacgcacagatttatcctgatggaacagatacaggtcctcgaaacagctcaattgcatcctagttagccggagccttgtaccacccccagggcgcatcagatgtgtactccgtcacctgcttgatgctcaggtagttatcaatgcccccttctccgagctctcgcccaaagccgctgcgcttgttcccgccccacggagcttggcagaagcaaggctgcgagcagttcacccagatgcatcccgcttcgatctcctcagctaatctctggcatcgctcactgtcaccggaaatcacg

SEQ ID NO: 4875 - DNA, 1037 bp, Hordeum vulgare
  UNSURE (1),(17),(20),(21),(23),(25),(26),(29),(32),(33),(36)..(38),(46),(49)..(51),(53),(58),(61),(66),(67),(73)..(75),(82),(85),(99),(100),(120),(123),(485),(1037): n stands for any base
nttttttggtccaaagntgnnancnncantgnnggnnnccccaccnatnnngnctggnggnaccannacgacnnnaagcctnttngtgatgcggggtgnnacatggacaaagatgccggntgntttgagctcttcccaggtcgggctgaatccttgcgcattaggtatattgctgcccctgctttgctttttttatctgatcggcctcgttcgaatctatcttcttttctcctcctccaccttccgtctttgttttttatctccttctggggggggggcggtctccttttttccttttcctcccaccctcttttatagactaattcaacgtcgctttatttgtcctgttctttcgtgttctttctacttcctttccgcttgtcttcctgcgttttacattacttttacctctctgatctcttctttccattcgtctctcatccctttgtgacttttctttcctttttttctttttttttttccgnattctcatgtatttcccctcgctctactattcttgttgttcgtttatctccatcccctttttttttcctcttttatttttttttcctttccttttctctttcgctcctttccttccttgtcgtcttttccgttccatattttcgtatttttgtttcatctccccggtgactttttcttgtctcttctcccttttcccccttcttccccatttatctctttttcccccctttactttttccccaccccccctttcttccgcgtctttgtactcgtcttttttgtccttttttatttgctacgtgcgtggtctccttttttttcccatgtttcatttattctcccttcttcacttcccacttcatttttacccttttttctccccttatgtctttcatttttttctattttctcttctctctactcattttcgctcatctcttcacttctttttacgctcccttctttccttttttttcgtccttctttcgacttttttttgtccttccgtccttcttttccatcccttcctcattttcttctccacttttccn

SEQ ID NO: 4876 - DNA, 551 bp, Hordeum vulgare
aaaacatgcctttattttgcagaaaggtccagtgtagtccatggcaaattacatttattctcaccactacaaaggccggcacacagatttatcctgatggaacagatacaggtcctcgaaacagctcaattgcatcttagttagccggagccttgtaccatccccacggcgcatcagatgtgtactccgtcacctgcttgatgctcaggtagttatcaatgcccccttctccgagctctcgcccaaagccgctgcgcttgttcccaccccacggagcttggcagaagcaaggctgcgagcagttcacccagatgcatcccgcctcgatctcctcagccaatctctggcatcgctcacggtcaccggaaatcacggcaccagccagaccataatgagtatcgttggccagttcgatggcttcctcttcggtagaaaattccttcacacacaggactggaccaaagacttcctccctccaaatctccattgatgtgttgatgtcagtgatgattgtgggttcaatgaagaaacctttctccagatgcttgggc

SEQ ID NO: 4877 - DNA, 545 bp, Hordeum vulgare
gtcccccgggctgcaggaactgtttacttcattgtgggtaacgtatttgggttaaagccctacgtgctctacgtttggaggatctacgaattccccctacttattaaaaactttccaggcccgcctcatggtatccaagttgaaagagataagttgaacaagtatggccgtcctttattgggatgtactattaaaccaaaattgggattatccgcaaaaaattatggtagagcgtgttatgagtgtctacgtggtggacttgattttaccaaagatgatgaaaacgtaaactcacaaccatttatgcgctggagagaccgttttgtcttttgtgccgaagctatttataaatcacaggccgaaaccggtgaaatcaaggggcattacttgaatgcgactgcgggtacatgtgaagaaatgattaagagagctgtatttgcgagagaattaggggttcctattgtaatgcatgactacttaaccgggggattcaccgcaaatactactttggctcactattgccgcgacaatggcttacttcttca

SEQ ID NO: 4878 - DNA, 551 bp, Hordeum vulgare
gtaaaattttatatataaacttacagtttgtactccaaaattctattgctgctacagccgtatgtgattgtaataatactggatatataagcataaacattaattgtctaaattgaacctatatacgtatatagcaacgattgatgccgccagtaacaggagcgcgtactcctttacttttggccaaattcacaagggagtaattctatgtgctgcgcctgcatgtgtgggatgaaaatccaacttaattattccggctggtgagatgccttggtgggttcagtatgtgaccctgacgccctggtatctgaggatctcgccgatgagctcgcccttgccggagccgacgtagcggccgacgatcttgttgtccctgatgaagaggaaggtgggcacctccacgacctccatgtccttgaggaagtccatgcaggcgtcgttctcgtcgccgttcatgcgcgcgaagacggttgtgtcggccatggagcgggacagcttgaccacggtggggtagaccttgacgcagggcccgcagtgcttgagcccgacgt

SEQ ID NO: 4879 - DNA, 1604 bp, Hordeum vulgare
  UNSURE (1),(5),(15)..(22),(25),(1200),(1255),(1295),(1297),(1301),(1312),(1368),(1410),(1424),(1438),(1599),(1601): n stands for any base
ntttntttttttttnnnnnnnnaanttgtaaaaggggaggacgcaaattttgcggcgtttgtagcagaccttaattttttgtttggggcttacaataaacctgtagtacgatattatcaatttcaagttgattttgtaacacttatactaaaagatgagaaagtccttattaattttaagaggaaagattaactcctcatcttaaagatgagtctgtgattatctaattcgaagttgttatttatacctattattttatagatgggtatggttattattaatatcatggtctatgtatgtagtttattgtttggttagttgtgtttgttgggtttttgtgaggtttgggagactcattttcttgttgtggggtgagggcatacgcgttttgggttgtagtgttctggtggtggttggggcggtttgtgcagtgtggtgtgtttaggatgtgagttggttcgtgggtggcggggcggtattgtattgggtggggtgttttggggtagtgtgtgggtggtggtgtgtgagttgttgtttggtgagcgatatgggtgttttcagtgtggttcctgtttgattattgcgaggttattatgtgtagcgcggaagaggatgttctctgggaggagtggagagaggggaggtggggtgcttaggtggtgtaattgtagtattagcacgagtgtgtcatgttgtcattgattggagtatttgcggcggtgtgactgcgtgtgtgcgttcgttttaatttatgcgggatacgtgtacattatattttagcttgtatggaaggacgttggtttagcaggtgggcgcgtgtggttgttttgcgttgtgttaggttgcaattggctgtgagatatgagcgtgtgttttgagtcttccaccacggtgtttattttgcttgagtgtgtgtgtttgtcaccgcgagtcgagtagtgtgaaagcggatgttatctagattatatgtattagctattgtttgttcgagcgttatgacatgtgtagtgtatgatacactgacagcagtgtgtggtgagtgtgcgacgtttatgtgtggcgagttattggattgttgtggcgtgccattcgtgggcgtgttagtgtgcgtctcgccagtgtgatgtggcgttcgtggtgattttctgtgcttgggatgtcagatagttagccatgcgagatatagtaagtagtgatggngtcgtgccttgtcatgtcagtgtgggatagcgcgatggcgagacgtgctggcggngtggtatgtttttaggtatcgatgtgcagattctattgtngnctancgcgacgtttnttatcttgtcgtgtgctgttctcagctgctcgtattttgtgtggactgaagtgatnagacacaatcgtgtgttgtatatctagtaattagtctgtcgngtattgatcgaatntgctcgtgaggtantcggttctgagaaagagtggtggtctgtagtgtggtagtttatgatgtataggcgtgttgcaggcatcgagcttaggtatgggactcgatgagggtagtatttttatgtgcgagctattgcgtatgagatagtattagttatgatgtttgttattatttantnttg

SEQ ID NO: 4880 - DNA, 518 bp, Hordeum vulgare
ctcggccgatcgccccctcttcttccgttcatcatttcgttcttcttgtgttccaccaatctggtatggtgatcgcctgatcggatcgccagttcaccgccaaccccatctattctgatctcgatcggtgctcagttacaacgataatccagaaaagggagatggaggtcatccgcgggccgattctaccgcgctgcgctgcgcccgctctgacctccggctctcggatcggcggccagctgctgaggcgcgtgcgcatgcggaggagggcttccggtgccgtctcgccaggcgactaccacgccgtgtcgcccaggttcttcggtgccccgacccagcatcacagcacgggctcctggcccgttcgctgcagctacggctcgtcatctgacggggacggcgccccgccggcgaacttcgacgccagcggcgaggagttcgtcgactccagcgtcatggaggctgtggagctcagatgtgtgtcagatggtttcgtgatcagaatgcgcgacggaaga

SEQ ID NO: 4881 - DNA, 1433 bp, Hordeum vulgare
  UNSURE (1)..(3),(8),(9),(17)..(19),(22)..(24),(28),(31),(33),(36)..(38),(40)..(42),(46)..(55),(58)..(61),(68)..(72),(75)..(79),(81)..(83),(93),(101)..(104),(106)..(119),(134),(137)..(147),(167)..(171),(174),(175),(180),(182),(185),(186),(215),(217)..(219),(231),(244),(283),(309),(347),(350),(541),(549),(556),(562),(726),(800),(867),(886),(955),(1012),(1135),(1243): n stands for any base
nnnaaaannttgaaaannnccnnnttgncantnccnnnannntagnnnnnnnnnncannnnacgccannnnntgnnnnngnnntttttcattnagcgcccnnnntnnnnnnnnnnnnnnttttttgttgtcgcnggnnnnnnnnnnngggggaggggggggggtggnnnnnttnnttagngnttnntttttgtggggggggtggttttttttttntnnnggggtggggtgngtttggttttttnttgtttttgtggtgtttttttttttttttgggtgtgtgngttgtgtttgttttgtccgtggtgtnttgtttgtgtgttttggttttttttgtgttgtgttttnttntttggcgggggggggggggttcttttttcttcttttcttttgtttcgtcttggttctcgctttttccgcgacgttgtttcttttttttgcttgttcctgtttgttgtcttgttgttttctcttttttctctctttgtcggtctctttctctctttctttctctctgtcgtgcctctttggttgttcttttnttcttttntcttccnttcttncgcttcttgttctttcttttcttttcttttttgtcttttttgtctctcttgtttctcctctcttcttccctcttctctccctctttctctgtttctttcgccttttttttttcttcttttcgctctctcgtttcttttttcctcgccgctctctttttctcttntccttctctttctccgcttccgttccctctcccgctcttctcgtttcctcctttttcgtccctttctctttccnctcctgttttgtggtgcccgtggccctgcgtctctccttcccgctcttcccctcctcgctctcgcgnctcttccctcctcctctgnttcttctctttctcttctttcttcttcttgctcttctcccttttttgttccgtctctcgtccccggttnctccttctttctcgtcggctccgcccccccctctcgctgtgctgccggtccctcctngtcgctctgctttctctcgctcctttcttgtcattttccctccttcctcccttcctcttctctctttgtcgctctccgctgtttcctctgcctccccccggtctctctctccctttcttcgcntttcctggtctctctctcccgttctctcctccctcccctttatccctcgtccctctattagtctttcttcctcctcctctctttcgtcctctccctcttctcgttctnttctctgttcgactctcgcgtttcttctgtctttctactcctgttctcctctctctcttccctctctcgtcccctcccttctctcgtcccttctctcctccttctcctcgtcgctccttttctctccctctcccctaccggttctctactccgcttcctctcatcctcgccgccacccttctcccttccg

SEQ ID NO: 4882 - DNA, 552 bp, Hordeum vulgare
caagtttataaactaattcccaaaatcttggatacttcacgggagtagaaaaaacagagccaaattgaagtctacatgaaaatgctgtctagccatggattcttcatctcaaactctcataaccaggaagccgtctagcctaaaattcacccctttgacataaaaaagaagagctaacatcccactagactaagattccagaacatcggtgaccatagaaggtgaagccctcgtgtcttggctaccgacggtcaccgaggggaaactcaaggtgtgcaggagacactgaagcattgccctcatcatcagtcggcatctgggaaaactgcttgaggaacaggaagcagtggccttgccatcatttactggactgacttgacatcactagcaaaggaggcaaccttcaacttcaaagatgtgaatctctcatccaccttcttctcgaatgcatcttggcggctaaggaaagcagccaaagagcctctatgctcttaaccattggacactagagcagggacacggacacacactaggctttggaaattatttaca

SEQ ID NO: 4883 - DNA, 480 bp, Hordeum vulgare
gggcctgcagggaattcggcacgagggaccgacaacacctacagtagagacgcgccacccgccccacacaccactctggaatcagtagtcaagaaggcaagaactctccggccggccggaccccgagctcgcgtgcgtcagtcaggatggcacccacggcggcggagcagcacacgaggaaggcggtgggcctggcggcgcgcgacgcctccggccacctctccccgctcgccatcacccggaggagcactggagatgacgatgtggtgatcaagattctgtactgtgggatctgccactctgacctacactgcatcaagaacgaatggaagaacgccaggtaccccatgatccctgggcacgagatcgccggcgaggtcaccgaggtcggcaagaatgtgaccaagttcaaggccggcgaccgtgcgggcgtcgggtgcatggtgaactcatgccagtcctgcgagagctgcgacaagg

SEQ ID NO: 4884 - DNA, 547 bp, Hordeum vulgare
gcctatgatttctttggtatatgcacatctgccataggaagaggacttccttgatcacatacaacaaaatacacaagcatcacgtacacgggtttacattttcacacacacaaaatgatttcagattgtttcttgttactgctaacaagaacagagaggcagagtcactcagtggtggcggcggcagcggcgttgtcaagggtattgccgatgtcgatgacgaatcgatacctgacatcggccttggcaagtcgctccatggccgtgttcacgtactcggcgtcaatcacctcgatgtccgccgtcacgtcgtgcttcgccgccagatccagcatctcctgggtgtccctcatgccgccgatgcagctcccggccagggtcttgttcgtggcaaccagagcaaagggggagatctccataggattctcggggaggccaaccatgatcatcttgccgttgggtttcagtagccctaagagaggggccatggggatgtttgcagacaccgtgtttatgatgccatccatggtattcattgcagccttca

SEQ ID NO: 4885 - DNA, 553 bp, Hordeum vulgare
  UNSURE (20),(26),(47),(54): n stands for any base
gtacccccgggcctggcagnccccgntacctgcccccgcacacgagnactgagnagaggatgaggaaccccacggcggctctctcggcggcggcaatgctgctgctgctgctggtgtcgccggcggcggcggccacgtggaccgtatcgggtagggagatatggtacagggagaggagcgatgtggaggcgcggctggtcttcggcgcgtggaaggccaagttcgggaagacctacagctccgtcggcgaggaggagcgcaggtacgccgtgttcaaggagaccctccgtctggtggaccagcacaacgccgccggcgaggccggggtccccgtggcccgcatgggcatcaacgggctcgccgacatgaccacggaggagtggaacgtcatctgctgcggggccggaagatcaggcccgccgtcgactggagggagaaaggagcgcagcgggcgatcgaggccatggtcgtctaggggtatacattacttcatgcatctatatggagcataccaggcagctgtttcttccatattgcattggtgtgccggtga

SEQ ID NO: 4886 - DNA, 539 bp, Hordeum vulgare
tacttatattctggaaatgctacattttcatctcagtttttgttatacgagcaacatggttctgctaacgttatcggcttccagcaacaaacagacaaatccatctgtgcttcatctcttccaaggatagtgctacctccagattttattctggttccagggcagccaccgtactggtaaacaggtgaccaatgagattgtgtcgacagaaatactcaaaaataaaccaaactgtagacacacctgccgcgtgacaccgccgctcttccccgcagcgacgcttctccagccctccggactcccttgtgactctccccgccccactcaccggcacaccaatgcaatatggaagaaacagctgcctggtatgctccatatagatgcatgaagtaatgtatacccctagacgaccatggcctcgatcgcccgctgcgctcctttctccctccagtcgacggcgggcctgatcttccggccccgcagcagatgacgttccactcctccgtggtcatgtcggcgagcccgttgatgcccatgcg

SEQ ID NO: 4887 - DNA, 552 bp, Hordeum vulgare
  UNSURE (20): n stands for any base
gtacccccgggcctgcaggnaattcggcacgaggcgcgggcgagcgcgagagcgagtgggcggtggatggcgatggcgggcggcgggggactcaaccggtcatcgtcgcgggggcagctgccgccgcaggagctgctcgacgatctctgcagccggttcgtgctgaacgtgcccaaggaggacctggagtcgttcgagcggatcctgttcctgctggagcaggcgcactggttctacgaggacaactccgtggagcacaacccctccctcaagtccctctccttcaaggacttcacctccctcatgttcaacagctgcgccgccctcaggccctaccgcgcgcacctcgacgacatctacaaggacttcacccactacaagttccgcgtccccgtctccggcgccatcatcctcgatgacaactatgacaggtgcttacttgtgaagggatggaagtctagtgccagctggagtttcccccgtggaaagaggagcaaagatgaagaggatcatacttgtgcagttagagaagttctggaggaaactgggtgt

SEQ ID NO: 4888 - DNA, 549 bp, Hordeum vulgare
gtgtgcaaaagaatgacatttataacaactcaagaaagatatgataacagtagtgttttagattacagataccaactgaacacggcatggggagacggaacgtcgtggcgtcacggattccagttaacaacgagcgacgacatcattccatagtctatacacatcaagggtacaggagttgatgatctgtcaggatcctaggtacgcagaaaggaagcatcaatggactgcagaatactggccgtatcgaatctgaagcttctgaagcttttgccaggtcggttgtcgacgtgctgcgtgccagatcctgctctagtaataacagggttttgcgtgtcagatcctgctctagtaataacagggttctcgacaggcacaaagacacccgagggattcttcgctttccacacagtacctctagtagatgtgtctgacttctgatatactggggaccgatgtgtgcctatccatgcttttagacccgtcaaaaatggtgcaaccatataaagcttcatcccattcactccacgagatattgcatcatcacta

SEQ ID NO: 4889 - DNA, 523 bp, Hordeum vulgare
cgtctaagtggctcgagcgcttcgcctacaccaacaccatcgtctaccccttcacctccattcccctcatcgcctactgcaccatccccgccgtctgcctcctcaccggcaagttcataatccccacgctcaacaacctggcgagcatttggttcatcgccttgttcatgtccatcatcgcgacgggggtgctggagctgcggtggagcggggtgagcatcgaggactggtggcgtaacgagcagttctgggtcataggtggcgtgtccgcgcatctgttcgccgtcttccagggcttcctcaaggtgttgggcggagtggacaccaacttcactgtcacctccaaggcgggcgctgatgaggccgatgcattcggtgacctctacctcttcaagtggacaaccctgctgatcccgcccaccacgctcatcattatcaacatggtcggcatcgtcgccggcgtgtccgacgccgtcaacaatgggtacgggtcctggggcccgctcttcgggaagctcttctt

SEQ ID NO: 4890 - DNA, 548 bp, Hordeum vulgare
gagcaaaatattgtccttcattggaatataatctcctgaacaaattctacaacttggaaccccccaaattaacacgttgtctcgcttggaaaacttgtactacaaaataagcaagtcgattatacaatgccccaaaagtgcaatgtgtgcaagccattgacaactaagctgaatcagcactgtactccacacggcttaagaatgggtcccttgggcttggcaatgaaggggtcgatcctgacccacacaagggagaagatggaggcgagcaggacagaccagagcacaacgatggtgggcgtccggttctgcctccccatgagccccttgaggaacgggtagaggtggacgatgacccagaaggagaagaagagcttcccgaagagcgggccccaggacccgtacccattgttgacggcgtcggacacgccggcgacgatgccgaccatgttgataatgatgagcgtggtgggcgggatcagcagggttgtccacttgaagaggtagaggtcaccgaatgcatcggcctcatcagcgcccgccttgga

SEQ ID NO: 4891 - DNA, 502 bp, Hordeum vulgare
gttgccctttcagcacctgaggaagctcatcggggctcactttgaagaagccggcagcaagcagccacaccaccacttcaccttcctcctcctcggggtacgtcattcagctctgccaatgccaattgttcttctcttgttcctattgctcatggcgatggtacctgtcaatcgccatatcaccttggtaattccaacccgttaatgatatgaggcgtgttgatgccagtgaaaaacgtccactcatccatcctgacggtgggaaactctttgttggtgtggatgtatgtatgtatgcaggatccttctggtgcgccggtgtcgagggagaaggagccgacggtgcagatcagcagactgcccaactggaacaaccagaccaacagctacctcgcctgcctgcgcgtcgccaggaagcccgcgacgacggagcagcagcagcagcagctccaccagacgcccttcagcccgctggagagcaagctcaactccttggccctga

SEQ ID NO: 4892 - DNA, 541 bp, Hordeum vulgare
  UNSURE (10): n stands for any base
gggcttcaanctagtagtaattttacagagcagagaatacatttctggatacgagatagctcgctcgtcgtcagttcgtcaccacatgtgaccgacggcaaccaaccaacacggtaatctgataacgatgaggggctcaagtcaagctctgagctcccggatgtagctggggctcatctggccgacgaccttgggcgagagcgcgcccgcggcggcatggtgctgctgctgctgcacctcgttcagggccaaggagttgagcttgctctccagcgggctgaagggcgtctggtggagctgctgctgctgctgctccgtcgtcgcgggcttcctggcgacgcgcaggcaggcgaggtagctgttggtctggttgttccagttgggcagtctgctgatctgcaccgtcggctccttctccctcgacaccggcgcaccagaaggatcctgcatacatacatacatccacaccaacaaagagtttcccaccgtcaggatggatgagtggacgtttttcactggcatcaacacgcctcatatcatt

SEQ ID NO: 4893 - DNA, 543 bp, Hordeum vulgare
  UNSURE (16),(45): n stands for any base
gtcccccggctgcagnaattcgcaccaggaagggccgactctganaacatgatgaatttgatagtgatacagtatcctccaaaatggaccacctatatctttgacaagcaactcacgtccccatgcaacatcagctccaggggaaagggagaaggagattgtagaactgtttaaaagggttcaagcgcagctgcgagcaaggggaaaaggcagggaggacaagaagcctgaacctgcaaaatctcagggcgagaggggaagtgtcgattcccttcttaatttgctcaggagacactcggtggaccaaaaacgaaagagcagcgatgagaaagaacagaattttgatcagacatggagaagcagtgattctggaaacaagcaaagttcaaggatatttggcacgaagaacgacgctcaggaagggcagaagccacctcctgcaaccttccagagaccgccttcaagcttcagacgaagatctcctgttcctggggttaagttccagcttgttaccaatccagatgctggtgccaagcctgtcgt

SEQ ID NO: 4894 - DNA, 557 bp, Hordeum vulgare
gcaaaacaaatgccccccagcgggcttacaggctttcacttatttaataacctctaataacagggttcagctaattaactaaccaagctaggacatgacagccaaaggagacagcaacagatcagcaaagatcggggaaaagttaaccttgctcatttacaactttctatctaagaaaaagggcactggtcttggcgaaataggaatggggagatcgtttgtgcacatgaccatggctgagggaagcaaaacggtgggctcgagcaggattggcgtcaccaactgatcaggaagcgtcgctcagtagtgcgaccaagtcgctcttcttcatcttcgagtaaccccggagtcctcgagatttcgccagctctctcagctccgtgaccttgagtgagctcaggtcagaaacttccagggaaggactgccttcctgactgtcatcatgggatgcgctgctatctgcaacgtcatcaacatcatcatcaacatcatccaacggttccagataatcatcaggctcactggtatctaacaagtccgattcatcgtctggaaca

SEQ ID NO: 4895 - DNA, 512 bp, Hordeum vulgare
ggctgcgccgttctgctcgccgcggcgctgctcctctccgcgccggccgccacagaggcgtacgattcgctagatccgaccgggaacatcaccataaaatgggacattatatcgtggactcctgatggctatgttgcagctgtcacaatgtacaactaccagcagttccggcacatatcggcgcccgggtggcagctggggtggacgtgggccaagaaggaggtcatctggtccatggtgggggctcagaccaccgagcagggtgactgctccaagtttaagaccaaccctccccattgctgcaagagagatccgaccgtcatcgatcttctcccggggacaccgtacaaggaccaagtcgccaactgctgcaagggaggagttataagtacatttaaccaggacccaggaaatgctgcctcctccttccagatcagtgtaggccttgctgggactacaaataagacggttaaggtgcccaaaaacttcacccttaagaccccaggtcccgg

SEQ ID NO: 4896 - DNA, 543 bp, Hordeum vulgare
  UNSURE (14): n stands for any base
tatacatttaattntactacagccatacaattaattaatcagttcaccgaagcttggcggccactacatttttggccctatttaacttagcagaacccatatacacacatcagctttcctcaccgcgtctcttatatatatgcaactgtggaaccgaatgaacagacgaccggaccctttgccgcacaccagaagctcgccgacatcgtttgtcagacataataggccagcagggtggccagcgcagtccagaacaccaagagctcgagcgtccacggtttcttcatcagagggctcgcgttaggcagccatggataggcgtcgggcggcggcatgacgcagttgtcgccgttgaagtacacacgccgcgggaaggcccatcctttctcgaaggtgaagatctccgggtccttctgcagaagtatttccgtctgcgcgtttccgaacggaccagcttgattgagcaggtcattgtagaacttcattccccagaacatcgcgctgtcatttatgcggcctccgtacggggctagcggcttgtag

SEQ ID NO: 4897 - DNA, 488 bp, Hordeum vulgare
  UNSURE (4): n stands for any base
gggnctgcaggcaattcggcacgaggggtagtcagtgaagatgcaattttgagatgggcggaagaaaaagaaaatgctgacgagtccgataaagtcttcgttaaacagtgtgatgtttttattcagtggctcaaggaagctgaagaggaagaggacgacgaggacgacgaagaagaagagtagagtcggagatgatgcgcaagcctggagaggagtgcagcgttgttgtgcgacacccgggaagttttggaaggctcgaatttgtgtgtacaacatgactccagttttgtttttcctataaccaaccaatcggaggggaaaagaaaagaggggagagaaagcattttcgcgcgcggggcggacaccgcaatggacccgcagagtgtagatatgttacataacccttcccggcttcatgacttcaggcgtgctttgcttggctgacgcttccatgaaggaaagtctgtttgttttaaaaaaaaaaaaaa

SEQ ID NO: 4898 - DNA, 439 bp, Hordeum vulgare
  UNSURE (16),(17): n stands for any base
agactttcctttctgnngaagcgtcagcaagcaaagcacgcctgaagtatgaagccgggaagggttatgtaacatatctacactctgcgggtccattgcggtgtccgccccgcgcgcgaaaatgctttctctcccctcttttcttttcccctccgattggttggttataggaaaaacaaaactggagtcatgttgtacacacaaattcgagccttccaaaacttcccgggtgtcgcacaacaacgctgcactcctctccaggcttgcgcatcatctccgactctactcttcttcttcgtcgtcctcgtcgtcctcttcctcttcagcttccttgagccactgaataaaaacatcacactgtttaacgaagactttatcggactcgtcagcattttctttttcttccgcccatctcaaaattgcatcttcactgactacc

SEQ ID NO: 4899 - DNA, 373 bp, Hordeum vulgare
aaacactccacagccatatataccaccaagctgatagcaagcaagcattgaccaatctatcatggcgaggcttcacctttccgccgtagcggcctgcgccgtcctcctcgccctcgccgccccctccctcgccggcgaccccgacatgcaccaggacgtctgcgtcgccgacctgaaatccccgatcaagctgaacgggttcccgtgcaaggcggacatcacggcggacgacttcttcttcgccggcctcaagaacgccggcaacaccaacaacccggcgggatccaacgtcacggcggcgaacgtgcagtcattccccggggtgaacacgctcggcgtgtccatggcgcgcatcgactacgcgccgggaggc

SEQ ID NO: 4900 - DNA, 272 bp, Hordeum vulgare
ttttttttttttttttttttttttttttttggaagagaaccaattttgtattattttcaagacaaacaaatggaacatacacatcaaaaaatcaactgcacgcaacagctcgcttcaataggagtatcatttattcagcaatgaacacacggttattcttcgggaacggcacccacactacttgaacctagccttgacggcatcgatgtcttcgttactgacccggaaggccttggccagcacgtcgctaggcaccggcggcgcggcggcaa

SEQ ID NO: 4901 - DNA, 543 bp, Hordeum vulgare
ggcctgcaggcaattcggcacgagggggcacatggtcttcagcaccgagggcgaggtgccgtaccgggaggggcagtccatcggggtcatcgccgacggcgaggacaagaacggcaagccccacaagctccgcctctactccatcgccagcagcgcgctcggcgacttcggcgactccaagaccgtgtcgctctgcgtcaagcgcctcgtctacaccaacgacgccggggagctcgtcaagggcgtctgctcaaacttcctctgtgatctgaagccgggttcagaagtgaagatcacggggccggtgggcaaggagatgctcatgcccaaggaccccaacgcaaccatcatcatgctcgccacgggtaccggtatcgcgccgttccgctccttcctgtggaagatgttcttcgagcagcacgacgactacaagttcaatggcttggcatggctcttcttgggtgtccccacaagtgacactctgctctacaaggaggagtttgagaagatggtggagatcggcggggagaacttccggctgga

SEQ ID NO: 4902 - DNA, 551 bp, Hordeum vulgare
gtcctcccgggcctgcaggcaattcggcacgagggtttaaaccaacttagagagctctcctctccagacctctcccttctctccgccaggagtctagggttagagagagagagagagagagacagcaaaaacaatctctcgccccactgttataccaagttcttcgcatccatctcactgtcatatatctttgtaacaatgggtggcctatccatggagcacccttgggcattcaccttcggcctactaggcaacgtcatctctttctcgagcctcctggccccgataccaacattctaccggatcttcaagagcaaatccacggaggggttccagtcggtgccctatgtcgtggccctattcagcgcgatgctgtggatcttctacgcgctggtcaagaccggcgagggcctcctcatcaccatcaacgctgccggctgcgtcatcgagaccgtctacatcatcatgtacctcgtctacgcccccaggaaggccaagattttcacagccaagatcgtcctcctcctcaacatcgccggctttgggctcat

SEQ ID NO: 4903 - DNA, 538 bp, Hordeum vulgare
  UNSURE (16),(76): n stands for any base
gtcccccggctgcagnaattcgcacgagcccacacatgagctctcctcttcaaacctctcccttctcccctccagnagtctagggttagagagaggcagagagtgagagaagagcaaaaaacaacctctagccccactgttgattaatttgccagcaggcttgttgtcaacttcatatctgtcttatttcccttcaatatcttcgtatcacaatggctggcctatccatggagcacccttgggcattcgccttcggcctactgggcaacatcatctcttttacgagcctcctcgccccgataccaacattctaccggatcttcaagagcaaatccactgaggggttccagtcggtgccctacgtcgtggccctgttcagcgcgatgctgtggatcttctacgcgctggtcaagaccggcgagggcctcctcatcaccatcaacgctgccggctgcgtcatcgagaccgtctacatcatcatgtacctcgtctacgcccccaggaaggccaagattttcacagccaagatcgtcctcct

SEQ ID NO: 4904 - DNA, 556 bp, Hordeum vulgare
ttataacacgttatatgtttattgcctcaatattataacacgtatgatataacagaacaaaggcattgcataccctgcatgcgggaatctacagcaccgcataccctccaaaaaggttgtatacatattaaagcttgcacgactcatgcatgagccatgcatggctgcatctagaccacctcaacagaacgcgcaaagtccaccgccatcacttgctgccccggcgccgccgcctcagcagcgcatctcctgggaacgtcggcgaccgggcgcacctcggcgcacgagctcttgtcggccttgccgacgttgatcacgacgacgtggtcctctgcgggcaccttccatgcctctttcccctccttggcatcgcttgccacgaccggcgtcgcgttcatgtagaacatgtagaggaccatctggatcatcccgaatgtgaagccaaggatgtttgggagcgcgacgtatttgtccttgatgagcaggccgtagaggaaccagacgacggcgctgagggtgagcgtgagggagagggagaagggcatgtactccacac

SEQ ID NO: 4905 - DNA, 516 bp, Hordeum vulgare
gaactacttctatgagctaattaacaaaaacatggtccaacctgtagaaattggctgtgatggaaaagctcgtgcttgtcaagttcacgatatgatgcttgagctcattatttcaaaatcggtagaagataatttcatctctttggcaggccacggtcaaactgatttggtaaatcctcatggtcttattcggcgactatcagtccagcatattgaccaagagcttgcatctatattggcgaatgaagatctgagtcatgtgcgatctctaacagtgatcgaatcaacttgcatcaaacacttgcctatgcttgttcgttttgaagctttgcgtgtactagaatttcaaaattgtgcgagtgtgaacaagtatgatatggaaggtatagataaactattccagctgaagtacctgagctttaggggcactgacatgtcaaagctaccatcaggaattgtgaagctatatggtctggagacgctagatattagaaatacacagatagaagaattgcc

SEQ ID NO: 4906 - DNA, 533 bp, Hordeum vulgare
ttaactcttatgagacctaacatcaaattaagttacacaagtacacacacacactaattcttataaatagtaataaatgcaacaaattcttaaattacagtattccctgtaaagcaaatagtaccatgtagtagagcaactaacaccacttcctctgtgatgcccttgcgtttaacagaagattccctcttgcattggtagtcaaatgtcatgatataacagttccctgacagctagctctcttcctcgtcagtgtagctttcttccaactcggtcccggatagataacctgggatgattgggatggctatttgcctcgctccttatacaatcagctgcagcagagcagcttacggaagatgtgcctacataattgcaaagagtaaatatggcatctctcagacacgggaggtggccaagtcccaagtagaacccatactcttctgccattgaaacaaaaaaacggcaccacaagcttctccagctttggcagtgccccttcttcaaacgtcaagtaaattgcactttcccag

SEQ ID NO: 4907 - DNA, 497 bp, Hordeum vulgare
ccgccccgccctcatccaagaaggagctcttcctccgcctctccgccggccccgccctcctccaggacaggctcgtgagcgtgtggctggacagggagaccggcgccaagtgctacatgctgtccgccaggaacctctccatcgtgtggggcgacacgccgcagtactggacctggatcccgctcgaggactccaggttctccgaaggtgctcaactcatgaatgtttgctggttcgagatccgcgggaagatacatagcaagatgctctcccagaacacaacctatgccgcctacatggtcttcaagacgaccgataatttctacgggctggattttccggtccaggaggcatcaatcagcgccggagcaaccaactcaacccgcaaggtttgcctccaaggcaacgacgacgatggcggcggcgagggtggggtgcccgagaattacctgcccatgattccatttccgctgcgaagactcaggagaaggaaccgc

SEQ ID NO: 4908 - DNA, 546 bp, Hordeum vulgare
cccgtcacttcatcagtatctaggtaaccatagtctgtacagatatgcttcagcagcaaaaggagaggtgttcaaaaacccacattgcagaaagacatgctttccttattcatttatagtccccccgagcgagtcgaatcctaggagctcctcaatcagccgatttcttgcgtctgatctcgatgccctgcacgatgaggccgctcttccagttcccgcctttcgtctccaccaggctgatggacacctcgccatcgtcgccgcccccctcgttgaggaactcgcccagctccagctccatccacccgtcggtcctttgctgagggaacgtggcattctcttcgtgcgaaactacgcggcggttccttctcctgagtcttcgcagcggaaatggaatcatgggcaggtaattctcgggcaccccaccctcgccgccgccatcgtcgtcgttgccttggaggcaaaccttgcgggttgagttggttgctccggcgctgattgatgcctcctggaccggaaaatccagcccgtagaaattatcggtcg

SEQ ID NO: 4909 - DNA, 428 bp, Hordeum vulgare
  UNSURE (422): n stands for any base
atcgacaaaaaacacagccgtttcagaaaaaataatggccgccgccgtgctccgctgcccgctgctcgcctcgccacttccggccgccggcgccggcgccgcctcctgctccggatactcccgcccatcgcgctcccttctccggcggcgaaggtgcccgagtcccctgctcgccgtctcctccgactcctccaagcccctcgcctcctcctcgaccggcggcggcgccgaccccgacgaggagcccgtcctgcccctcctccaggagctcgcggattgcttggtgctcccgcccaaattcctctccctgctgccccgtgacctccggctcgatctcaatgatgcggcattcgatctctccaacgggcctgttcttaacgagtgtggccaagaggtcggtgatctgctgctggacctggcanaagcat

SEQ ID NO: 4910 - DNA, 438 bp, Hordeum vulgare
ttttttttttttttttgggccaaggtgcttcagctttctcatttgattgaagaacacaggcttgttttcagacgaacaaacaacacttgattatctgtatgtacataacgctccgcagtacacacatcagcgcgcattccgtttcctttttattttcgaggaaaagagaggcttcattcaactcagggtgccatcacagtcttccgctagacgccacacgaggtccacaatttcagaaaccgaagtgcggctagtccgatttgtcctcggggttcatctgcagagccagcaccacgagccccactgccgcggccgcggacaaggcggtcgaagtatagccgagaagcagcagtgggaccttgagcggctggctgtcatctggactgctttgcacgccttgggccagctgccaggagaaaaacccgaaaaccagtccag

SEQ ID NO: 4911 - DNA, 518 bp, Hordeum vulgare
ggctgttggcgatgtgacgaatcggattaacctaacacctgttgctctgatggaggctacttgctttgctaaaactgtgtttggtggccagacagttaagcctgattataaagatgtaccttgtgctgttttctgtattccgccgctatctgtcgtgggtcttagcgaacaagaggctttggcggaagccaagaatgatcttcttgtttacacatcaagtttcaatccaatgaagaacagcatatccaaacgtcaagagaagtctatcatgaaactggtggttgatgctgagaccgataaggtactcggtgcagccatgtgtggaccagatgcagctgaaattatgcagggcattgctgttgcgctcaaggctggagctaccaaggcgaccttcgacagcactgttgggattcacccctctgccgcggaggagtttgtgacgatgcggaccttgaccaggcgcgtgagcccggcatcgaagccaaagacgaacttgtaagcaagatccctgcaatgtt

SEQ ID NO: 4912 - DNA, 550 bp, Hordeum vulgare
tttaacataagggcttatttggcttggaaatacaacaatacccacgatttctgtacaaactgttccacagaaacttattactatcacaatcaaatacgtacaccgtatcaccctttcaggtcaaatgccaagcgcagggctagcgaactgaaacaagagtccacgtctacagttcccgtcgccgcaccagtataattttcgtccaaaacattgcagggatcttgcttacaagttcgtctttggcttcgatgccgggctcacgcgcctggtcaaggtccgcatcgtcacaaactcctccgcggcagaggggtgaatcccaacagtgctgtcgaaggtcgccttggtagctccagccttgagcgcaacagcaatgccctgcataatttcagctgcatctggtccacacatggctgcaccgagtaccttatcggtctcagcatcaaccaccagtttcatgatagacttctcttgacgtttggatatgctgttcttcattggattgaaacttgatgtgtaaacaagaagatcattcttggcttccgccaaagcc

SEQ ID NO: 4913 - DNA, 514 bp, Hordeum vulgare
cactggcaccgggagcagcgccaccaagctctacttcgggaacctgccgtacaactgcgacagcgcgctgctcgccggcatcgtgcaggaccacgccgtcccggagatggtcgaggtgctctacgaccggacgacggggaggagccggggcttcgccttcgtgacgatgagcacgctcgaggactgcgagcgtgtcatcaagaacctggacggcaccctgtacagcgggcgcacgatgagggtgaacatggccgacaggcccaagcccaaggcgccgctgtacccggagacggagcacaagctcttcgtgggcaacctgtcgtggacggtcaccccggagatgctcaccgacgcgttccagcgctgcggcaacgtggtcggcgcccgggtgctctacgacggcgagaccggccggtcccgtggctacggcttcgtctgctactccaccaaggaggagatggaccaggccatcgagacgctcaacggaacggagattgaaggcagggagatcagg

SEQ ID NO: 4914 - DNA, 551 bp, Hordeum vulgare
  UNSURE (14): n stands for any base
ttttaaataagggnctttccccgctccatttcgacgaacgaagtcaccaaatatacaccaggtgaacatatcagatcagcgatgcaagaacgatgttatttgttgctctcagaatgtgctttcatgagcaatcgatggtttatttgttgctctgtataattttgcattgcgaggaagcatcgcataaaccccgagcctgacgccgatttctccaatgtgaagaaacgatcaagctctctagtatctcttccccagggccaagttgaccctgatctccctgccttcaatctccgttccgttgagcgtctcgatggcctggtccatctcctccttggtggagtagcagacgaagccgtagccacgggaccggccggtctcgccgtcgtagagcacccgggcgccgaccacgttgccgcagcgctggaacgcgtcggtgagcatctccggggtgaccgtccacgacaggttgcccacgaagagcttgtgctccgtctccgggtacagcggcgccttgggcttgggcctgtcggccatgttcaccctcatcgtgc

SEQ ID NO: 4915 - DNA, 349 bp, Hordeum vulgare
cgaagcgagggcgtggagggtccgctggaaacaagaaacggatgtcgctgggtctgccggtggcagccactgtgaactgtgctgacaacactggtgccaagaacctctacatcatctccgtgaagggaatcaagggtcgtctgaacaggcttccttctgcctgtgttggtgacatggttatggccactgtcaagaagggaaagcctgacctgaggaagaaggtcatgccggctgtcatcgtgaggcagcgcaagccatggcgccgaaaggacggagtcttcatgtactttgaagacaatgctggagtcattgtgaacccaaagggagagatgaaaggttctgccatcac

SEQ ID NO: 4916 - DNA, 541 bp, Hordeum vulgare
agagataatttcgatcaaaagctctttcaggttcgaacacgccaaatctcagtagccaaaaccacagtgcaaaatcttacgaaagctagcaggccataatccagcagcattacataatccaggaaactcatcctcaagtgccacaagtaataataaactagaagaaaagagggacatgctatcaaagctttgatcatctagctgctccagtgatcagacaatggcgtttgctgcgctggcaatcctgggccacaggtcggcacactccttcccgatgggtccggtgatggcagaacctttcatctctccctttgggttcacaatgactccagcattgtcttcaaagtacatgaagactccgtcctttcggcgccatggcttgcgctgcctcacgatgacagccggcatgaccttcttcctcaggtcaggctttcccttcttgacagtggccataaccatgtcaccaacacaggcagaaggaagcctgttcagacgacccttgattcccttcacggagatgatgtagaggttcttggcacca

SEQ ID NO: 4917 - DNA, 519 bp, Hordeum vulgare
ccgtattttgctttgattattagagcaatcggagtattagaaggtatagctttggtcggagaccctgaatttgccattgtggatgaagcatatccatacattgcacagaggctgctaacggatgaatcacctcgactgaggagtgccttgcgttacacaatatacggcaaaacaggtgttttcgacgcagaaaggttcattgacgttatgcaagctttcgagaatttcattagtgcagcaaagagtggtggaggggaggacatgaagggaaacatggcagagctgggtgctataggattccaacctagcaccagtttagttcctgcattcccgatggccatttcccaacctgaaaatccaatcaaagctcgggctgctctctcttttctactctctgacaggggtgacttcttccgggagttcattcttgatgagattgtgaaagccatcgacgcggtttcaagggagcaattgctacaaattgcttcatcttttggggtcagaaatcccgtcccggtt

SEQ ID NO: 4918 - DNA, 535 bp, Hordeum vulgare
  UNSURE (5): n stands for any base
acatncatgttgctgtacatcattctatcgtcgtgtatgtgtgtgtagtttgtataaaaggaaaaaggagaaataagtctctaatttcctgtcagaaggaaaacaaaactgagatcactttacaaaaatgcttcccggatcacccgtgcgaatacccgtgatgacaaccggctcaagacatctggtaggatcttcgacgagatgctcggtagcacaggtaaaagctcttgcaccagagacacgacatttacgtccccgttgactgtttgatttgccgtcccagccgtcagaaacttggcgaccttctcgacattgttcaagatgatcctgtcttcctctgtgattgtaggaagcaatgctcccgacctcacaggaaccatgccgaaaaccgggacgggatttctgaccccaaaagatgaagcaatttgtagcaattgctcccttgaaaccgcgtcgatggctttcacaatctcatcaagaatgaactcccggaagaagtcacccctgtcagagagtagaaaagagagagcagccc

SEQ ID NO: 4919 - DNA, 448 bp, Hordeum vulgare
gtctccccgggcctgcaggcaattcggcacgaggggaaaaaagcttaacccgccagacatggactcgccgtcgtcgccggcgccagcgacgccgccagccaccggagatgattgtttcgcaaaagaaaagtggcgatttaaactgcggaaaccttccacggctattcatccagcgcgacgatggcgtgtcgttcgatccatcgagccacaacggtgcatgcgtgatcgtgatgctgcaatgatgtcagcagcacatcggttgcatgcacatgagccgtcgcgcgatgctgcgacgccctgtagtggatccctaaacaagacgatgtgcacacaagatgttgagcagactttccagaaaccttccccggctattcgtccagcgcaacggtggcgtgtcgttcgatctgccgagccgcaacggcgcatgcgtgatcgtgatgctgcaatg

SEQ ID NO: 4920 - DNA, 546 bp, Hordeum vulgare
  UNSURE (14): n stands for any base
accgggtgatattncgagggccgcagtaacggggaactgaatccacaccgtggtttatatacgaaattttttagcgctaccagtttggtttcgaaaggtaaagactctagctgcacagcaaaaaagcccagaaggctaatcaaccatgtatagttttttctttttgtgatatggaagaccggcatagcatgtgactggcacgatgtagtaccttctgtcgttcgttcgctgatgatctgcagcagcagccgcggcgtttttcagcgagcacggaagggtcaggtgatgctgaacgccacggtggacggaacctttggagccaggtgggtcgaggccatctccgtggcgtagcggcacctttcttcgtcttccagcctgtgcttctccttcctgaagaaaaatggctccattgcacgcgtctcaagttgcaagctctcgagcacgggcgcccttctcagcagaaagtagaggagctccatcagttccggttctccgctaaaccctttgattaggataatgttgagcctcgcaaacgtcagatcctcg

SEQ ID NO: 4921 - DNA, 10 bp, Hordeum vulgare
  UNSURE (1)..(10): n stands for any base
nnnnnnnnnn

SEQ ID NO: 4922 - DNA, 973 bp, Hordeum vulgare
  UNSURE (20),(641),(642),(647)..(661),(663)..(668),(671)..(686),(697),(698),(700),(703),(705),(707),(709),(710),(712)..(715),(718),(722),(723),(725),(745),(757),(770),(771),(773)..(775),(784),(785),(790),(792),(801)..(804),(835),(857),(859),(929),(933),(963): n stands for any base
gtacagtacagtaacggttncaggatcgggcacggcccttatcaagttcagagcaaaagtgaaatcaacttcatgcgtttcacgggctcggcatcggactaacgcggctagtctagaatctatcaggattcaagtctccactcaaacatcgaagctactacaggtacaacaaacagctgccacaacagagacacaagagtgacaaaggaaatcaaatcagcgctaataatctccggtccactccttccagtccttgtcgatgttctttttttcccacgcgatggcggcgcgagccgcctgaggcgcgccggggaggcccctctctttgatctcgcccttcatgtccaggaacgggtgaaccaggagcgtcccgggtccacagtactcatgttgcaagaacgtgcccaagacctcggtgcagacgtcgacgatgtcctccacgtgctccccgaagtagtcctccttcttctgctccagccgccacgtcatgtgctccctgaacttgctcgtctcctgctcggcgaactcggggatggggtccgggaatttgtagtcccctgcagcccgggggatccactagttctagagcggccgccaccgcggtggagctccagcttttgttccttttaggtgaaaatatnnaaaannnnnnnnnnnnnnnannnnnnaannnnnnnnnnnnnnnnaaaaataaaannanaanananannannnnaanaaannanaaaaaaaaaaaaaaaaaaanaaaaaaaaaaanaaaaaaaaaatannannnataataaannaaaantnaataattannnntaataaataatattaattattaataaatttnatttcttattattataataatnanattaatttaatttaattttttaatatatataattatatatttattattaatttttataaatttttatatntaantattatttttaaattttatattatataaanatttaaataa

SEQ ID NO: 4923 - DNA, 390 bp, Hordeum vulgare
gatcaccgaggcgtggggcgtcgccaaccggcttgacctcgtcgggcccatcgtcgagcagcccgagtacaacctcttctcccgccacaaggttgagtctgagtttgtacctctttacagtacttatggcattgggttgactacatggagtcctctagcttcaggagttctcactggaaaatatagcaaaggcgggatacctcctgaaagtcggtttgccctagataactacaagaacctggcaaacaggtctctggttgacgacacgcttaggaaagtgaacgggctcaaaccgatcgcttccgagctcggggtctcgatggcccagctgggtatcgcgtggtgcgcgtctaaccccaacgtgtcgtccgtgatcaccggggccaccaa

SEQ ID NO: 4924 - DNA, 550 bp, Hordeum vulgare
gaaggatgccgacgaatgataacacacacgggacagcagcacacgcaggaagcgtccgtgacaaatgacaaatggcgtcgtcctcatcaggcccactcgacaacaaaatgtttcacacgctgaacacaccgactacacaggaggagccatgtatagtttcagaaaaccagatacagggagatagaccggccagggaaaaaatcccaccatgtggagggcacacgctgcacagccgataaaaccgagtgcttcatctgtacgactcgaggcgcttgggcttgctctggatgaccgcctcgatcttctccaggacctccggagtcagcagcgggacgacctccagggccttcatgttctccacgatctggctttctttggtggccccggtgatcacggacgacacgttggggttagacgcgcaccacgcgatacccagctgggccatcgagaccccgagctcggaagcgatcggtttgagcccgttcactttcctaagcgtgtcgtcaaccagagacctgtttgccaggttcttgtagttatctagggcaaa

SEQ ID NO: 4925 - DNA, 540 bp, Hordeum vulgare
gtcccccggctgcaggattcggcaccaggatcaatcttagtgaggacatatttgctggattcaattcaacactgcgtgaaggaaacgttacacatcatgaatacatgcaagttggcaagggaagagatgttggtctcaatcagatttcactatttgaggcgaagatagcatatggtaacggcgaacagactctgagccgtgacatctaccgacttggccatcgttttgatttcttcagaatgttgtcctgctactatactaccattggcttttacttcagcacaatgattacggtatggaccgtgtatgtattcctctatgggcgtttgtatctcgtcctcagtggcctcgatgaaggactagccacaggaagaaggtttatacacaacaaccctctccaagtcgctcttgcctcacagtcgtttgtgcagcttggcttcttgatggcactccctatgatgatggagattggtctggagagagggttcaggaccgcattgagcgactttgtgctgatgcagcttcagttagcatccgtct

SEQ ID NO: 4926 - DNA, 527 bp, Hordeum vulgare
  UNSURE (30): n stands for any base
ttataattaataaagtacacaagttataangtacaatcaccaatatcagataagttaagcatacactactactactacaaaccagaccatgcatccatatgattatcttgtgcactactactacattgccaatgcaatttgcagcctggaatacatacatacatactactgacaagccacaaccgctacagccatccagcatgcctacaatcgtctatctaccttactactagctacgacggcaatctatccatctacctatcgtccttgctccgcgccgcccggtccttcttgtgcccacccaggatcctcgagatctgcagaccacggctgaaggcctggttgaagagcatccgagtctggaactcagacacgaacgggaaccacgccaggaacgcgatcggggtgaagagcagcagccccatgatgatctcgtacccacgagctagagcccggatcgacccccacagccccaccctcatgatcgccggcttcagtgcctgagccacgaggagcaggccccatcc

SEQ ID NO: 4927 - DNA, 517 bp, Hordeum vulgare
gcatgtcgtgtcgggaaccccgggcagagtatgtgatatgatcaagagaaggacgttgcgcacaagagccatcaagctcctagtcctggacgaagccgatgagatgttgagcagaggtttcaaggatcagatttatgatgtctacagatatcttcccccagaactccaggttgttttgatctctgcaactctgccccatgacatcttggagataactagcaagttcatgactgatccagtcaggatccttgtaaaacgtgatgagttgaccctagagggcatcaaacaattttttgttgctgttgagaaagaggaatggaagtttgatacactgtgcgatctttatgatacacttaccattacccaagctgtcattttctgcaacactaagagaaaggtggattggcttactgaaaggatgcgcaccaacaacttcacggtgtcagctatgcatggtgacatgcctcaaaaggaaagggatgcaattatgaatgagttcaggggtggcacgactcgc

SEQ ID NO: 4928 - DNA, 550 bp, Hordeum vulgare
  UNSURE (72),(73): n stands for any base
gtatggcgtcaaatacgagacacaaaagagtgttttacatgggctggtcaatccaagaaagaatatatacanncttccatgttcccaaagcaacaaaagaaatctcaagttacagcaccacaaatacagccaaacatcccaaccaaatccccacacgcactgacgacaaagagagagcccggtccagagctcagataagatcagcgacgttcatgggcatctcgtcgatctgcgtgctgtagtactgttcaatgtcccggaggatacggatgtcgtccttgcgcacaaagttgatcgccacacccttgcgcccaaaacgcccagagcgaccaatacgatggatgtaaagctcacggttgttcgggagatcgtaattaatgacaagggagacctgctggacatccagccctcgagcccaaacatcggttgtgatcaggacgcgagtcgtgccacccctgaactcattcataattgcatccctttccttttgaggcatgtcaccatgcatagctgacaccgtgaagttgttggtgcgcatcctttcagtaag

SEQ ID NO: 4929 - DNA, 551 bp, Hordeum vulgare
  UNSURE (20): n stands for any base
gtacccccgggcctgcaggnaattcggcacgaggctggagggcagtcatggacggctgaatggttgaagtttgataacagctacttcaaggacataaaagagcaaagggatcaggagcttctagtattgcctacagatgctgcactatttgatgacccatcattcaaggtatatgcagagaagtacgcagaggaccaggatgcattcttcaaagactacgctgaagcccatgctaagctgagcaaccttggtgcaaagtttgatcctcctgagggattctcgttggacgatgacaagggtgccgcggcaaccgacgagaaggcggttgctgatccagagccaacggttgttgctccagagccaaatgctgttgctccagagccaacggttgctgcaccagccccagcggatgctactaatggcgcaggaccgcaaccagagcccttcgttgccgccaaatactcttacaagaagagagagttgtccgacacgatgaagcagaagatcagagccgagtacgagggccttggaggcagcccggataagcctat

SEQ ID NO: 4930 - DNA, 543 bp, Hordeum vulgare
ccatggtttcagcaatttactaggtttgcctcactttacttcaaatgatgaaaactcaagacaacgtaagatgaccaaaagcattgccttagtcatcttgcatgtcggcacaccagtccctggaaaatggttaattacaccagatgaaaaagaagaaagactcatcagaccatcgatcttagttcccgaccagagacgtcaagaatgccaatcctgcgatcacgatcataatgttgaggaagtagttggactgcataggcttatccgggctgcctccaaggccctcgtactcggctctgatcttctgcttcatcgtgtcggacaactctctcttcttgtaagagtatttggcggcaacgaagggctctggttgcggtcctgcgccattagtagcatccgctggggctggtgcagcaaccgttggctctggagcaacagcatttggctctggagcaacaaccgttggctctggatcagcaaccgccttctcgtcggttgccgcggcacccttgtcatcgtccaacgagaatccctcaggaggat

SEQ ID NO: 4931 - DNA, 960 bp, Hordeum vulgare
  UNSURE (737),(960): n stands for any base
gtcttcccgggcctgcaggcaattcggcacgagggcacagagagagagagagagagagagagagagagagagcgagagagagagagagagagagagagagagacagagagagagagagagagagagagagagagagagagagagagagagagactcactctctctctctctccctctcccccccccactcttaccctctccctccccacctttcccctccccactctcccctccccgcccgctcgcctctgcgcgcgcgcccccctctctgcctacatgcgcgcgtgtgcctgcccttcctccacccccccccctagtccctctctgttccccctgtctgtctctccctctcccgggtgaccgttctccctcccttttctctctatctttctctctctctctcagtcacacactgcgtctctctctgtgctcgctctctctctcattctcaccccgcatgctctcacgctctccgttcccctctttttctctctttcgctctctctctcttccaccccccttgaacacagacccacacacttatagttttctttgccccccctcccccacactgttagaggccccctccctcctctctctatctcccgcccccccgtcttccccccacacccccgctcttgtttccccccagcgcccccctctccctctttactttctggctcaccccccctcgcccccccatttactctcttttgcccccgtgccagttggattcnttatcccccgtcccctcttctctctttcctccccctcttcttccctcctcttttttttttgcctctttaagatataatctctttcccccttcccccccccccgccccccggggttcgtctccctccttttccccccccccccactttcctcgctttatttttcccccttttttcctcttttccccttcccccctcttttttcctccgctctccttttcccccn

SEQ ID NO: 4932 - DNA, 548 bp, Hordeum vulgare
  UNSURE (35): n stands for any base
cccacaaaacccgtgtttatgttacatgcccaggnacaagttttggggtttaattacacagccagcacgcataaacgtccacacgttctgcggcatcaggtggacgagacgacgacgctcatcgcctcaatttacagttctgccgatgtctccatgcaatgcaatacttagtttcaggatacaccgtgcgtcgacgggggcgttatcatcagcccaatcgagcatttccatgggcagccggactcgggtggttgccggcgacaaggatgtctttgatccggtttagcggtacggcagcctggttgattctctccttgctgctggcaggttgcactttgacctgctgaagctgcagcttgcccttctgccagcgccgtcggaaatacgccatccccatcaaagcggcagcagccacaacgataggccacagcttgttgctctccttagcgctcctgtacagcgatataagttgcttctgccaccacacgttgcgtggggctccagaaccgtcaggcttgctctcttcgccagaagcaacaacattggac

SEQ ID NO: 4933 - DNA, 524 bp, Hordeum vulgare
aaaccgttaaaggacgagcccaactcggggtgggagcatttgccgacgctctacttgttatccccaagacgctagcggagaattcgggtttagatacccaggacgttattgtctccctagagaatgagcacgaccgtgggctggtggtggggctgaaccataacactggcgagccggttgacccggagatggaaggcatctacgacaactactcggtgaagcgccagatcgtcaattccggacccatcatcgcgtcgcagctgttgctagtggacgaggtgatcagggcaggccgcaacatgaggaaaccgacctaaacatagcgctcgctcctttcaggccgaggcgagagtttttgtttggctgttttgctctctggtgtgccgagtagcgagtagtgatgcggtggggtggggaatgcttgaacggaagagattgtacttgttgtgacagtgtgtgcccttgtggtgtcgatctgtttctacgctcgtgtttgtatgcagaatgttttgctggatcaagtt

SEQ ID NO: 4934 - DNA, 547 bp, Hordeum vulgare
tgaccagtgaaatgcttacttccttttcggaaactcctatggtttttcaaggttaagagagcacaatgcactaaccaggattgattataattcacccctacgacaagacagaatggattacataattctaacagaaacgagaaccaaatcgccgaaagcgcgcacaaaaaatacatagctactcaacttgatccagcaaaacattctgcatacaaacacgagcgtagaaacagatcgacaccacaagggcacacactgtcacaacaagtacaatctcttccgttcaagcattccccaccccaccgcatcactactcgctactcggcacaccagagagcaaaacagccaaacaaaaactctcgcctcggcctgaaaggagcgagcgctatgtttaggtcggtttcctcatgttgcggcctgccctgatcacctcgtccactagcaacagctgcgacgcgatgatgggtccggaattgacgatctggcgcttcaccgagtagttgtcgtagatgccttccatctccgggtcaaccggctcgccagtgtt

SEQ ID NO: 4935 - DNA, 10 bp, Hordeum vulgare
  UNSURE (1)..(10): n stands for any base
nnnnnnnnnn

SEQ ID NO: 4936 - DNA, 549 bp, Hordeum vulgare
aggtttatttcacgataagagatgatccgcaccggtagcaaaaacaataatacattacaacaagtgttaatccaacatgaacgatgtacagtccatcgacgagagagttgtacaatctgcgttcttgtcccggtccgggcccgagctgtcggcgaaaacgccggttagtcgcagccgctcatggtaggcacgtgcctgccagcagatcagaccacagcttgctcaccaatcgccgtgccaccgtcaccatcctctcattgacttgaagccagacttgttattagtcgaaccaggcaacattttccttgcaggtttgagtatttggaaggagcacatcagcgtctcgtctacactcatcatggcaccggcattatcgaattccccacagtaattaggcgctgaaaatattgtaactagctgacgatcagcaaagaactcgtaaccatcctcaacaacctgatgggctcggcagatgaggtctaaatcatgcttctcaaggaattcagccactttatcaggtccaaatgtatatgagacacctcgatcatt

SEQ ID NO: 4937 - DNA, 518 bp, Hordeum vulgare
gtggtattgaagcagaggctacaatgcttgggcagcccatgagcatggttttgcctggtgtggtcgggttcaagttgactggaaagctaaggaatggtgtcactgccaccgaccttgttcttactgttacccaaatgctaaggaagcatggtgttgttggcaaatttgtcgaattccatggtgaaggtatgggcaaattgtctttggctgacagggccacaattgctaacatgtcaccagaatatggagctaccatgggcttctttcctgtagaccatgtgacattagattatctcagattgactggccgaagcgacgaaactgtttcaatgatcgaagcatatctacgagctaataatatgtttgttgactataatgagcctcaagcagaaagagtttactcttcgaatcttgcgctggaccttgatgacgtagagccttgcatttctggcccaaagaggccgcacgaccgtgtcactttgaaggaaatgaagtcagattggcatgcttgcctcgac

SEQ ID NO: 4938 - DNA, 542 bp, Hordeum vulgare
gggaaaggatactttcttttttagggctaataaaaaaattacaaggatttacaagaaacacaccttacattgtactcccttcgtaccaaaataattataattaaggagaactagcagaggaagtaaaattttattaaaaaacaaatacactttatagaaaggaacaaagagaaccctgattttgtaacttactttagtaaataaaggttactacaggtatgcaaaaccaggcagtcgattggtcgagcaaaagattaaaaaaaatactcaagattgctaccagttcaaatttgtttttagcacaaagcaatgtaaaccaggctctaccaatttaatccaccacaactgaagatttgttcaaaatgaacacatgtttcataaccacaaccaaactccccccaagtcgacctgcgcccacgccaggcatggaaatgccagctttattttcggtttattcataaggccacaacataatgagcaaactcttgatgtccacggtggcactaacaagactgccatgccgccatctaggtcgaaaaggg

SEQ ID NO: 4939 - DNA, 549 bp, Hordeum vulgare
gttccccgggcctgcagggaattcggcacgaggctcaccccatacatccagactctaggaatagaccatgccatggcgtccttcatttggctttgtgggcctattactggttttgtcgttcaaccttgtgttggagtctggagcgacaaatgccgctccaagtacgggaggagacgacccttcattctcgctggatgcgtgctgatatgtgcagctgtaactttagtcgggttttctgcagaccttggttacatgttaggagataccaccgagcactgcagtacgtacaaaggtctaagatatcgagctgctattatcttcattcttggattctggatgttggacctggcaaacaatacagtgcaaggacctgcccgtgcccttctagccgatctttcaggtcctgatcaatgtaattcagcaaatgcgatattctgctcatggatggctgtcggaaatgtacttggtttttcagctggtgcgagtgggaattggcacaagtggtttccttttctaatgacaagagcctgctgtgaagcttgtggtaac

SEQ ID NO: 4940 - DNA, 526 bp, Hordeum vulgare
  UNSURE (18): n stands for any base
aaaaataaaacagtgtancatcttttacaactttgcatatgcacacatgcctaactacctctctatcctaaactctctatcttatctttagtcttattgtgtatctgacaaaatgaatcatttcccatataaacgaatgacaaaatggggatgagggtttagttgtgttcaggctgagtatctgtagatgttacacacagcagccggcttccggctctgggttctgtgttttcagcccatgtggaatccggcggattggtagttgttcgacagcttgggtagcttgatcaccgcgagaactccggctgccagtgagaagaccgaggccaaggcgaatgccgggatgttccctcccccgaagagcaggtcccatgggcctgctccgagcgacactactatctgaggagcgacgatggcaagattcaggactccagtagccaaaccttgtccgcctcctgttccggcagtcagctcagcagtcaccgagaacggaacgctgtaagtgatcgaaagtggcaatccaaga

SEQ ID NO: 4941 - DNA, 962 bp, Hordeum vulgare
  UNSURE (664),(692),(699),(844),(920): n stands for any base
tgtcccccgggtctgcaggaattcggcacgagggaaagaacatgagaaattaaaagaaacttctgatgaaattggtggtggcaattccagtcgtaggcggactgatgatgattctcattttatgaatttagttggttattcggaagactcagatgaggacgattctgtccaggtagctgatgttggtgatgtgggatgtaaagaaactactcctgatggcatctcagctgtcgctagagaagcagaaccaggagatggaccctgcacagagcctacttgtgaaactgctgttcatgtgaacgaatgcagtgcggaagctgctatttctgaggatggtcacgccacaacggcccttggcagcgtccgagcgtcttcaacggaactaatgaatttggagagtgtatctgcttgcaatgttcatcaaaaccctctgaacaaagaacttagttatgctgtttcagtaactcctgactctgttgagcacgatgacacagtagtacctgtggctctccaggaaggagctgctgtcgctacagaaccagaagcaaagaaagaggtcgacgaacctacccaaatgaaaatgttgagccggctgctataagccagagtttgtggagcatgctggtacagaagctgatccaagtaaagaagcatctatacctcnagagaaaccactgtagccttggttgcangacccgnaaaaaatgaagaagcagatgcacctactcaagtcgaaccagttgccttagtgccagattccgtggagcatgctggtccaaaagttgatcaaatattggaacgtctgtgggttctccagacgaactttttgttgtccctgttacgnaaccagagagaagaaggtaaaggcatccgttcagaggatatgctgaaccattgcccgaaaacccaaacctgctggnacccaggaattgcaaaaccttttataaacccagtcttatgaa

SEQ ID NO: 4942 - DNA, 510 bp, Hordeum vulgare
  UNSURE (55)..(60),(85)..(90),(179)..(183),(273)..(279),(502)..(506): n stands for any base
caaaactcgtgtatatttacatgcccaggagaagttttggggtttaattacacannnnnnacgcataaacgtccacacgttctgnnnnnncaggtggacgagacgacgacgctcatcgcctcaatttacagttctgccgatgtctccatgcaatgcaatacttagtttcaggatacacnnnnngtcgacgggggcgttatcatcagcccaatcgagcatttccatgggcagccggactcgggtggttgccggcgacaaggatgtctttgatcnnnnnnngcggtacggcagcctggttgattctctccttgctgctggcaggttgcactttgacctgctgaagctgcagcttgcccttctgccagcgccgtcggaaatacgccatccccatcaaagcggcagcagccacaacgataggccacagcttgttgctctccttagcgctcctgtacagcgatataagttgcttctgccaccacacgttgcgtggggctccagaacnnnnnggct

SEQ ID NO: 4943 - DNA, 337 bp, Hordeum vulgare
gcaaggcggagagcccaactaaacaccaactcccgccgccgccgccgccgccgccgacatgccgccgtccctcctactacccgcctcctcttgtactagtatgaggttgctctctccgcagcatcgttggtcaactcccccgcccccgctcgtttcctcctccttctccgcgcgccgcccttatcccggcctccgcctcgccgccgccggaaccaacggcgtcaacggggacgccggcgccaacaacaacctgcccaaaaaccggagggatattctcctcgaatacgtaaaaggtgtccagccagagtttatggagctcttcgtcaaaagagcccca

SEQ ID NO: 4944 - DNA, 441 bp, Hordeum vulgare
taaagattttagttgcatttaccagctcaagagcacttctacctgtttggaaggacatcttgacaatgccccctgttggttttcaagtccccaaaaatacaaaatttcttttttctatctgaataccaactaacacaacacagaacaatatatatccgtacaaaaaaccacacatctcagcagaccaaactaacaaatctgaaactcaaccgtactcgctgtggctatctagcagctatagttgtgtctgcgtgttgtctccagggccaggcggcagctcgccccccatcttgggggcggcgcccagcactctctccatgtcaaaacgcacctcaatgttgcgcatgctgtacccgacgatcatcagccagaacagcaagttcgccagctgagcaccgctcgtctccgacaccgccgtcttcatttgcgcagggtccgaga

SEQ ID NO: 4945 - DNA, 486 bp, Hordeum vulgare
tcgagcgcatcgtcgacaggctcgacgtcgtctggaacgtcgtcgaccacctcaaggccgtcaaggactcgcccgacctccgctccgccgtcgaggacgtccagcccgagaaagtgaaattctacctgagactggggcagagcaagcctatctacgaggccttcaacgccatcaggaattcttcagactgggacagcctcagcgacgcccgcaagcgtgtcgtcgaaggccaaataaaggatgctgttcttggtggagttgcgcttgaggatgagcagagagagaaatttaatcaaatccaacaggaacttgaaaaactgtcagagaaattcagtgaaaatgtgttggatgcaacaaagaaatttgagaaattggttactgacaagaaagaaattgatggtttacctgcctcagctcttggcttggcagcacagactgctgtttcaaagggacatgaaaatgcttcagctgaaaatggaccttgga

SEQ ID NO: 4946 - DNA, 502 bp, Hordeum vulgare
cgacttcacatggaaataaattatcctaaaagttggtgcggcaaacaaaaaagaaaaagaacgatcgacaccctatgcagcgacaggtagcaagccgttgtgcctaagcagtggctccggcgaaggctcccgtcctcggaaagcgacgaaaacctcgagtggagattttccacctccaagtgcaagaaccgtttctctgaatcgtctgccggtctcctcaatggccttctcgttatccagaccagcatcttcgaatgctgagaatgcatcagctgatagtacttcagcccacttgtaactgtagtatccagctgcatagccacctgcaaaaatgtggctgaatccacacaggaatctgtcctctggcagaggagcaagaacctgggttttttctgcaacccttcggtcaacatcatatacagacactggtccacttggatcataagttgtatgcagctccatatctacacttgcaaaacgtatctgacgcagactgaaggtg

SEQ ID NO: 4947 - DNA, 10 bp, Hordeum vulgare
  UNSURE (1)..(10): n stands for any base
nnnnnnnnnn

SEQ ID NO: 4948 - DNA, 561 bp, Hordeum vulgare
  UNSURE (8): n stands for any base
ggtctttnttgacagatgatttacagggtgtcgaaagagcatgtaaagtttcctaaaagagaaacctttatttgctaactgaatgaatgattgttgcagttccagtggccaccttcaaagtgcttacttctgagaagaaaaagaaatctcaacctccatctccatggaaggcaagtggaatcagctgcagaccataaaagagaagatccaaagatgttgacgtgcaaagagaaggtcaccgaggaaactgttttgccttcaatatctggactgggccaggagcaaaacactctagtttctaatttgtgtttttctttcttacatgcacttcatcttgtacattcttcttattcgcaatcatacaaccaaataatctcatcagtgctacataaagacaccgactgcagttgacgactgaatcctgaatttcaagactacccaattccatcaatgaaatgtcaggtttctacttctacatacggcttttctccataaaactggtgcttgctggtgaatggcatctttccagagcaatacaatgaaatgaaatggaatggtggc

SEQ ID NO: 4949 - DNA, 470 bp, Hordeum vulgare
ggcgccgagatcgtcggcacgttcgtgctggtgtacaccgtcttctccgccaccgacgccaagcgcagcgccagagactcccacgtccccattttggcgccgctgccgatcgggttcgcggtgttcctggtgcacctggcgacgatccccatcacgggcaccggcgcggcgctggcggcgatctaccacgtggtggtgatcagggcgatccccttcaagagccgcggctagtggaccaatcagtctgggcggccatggatggaatcttatcgctgttcatcgtcgaccgatcatgtggtggtggtggtggttgctggtgcgcgcgtacgtggatcgtgtctcggccgcgcacgctgtaatagttctcaaatctgccgtctctcctcggtgtgtgtgcctgccggcagcgtcgcctgttcaagtctgcgagtttcagtcagtatagtacctgctgtactactttcccaaaa

SEQ ID NO: 4950 - DNA, 466 bp, Hordeum vulgare
gggaaagtagtacagcaggtactatactgactgaaactcgcagacttgaacaggcgacgctgccggcaggcacacacaccgaggagagacggcagatttgagaactattacagcgtgcgcggccgagacacgatccacgtacgcgcgcaccagcaaccaccaccaccaccacatgatcggtcgacgatgaacagcgataagattccatccatggccgcccagactgattggtccactagccgcggctcttgaaggggatcgccctgatcaccaccacgtggtagatcgccgccagcgccgcgccggtgcccgtgatggggatcgtcgccaggtgcaccaggaacaccgcgaacccgatcggcagcggcgccaaaatggggacgtgggagtctctggcgctgcgcttggcgtcggtggcggagaagacggtgtacaccagcacgaacgtgccgacgatctcggcgcc

SEQ ID NO: 4951 - DNA, 518 bp, Hordeum vulgare
gcttgccagttaccgaaaacccgatttggagaagtcagatattaaaagcaaaacagatgatcagcaggaatctttaaaggtggatgaatatgaatcatgtgaaaaaggtgcccctgaagataagactgaggaggaggatgtttgcccaatctgcctcgaagaatatgatgaagaaaatccccgctccattaccaaatgtgaccatcatttccatctctgttgcatcctcgaatggatggagcgaagtgagacttgcccagtctgtgaccagataactttgatagatgagatgtacgaatagcatgttgaccccggcggatcctctctaggagctcttgggtgcctaccgaggaggtttagtactagtccttttttctatgggggaagtaaaaccagcaactattctgctcctaatatgatagtatgatctggtggaggtgctactggaatgcatcttgggagaacaaaatgggaaataatgaaaggaaggaaactggaagaaatatgctctaaaaaaa

SEQ ID NO: 4952 - DNA, 548 bp, Hordeum vulgare
tacggcgtaaggatatacaaatgaaaaccatagttagaagcagttcttttatacttgctgtcaccctatatctagtatgtgatggttatacagacgctcaatccgaaaacgcgagccaaaatccagaaagcatgaaaaagagagctagattcaagagttttcgactagtatgaagtgcatattgcagatgcagcctgctaatcctcctgttaccataaacagccacagcttgacacaaatgctagtataaacgcagagatggatgtttttttagagcatatttcttccagtttccttcctttcattatttcccattttgttctcccaagatgcattccagtagcacctccaccagatcatactatcatattaggagcagaatagttgctggttttacttcccccatagaaaaaaggactagtactaaacctcctcggtaggcacccaagagctcctagagaggatccgccggggtcaacatgctattcgtacatctcatctatcaaagttatctggtcacagactgggcaagtctcacttcgctccat

SEQ ID NO: 4953 - DNA, 520 bp, Hordeum vulgare
gcctccacctctcaacaaatccaagccaggccaagcaaagctcggcgaagcgccggcagcaatggagggcaaggaggaggacgtgcgccttggcgcgaaccgctactcggagcgccagccgatcggcacggcggcgcagggcggcggcgccgacgaaaaggactacaaggagccgcccccggcgccgctcttcgaggcggaggagctctcctcctggtccttctaccgggcagggatcgccgagttcctggccaccttcctcttcctctacatctcggtgctcaccgtgatgggcgtggtgggcaacccgtcggggtccaagtgcggcaccgtgggcatccagggcatcgcgtggagcttcggcggcatgatcttcgtgctcgtctactgcaccgccggcatctccggcggccacatcaaccccgcggtcaccttcgggctgttcttggccaggaagctgtcgctcaccagggccgtcttctacatcgtgatgcagtgcctcggggccatatgcggcgcc

SEQ ID NO: 4954 - DNA, 552 bp, Hordeum vulgare
  UNSURE (21): n stands for any base
ggtaattattccttatatggngcacatagccctttattaacccaaacacattttacatcatttttaccgtgctttacaaatttgcaccaaaaaccgtgaccggaaagcattcaaaactagaaaataagctatatgatgaaacatacatttcaagagcaaggagaaaatacaacaaaaataagaagactccatccacagtcggcagattgatttgtcgactagtcgcggctcttgaaggggattgccctgatcaccaccacgtggtatatggccgccagcgccgcgccgatgaacggacccacccagaagatccagtggtcgtcccacgcctgcttcttgttgtagatgatggcggcgccgagggacctcgccgggttgatgccggtgcccgtgatggggatcgtcgccaggtgcaccaggaacaccgcgaacccgatcggaagcggcgccaaaatggggacgtgggagtctctggcgctgcgcttggcgtcggttgcggagaagacggtgtacaccagcacgaacgtgccgacgatctcggcgcccaaccca

SEQ ID NO: 4955 - DNA, 26 bp, Hordeum vulgare
tttttttttttttttttttttttttt

SEQ ID NO: 4956 - DNA, 395 bp, Hordeum vulgare
  UNSURE (348): n stands for any base
tgggtaaagacaagccttgcccctggatctggggttgtcactaaatacttgctaaagagtggccttcaagaatacttcaacaagcagggattccatcttgttggatatgggtgtaccacgtgcattggcaattctggtgatctcgatgaatctgtatcagctgtcattacagaaaatgatgttgttgctgctgctgtgttgtcgggcaaccgtaactttgaggggcgtgtgcaccctttgactcgggctaattaccttgcttcaccgcctctggttgttgcatatgcacttgctggcactgttgacattgattttgagaaggaacccattggtgttggaaaggatggncaggaagtttacttcagggatatatggcccacaactgaggaaattgc

SEQ ID NO: 4957 - DNA, 426 bp, Hordeum vulgare
actccccctcgcccccatgccggacgccccccactgaccgggccaactctccccgccgccgcccgcttcttcggcttttttcctcgacgggctagctcttctcccgcgggattcgatcgcggcaactccagctcaagaaccgcggctgaatttcaggtggcgcgggattgatctcggatgccgccgaggttgactggatctttcctcccctgctcagacacgccgccgccgccgtttcagactggccggattaagcggcgctaactaatcagctccgcttccccacctgcgcgctaaccgcagctccaatgccgccaagattgtagcctccttcgtaactatcacatgctggaccggatggcgcccccgagattcagatgcggagccggcgcgcgccggctgctgctgctcgcgctcgcgcccttc

SEQ ID NO: 4958 - DNA, 405 bp, Hordeum vulgare
tttttttttttttttctttaaagatgaacgcatcatctgaaaaaattatgggggaaaagcataagaattgttcgatctattctcatcgaacatatctgaatacaagaatgttcctgctacattttcatactacctacagtccaatgatcaaaggaagcttatgctacctccactaggcatgcaattaattagttcttatccacttcctaaatacatttctgaattcctcttcctcttctcctgccagacaaaaccttattgccactgctgatgagatcatcacagatatatctcctggatatgtaattctccatgaagaatcaaagttcatcatcatcatcaggaatgctcttccctctcttactgctggaatacggcaccgtatcattgccagatatggaaccc

SEQ ID NO: 4959 - DNA, 231 bp, Hordeum vulgare
gccaaggacgacggcacgctggcctccttcgtgggcttccgcgtgcagcatgacaatgcccgcgggcccatgaaaggtggcatccgctaccaccccgaggtgagccaatctcgtgggattgtcttgctacttccgtcaattcgattgcgatttctcctgaaaggctaaaacaagacgcgtccaaatagctttcaaaaaggctaagcagattgacgcacgcaaaaaaaaaaa

SEQ ID NO: 4960 - DNA, 519 bp, Hordeum vulgare
gatcttctcctcctaacaaccgagccaggctcaagcggcggcgatggagggcaaggaggaggacgtgcgcctgggcgcgaaccgctactcggagcaccagcccatcggcacggcggcgcagggcggcggagccgacgagaaggactacaaggagccgcccccggcccccttcttcgaggccggggagctcacctcctggtccttctaccgggccggcatcgccgagttcctggccaccttcctcttcctctacatctcggtgctcaccgtgatgggcgtggtgggcaacccgtcggggtccaagtgcggcacggtcggcatccagggcatcgcgtggagcttcggcggcatgatcttcgtgctcgtctactgcaccgccggcatctccggcggccacatcaacccggcggtcaccttcgggctgttcttggccaggaagctgtcgctcaccagggccgtcttctacatcgtgatgcagtgcctcggggccatatgcggcgccggcgtggtgaaggggtt

SEQ ID NO: 4961 - DNA, 512 bp, Hordeum vulgare
gccgaccgcgccgtccatcgtcctccacgaccccgacccggcccgcccgctcctcccgctcgccgtcgccaagatcctccgcgccctcgcgctccaggagagccccggcctcctcatcctcggcaagcaggcaattgatgatgattgcaaccaaacaggacaaatgctagctgcattgctcaactggcctcagggaaccttcgcctcaaaggtgataattgacaaggataagcaaaaagctactgttgagcgagaggtcgatggtggaactgagacaatctgcttggatttaccagcagtgatcaccactgatctgagactgaaccagccccggtacgctacgctgccaaacataatgaaggcgaagtcgaaggtgatcaagaaagtaacccctgcagacctgaacgtcgatgtcaggtcagacatggaggtgctccgggtggacgagccgccaaagaggaaagccggggtgatcctctcgtctgtcgacgagcttcttgataaactgaaaa

SEQ ID NO: 4962 - DNA, 547 bp, Hordeum vulgare
ggggaggaacacatctttatttatttgtttggaattgcactttatttgggtgtacatatgtgaactagttacaggacacgagcttcgtttttcagtttatcaagaagctcgtcgacagacgagaggatcaccccggctttcctctttggcggctcgtccacccggagcacctccatgtctgacctgacatcgacgttcaggtctgcaggggttactttcttgatcaccttcgacttcgccttcattatgtttggcagcgtagcgtaccggggctggttcagtctcagatcagtggtgatcactgctggtaaatccaagcagattgtctcagttccaccatcgacctctcgctcaacagtagctttttgcttatccttgtcaattatcacctttgaggcgaaggttccctgaggccagttgagcaatgcagctagcatttgtcctgtttggttgcaatcatcatcaattgcctgcttgccgaggatgaggaggccggggctctcctggagcgcgagggcgcggaggatcttggcgacggcgagcggga

SEQ ID NO: 4963 - DNA, 518 bp, Hordeum vulgare
cgcttccgagtccacaatgtgggagtctcgacgagcttgaacctgaggatccagggccacaacatggccatggtggagacagagggctcgtacacgatgaagcagaatttcaccaacctcgacatccatgtggggcagtcctactcctttctggtcaccatggaccagaatgcaagcagtgactattacatcgtggccagccctcggttcgtgaacgagtcgctctggaccagggttaccggtgttgcaattcttcactactcgaattcaaagggcaaggcatctggtccgcttcctgacccaccgaatgatgagtacgacaaaagtttctccatgaaccaggcacggtcaatcaggatgaacgtgaccactggtgctgctcgtccgaatcctcaaggatcatttcactatgggcaaatcaacgtgacccaagtgtacaagttgaggaatatgccccctgttaccatcaatggcaaaaagcggacgacactgaacggtatctcctattcaccgcctgc

SEQ ID NO: 4964 - DNA, 550 bp, Hordeum vulgare
ggtaaaaaaatggtcttgcgaatacagctgacacggcagcaaacaagtatccaagtcttgtttcacaggaacaggacagggctagctaaaaatcatcatcctcaaggtggcggcacggtgaccccgcaatgcccccaattgcggggtcacgggcagcagtaagtaagtaccacgcaaacaattcgacgcgcacacaactctgttaacaagtttcgacaaattcgccgatgcgcaaataatggcaggacctctccacccaatcgacggatcaccccgcaaactcaacctacattctcaatttcctaataactcacaaatagcagcagatcacttcacttcagtgtccgacgaccgacaacatgaccagcgacaccaagacagccagcaggtagcggctctgtcttaccgcgggggaagccgagctcgacgacgacccatgaggcttctgagccttttgtttttccttgaggaggccacagaagagggcgttgtctggtagcaccgattcagtcacgttatagcctccgtcaggatccaccaccctgatgta

SEQ ID NO: 4965 - DNA, 517 bp, Hordeum vulgare
ccgctgtaacgaggctgatgtcggctacaactgcagcaccagcggcggcgccgccaaccgtggcgcgctcggccccttcggactcctcgtccttgctgacggtgccctccaggagcagacggccgtgtacttctacgtgtcgaggggcctcgatggaggcctccaaacccatttctgccaggacgagtcgcgatcgtcgctggcccaggacgtcgtgaagcgggtggtcggtttcaccgtgcctgtgcttgacggtgaggatctatccctcagggtgttggtggaccactcgatcgtggagagcttcgccatgggtggcaggtccacggcaacgtcgagggtgtacccgacggaggccatctacgccgccgcaggcgtgtaccttttcaacaacgccaccagcgccgccgtcaccgtcgagaagctcatggtgcatgagatggacgactcctacaaccagatcttcacggccgaagacgcctcagccgccttgtagctgaaattaatcaagctcttg

SEQ ID NO: 4966 - DNA, 539 bp, Hordeum vulgare
  UNSURE (39),(43),(44): n stands for any base
atttcattttcgaaaatttggtagcagcgcaaccgcgtngccnncctctcgttccccaaataattccatttacaattgattgatcaatatgatcatcatcatcatcatagtcccgctgcaggatacatatccatcctgccagtagttacacttggaaggcagtgatcatcctgccaacaaatcatctacctaattcatctcgccaagaacccaaaaatccaaaaagaaaaaagaaaaaaacaacaacaaacaaacaaacagacaggaagatgactagagtacgtagctagtactccatctccatccatccatgagggaggaagcttccgatcaatcaatgtgatcgatcgaatcataacatgttgtataggtgaatatgcattacctggccaagagcttgattaatttcagctacaaggcggctgaggcgtcttcggccgtgaagatctggttgtaggagtcgtccatctcatgcaccatgagcttctcgacggtgacggcggcgctggtggcgttgttgaaaaggtacacgcctgcgg

SEQ ID NO: 4967 - DNA, 551 bp, Hordeum vulgare
gtcctcccgggtctgcaggcaattcggcacgaggctgcgctgctccggtggtctccgccgccagtgtcttatacacgcctggagcggaactcatgagcgggggcaccgcagttagtgccagcctgcggacagccctgtcgtactgcgtccagcaggtccggagctatgactaccacaactacctctgcctgctccacctgccgcccgcgatgcgcaaggccgcgttcaccttccgggccttcaacgtcgagacggccaaggccatggacgtcgtctccgacccccgcaagggcctcatgcgcctcctctggtggaaggatgtggtcgacaaggtctacgccaacaagacggtcgagcaccccgtcgccctcgcgctctcctcgctcctctccgagcagaaggtcagcaagcactggctcaagcggtcgctggaggcaaggataaacgacgggaaccgggacgacgacgccattcctgagaacatcccggagctggagaggtacgcggaggacacccagtcgaccatcctgtacatgacactgcaggctggt

SEQ ID NO: 4968 - DNA, 553 bp, Hordeum vulgare
ttaaaattgctcagaaacagcagttggagcaggcagcagagcctttcttcattatcaagcttattacattccagtaaatgaataccctgggttcagtctgagctaaaacgcacgctgacctgcgctttcaacaaacacggttcgcacagtatggatgaattcagtacttgtttcgccacgcatgccagtttagctttagctggtaccacagaggggatatgccatggactccactagacaagcgcgagtcgaagacgttgaattctcggcgcctcagggagtccagaaggacctgggccggcacggctggaaggagcacgggaaccgcctctgctggcacagacgctgccagctcccgtgccttctgcaggtgagcttcggcaacagacgcaaccttgaaaactgcatccgggagcgcatcgcccatcctgacctctgtccggccaccctcccgtgcaagcagcccgcactcctcggccacactggccgggatgtacggtatcttcccttgcttgctcacatggtgaggcagcgccttgagcagcagcagcag

SEQ ID NO: 4969 - DNA, 474 bp, Hordeum vulgare
cacacacttatatatttccacgtttctgtggaaagaaatgatgacagatcatcccaaactgatacaaatcgttgtactaaatcacatgtgtttatatttagtgccaggaaagcatttagaagtttcaggtattgctgattttgtcgtttttatcgtactatacaaaacaaatatgaattagccagaaatgcatgcatcaatttgaagtatataggtacattagggagtaatagctaataactgtgaaatggccgactgactaagaaggatgttaatgtgtgtgtgtgtgtctgcagagcccggtgggcgtgtttgagctgcttcccgtggatgtgcggcggctggtgctctgcagtccagcgcaaggggccgagttgctgctgcgggtgtccccggtgctgtgtggggagcgggggctgcggcggcggaccctcttgtggctgcacatgctcctgcgccggttgctcctcttct

SEQ ID NO: 4970 - DNA, 506 bp, Hordeum vulgare
gagaaaactgttcattcttcagttatctctaaagctctaattacttacaacatactaggagactacaggaaggacgaaagcacaagtgatccatctttgtggcaagtaaaaccaggtaaatccacaacgccaactttaaacacatcatggactacgctcgtcaagaacactagctgagcctgagactgcgggcgacacacgcgacaagaacagagaacaagaagaacaatcagtcggagacctcatgaacacaggcagcaccgagggcgagggacacacccgcagcacgcggccccgcagctggcacacgcagggcacgagcaagaagaggagcaaccggcgcaggagcatgtgcagccacaagagggtccgccgccgcagcccccgctccccacacagcaccggggacacccgcagcagcaactcggccccttgcgctggactgcagagcaccagccgccgcacatccacgggaagcagctcaaacacgcccaccgggctctgca

SEQ ID NO: 4971 - DNA, 1560 bp, Hordeum vulgare
  UNSURE (17),(27),(28),(39),(46),(48),(65)..(68),(272),(574),(580),(740),(901),(1049),(1090),(1113): n stands for any base
gggtttgtttgtttttnatcttgtttnnttggtttcgtntatcctncnaaaacgtcaaccccccnnnnaaggggttcctcctcggcggctttcggcggggattttatttttctcccaccacccacccctggtgggggggggctgttttttttgttttcccccccccctcccccccccctcccctcccctcttataaaaaaaaacaaaaaagggaaaaaggtttgttggggtgttgttttttttgtggtttttcccccccttttttttttctncacacacaacaaccaaccaaaaaaatattttttttttttttttttttttgttgtacacatctattattttatattttttttgggtggggtggggtgggggagagcagaaaaaaaaaaaaaaaaacacaccgggggggggagggagggggggcgttttgtttgttggtgggtgggggggggggggccgtccgcctcctctcttactttacactttttctttttgtttctttttacatgtgtgttatcaatagagtggaggtgggtggtgttgctctgtttgcgtttctgtttctctttttttnctcccncctcacatcctgcggcggtgtggtgggtgggggagatgtgggtaataaagaatgaggtatttctttctttctctctttttttttttttttttcacaacatcctgccccccctccgcgcgggtgttggcgcgtggtgtgtttttggttcttttcctgcccnacttatctctttattttttctcttgtttttttttttttttttttattctccctgatctttcacatacaaagtggtgcgtcgcgcgcggtctttccttttctgtctatcttgtaacgtcttgtttttgtctttctttgttgttcgtttcccgcctctggcancatttcatccgtttgtccggcacctttatatacgctctaatttttatttattttgtgtttggcggtctgctgtctgccgccgtcgcccgtctcttctctccttttctctttgtggtggtttgttgttctttttcttctttttcttctnctcttgcctctcgtctatccccccccatctctctttttccntccttgttcttcgttcccgttgnggcgcgcctgttctgttcccggtggtgtcgtgtcttgctcctgcgggtgcttgtttgtctgtgtgctgccgcgctgtttggcggctcggtggtgccgtgtgtttttccgctctgctgtgtgggttttgttcgtttctgtcgtcgtttgtgtgcttcctcgttgtggtatctgcttgtgtcgatttcgtggccgatgtgtgttttgtgctgtttcatgttggcgtctggtgtgtcgctgtcttttctttcgttgcgcgtgggtcgctggagcgttcctccgtgttcgctgttcgcgtctttgccttatctccgcccacgtgcggtttgttcctcttcttcggctatctctcttctttcccttctctccgtgtctgtggtgttcgtctcctctcgctcacctacacccgtctctaccgtgtgcttgtgctcgtattctgccacgtggcg

SEQ ID NO: 4972 - DNA, 429 bp, Hordeum vulgare
gccaatgcaaatgttattgttaatctggtaccttttttttagtatttatacaaaaatgaaaaacaaatagtcagacacagaaacagacacacacaggtacagctgtggctgctacaatgacagcacccaatgtatcctcctccatccctccctcctcaccagatcatcaggcatcagcaacccatctaaccatttcagacacaaagtactacatacatggcacacaccggcaccagcgaaacttcctccctcgacgagctatcttatcttgtagcaaccgcaaacgctaacgcaagttcgtccatggacacagaacatggtggtttgtttgggtgatagggtatggcgacaacagctacaacagagcccttcttcatctgtatctcaggttcaggtcgagctcgggcccatacatgccgcctccaccgg

SEQ ID NO: 4973 - DNA, 486 bp, Hordeum vulgare
gtcacttgttgcagcccctcagttaaccatacctcacaaataaacctttgctagtcttgatacctttggaaatgagattactgagtccgtgtggctcacagattacaacaacaacagttgcaggtacatgtaaagcaatactttgacgtgagggcgaggattgttctatttgtagtttcttctttttcatcatcatcgatctaggatgggttcttttttgtagcttgggatagcaaggatggacatcattctttatcgtttggtttcgtccatagccggaccatgcacttcttcatgatgcttgattatgttgttttactgatgtaatattgatgtagcttgtggcgagtgtaaactaactccttatactcatcttttcagtacatgtacttgcaacgatatccattcttgcaaaatgacgagatgcccttctatccccgtcgaggccctctcgtcaaaataaggataggatcacatcttgggcgt

SEQ ID NO: 4974 - DNA, 541 bp, Hordeum vulgare
aaacgccaaataagaaccaagaaagatgatgcaaggatgaagttggtttgagatctcaacgaacaatacaattatgttactcacttgagagccccccttgacaatacggcaatctatcttataacccaatctcccaactaccaccatgagaccggtaaaatagaaaacctgtcaagggcaaacctataccttgaacatagtccacttgagctagatgatcacgatcttgacttcctcaagatagaccacctttcctgattgtgttgactcgatgaagactagttgattgctcccccatactcactaggggtgagccactcttgagcacatcttcactagtccattgccaccacaatggatgacatgcttcaagcatgatatctttgtgatgctccacttgaacttgcaaaccgcaatcttgatgacgatcatgtgttgatgtcatcctccatgggttgtatgagatattcctattttcgcaatcccatggaaacacacctaaccccacatagaatgtaacgcccaagatgtgatcctatcc

SEQ ID NO: 4975 - DNA, 414 bp, Hordeum vulgare
gacagaccaagatacttactgccacgcggcctcgtagcagcaacccaggccgtctcgccattcggatacgtgtcggaggatccattccctgcccatggaacagagggggcttcctccatcaacatcatgctgggcggcacctgcagcaacagcctgaacatctacagaagacaattctagaccatagttactttcttccttcttacaccaaaggtcatcttttcattttgttgtgatacttagcttttgcgtcgaggaaccgaaagtggatataggatatataggaggggggccgtcttactgtcgagtcgaagaagaagaagaagcagtgtgtatttggcgtcagttgcagacagtgggtttttgtgatgaattattaatacattttttttcgcttttaaaaaaaaaaaaaaa

SEQ ID NO: 4976 - DNA, 394 bp, Hordeum vulgare
gcgaaaaaaatgtattaataattcatacaaaaacccactgtctgcaactgacgccaaatacacactgcttcttcttcttcttcgactcgacagtaagacggcccccctcctatatatcctatatccactttcggttcctcgacgcaaaagctaagtatcacaacaaaatgaaaagatgacctttggtgtaagaaggaagaaagtaactatggtctagaattgtcttctgtagatgttcaggctgttgctgcaggtgccgcccagcatgatgttgatggaggaagccccctctgttccatgggcagggaatggatcctccgacacgtatccgaatggcgagacggcctgggttgctgctacgaggccgccgtggcagtaagtatcttggtctgtc

SEQ ID NO: 4977 - DNA, 1479 bp, Hordeum vulgare
  UNSURE (1)..(4),(11),(12),(22),(878),(1278),(1347),(1361),(1377): n stands for any base
nnnnttttttnnttttgttttnggggagaaaggggggcggggggttttttggtggggtcagaagaccttatttgtgaggtaggacgctaaaaatccctgacaccagataataatattataatatatatgattcctgtgtgagaaaaagaatgccgtgggactatggtgttgaaaatgagtggtggatatagaggaaggcggagagtggtggtgtgtgttcgtggggggggggtgtgtgtgttgtggtgtgtgttgtcatgggttagtgtttgtttacgggctgtgggtggtgggtgtggggcttgatggtggtgggggtggggggcgtgggtgtttttatcggtggggcgtggggcgcttggcggtgtcgttttaggggagtagacgaggggaaggaaagggatggaggagcgcgaaaggagtatggctgtttttatttgtttctgtgcttctttttttgtgcatagtacgttttggcttgtttggtttcaggtgttgttatcggtgcgccgaacgcaagtgggtgtaacgcggcttgcgggtcgggggtcatagagagagttgacttgttacgttagcggtttatgttttttgtcgtttatccagttggttttgtgtgccgagcgtttgtatgtcgggtgtgtgttgcagggcgtggtgttgagtgtggtgtgtgtagggttgttcgaccgcgccgctttttttgtgggtgtgtgtttgtcggcaggtgtgttggttactcatgcgtgtatttggtatgtgtgtgttgctcgaggcgactgtacgttggatttggcgtgcgtagcgaggccacgcgatttttccgccactctaggtgagtcgattctttatgtgataccgcgtgcggccttgcgccngtgtgtctgctttatgttcttgttggcgccggtgtgtgtgtgttgttgtgtcatgagatctcacgcctattattatgatttgtataatgttctgtacagcgcaataattgatttattgatcgcgaatcatattttgatagagacttctcatatcccgccaagaccgcttcctttacagtctgttggtcgcagtttcttatgtgcgtgtgtgtattcattcttgtgccttccgctgctgattgtcgctgtagtgtgtagtatgtgtgtgggcgacacggtggatcgcagtctatcgaatgagtggtacattataatgcgcgcgcaagagaatagattattggtggtgcgttgtgccacatccggcgagggtgttcgatttaatgcagaagtcggtgcattngtggagtgataagcctcatgccatcgctgctcaagcacgtatagaactcaaagtttattgtatagctgncctacgacaccgtncgtgaacgcgttattnacaggcagcgagcgcgttcgagtgatggacgattacacgacacagcgtagagatgtattatttgtctgattggattcagcggcctcgcgggaggtctagtct

SEQ ID NO: 4978 - DNA, 545 bp, Hordeum vulgare
  UNSURE (20): n stands for any base
gtacccccgggcctgcaggnaattcggcacgagggcggggagggggcggagggggcggggagggtgcggaagccctacaccatcaccaagtcccgcgagagctggaccgacccggagcacgacaagttcatcgaggcgctcctcctgttcgatcgtgattggagaaagatcgaggcgtttgttggatccaagacagtcatacagatcaggagccatgcacagaagtacttcttgaaggttcaaaagaatgggacaggtgaacatctgccaccgcctaggccgaaaaggaaggcggcacacccgtacccacataataaagcctcaaaaaaggcccctgaagttgacttaccacaacaacctcctcatatcgtggagcaaggatgcgttgtacctatggatgcacctactgttgctacaaactcaagtgcagacgacacatttccttcctgggacaatgttcttacccaaccttatagcccaagacatacacaagatttaggcgctgcaaataatagctctagtagcatagagtgccaatctggaac

SEQ ID NO: 4979 - DNA, 424 bp, Hordeum vulgare
ccgcgttggagccggacaggtgggtgacggcggccgtcgatcgatgtggttgaggcggcgagaggagggtggccgtgccgtcgtcgcgtcctgggactgggaggcggccgcacgagacggcagcggcagcaccaagactgccgcggatcgaccttggaagccgactccctcaccgctcggagctcccctgcgcgctgcggccttcttctccagctcggaacgccgtctgctatctctgtctgtcccaagccctgaattgaagagaccctacactagagcagcagccagcagcggagtacagccagaacaacaagcactgaagggattcccatgctgctcaacaagtagcagagcccccccatcaaatacccacaacagtagacttaaacacaccacaaatcaggacgatcaatccgaggaaaag

SEQ ID NO: 4980 - DNA, 547 bp, Hordeum vulgare
aatttaatctcctgcggttgatcacgcctttgaaatcgagaatgagtctgcaattctggcacaggagctgtcctgtggtgaccctgcctgctgaataccatgaacaaggcatagttgacaaccctactgaaaacaatgtgagaacggtgtgggctagcaggaggacatgggaggacgaacagctatacctggtccatgatcagggcaccggtctttctactactctggtcgtcaagaagttccagagcgtgaacccggtactacaagtgcacgacaatgtcacgtaccgctacaattcagagatgttcctgctagccagcaattctcacgacaacatcatcaaagccgtagacctcatccagcgggaagacgcaatcatgctcgtctacgagtatccggtgaacggcagccttgactactggatgcacccgccggtggagaccggtcgacctctaggctgggcggagaggagggcaatcgccatcggcgtggccaaagggctctgccacttgcaccatggatgcaagaagccgattgtccaccacaa

SEQ ID NO: 4981 - DNA, 547 bp, Hordeum vulgare
gtcccccgggctgcgggattcggcaccgggaagctccctcttttccccttccgtctccgtctccgtctccgtctccgtcgcctcgtcttctccgcgatccccaatccctcgatccccgatccgcccgcccccagcccggatccaggcgatggcggccgcgggagacgccggcgagaagaggatggtcacgctcaagagctcggacggggaggaattcgaggtggaggaggcggtcgccgtcgagtcgcagaccatccgccacctgatcgaggacgactgcgccgacaacggcatcccgctccccaacgtcaactccaagatcctctccaaggtcatcgagtactgcaacaagcacgtccaggccaagcccgccgacgccgccggagctggtgcgtccgatgcgccgccccccgccgatgacctcaagaattgggacgccgagttcgtcaaggtcgaccaagccaccctcttcgacctcatcctggccgcaaacttcctcaacatcaagggcctactggacctgacctgccagactgttgccgacatg

SEQ ID NO: 4982 - DNA, 556 bp, Hordeum vulgare
gaaaggctgacctccatttatgcatgatttggttcagtctatgactgaaacccatttgtttttcatccgactgtaggatagacaaaaacaaccataaaaaagggcgataaaatgcagacatgactaatactaagcattgttcatccagtgcggatggcatcgcctacatgctcctctactcaaaggcccactggttctccctgcggatctcctcctcctcatcgggtgtgaagtcattcttgatgttgaaggtcttgcggatctcctcaggggtcttgcccttgatcatgtcggcaacagtctggcaggtcaggtccagtaggcccttgatgttgaggaagtttgcggccaggatgaggtcgaagagggtggcttggtcgaccttgacgaactcggcgtcccaattcttgaggtcatcggcggggggcggcgcatcggacgcaccagctccggcggcgtcggcgggcttggcctggacgtgcttgttgcagtactcgatgaccttggagaggatcttggagttgacgttggggagcgggatgccgttgtcggcgca

SEQ ID NO: 4983 - DNA, 496 bp, Hordeum vulgare
cgggtgctcgtggaccactccattgtccaaagcttcgcgatgggtgggaggttgacggcgacgtcgagggcgtacccgaccgaggccatctatgcggcggcgggggtctacctgttcaacaatgccaccggcacgagcgtcaccgctgagaaactcatcgtgcacgatatggactcgtcgtacaaccatatatacacagacgacgacttggtagtcgtcggttaggctgatcgcttacaagaagttgtggattgattgctcggtcggtggctccctttctcctagacacatgtaatggagtactatcgactctgcctatcagtccatttttgttcttccttctctggagtttgatttagtaattaagatgaattagatgatgttgatgacagggctatgatgttgttgatgatgatgattgttcacttgtaaatcaatttgttgggaatcaaaatggcatggatgccaccaagtttaagtgaaaaaaaaaaaaaaa

SEQ ID NO: 4984 - DNA, 475 bp, Hordeum vulgare
ttaacttggtggcatccatgcattttgattccaacaaattgatttacaagtgaacaatcatcatcatcaacaacatcatagccctgtcatcaacatcatctaattcatcttaattactaaatcaaactccagagaaggaagaacaaaaatggactgataggcagagtcgatagtactccattacatgtgtctaggagaaagggagccaccgaccgagcaatcaatccacaacttcttgtaagcgatcagcctaaccgacgactaccaagtcgtcgtctgtgtatatatggttgtacgacgagtccatatcgtgcacgatgagtttctcagcggtgacgctcgtgccggtggcattgttgaacaggtagacccccgccgccgcatagatggcctcggtcgggtacgccctcgacgtcgccgtcaacctcccacccatcgcgaagctttggacaatggagtggtccacgagcacccg

SEQ ID NO: 4985 - DNA, 241 bp, Hordeum vulgare
gtctgccatttcgaattctccatcgccgtctctctctctctctctctacaacggctctctctctccttcatctacaaaaagattctccattgattcaaccccgagctccccaacctgatttcgatgggggaggaggcggcggtagatctgatttcgatggaggaggaggcggtcacatcgggaggcgacggcggcgtcagggtcgtcgccaggatctgccccgctcctaccgctcctgccg

SEQ ID NO: 4986 - DNA, 378 bp, Hordeum vulgare
ttttttttttttttttttttttttatactgcagagtagaaagatgttttcactgcattcattcattcatatgaaccatgtccacaaaatacacaaacctccaatccaaacaccaacaaaaaaacaagttataatgtagtagtagctcctactactagtgaaagccagtggcactctctctatctgtctcaacaacaagaaccgttgtactactcatccttccatccctccctatgcagaaattagataggattccatccactccaccatcccatcaggatggttaggggctgtcggtgatgatccccgacatcatattatttatctcccttttgttcatcccaatcacatccctgagatcgtctatccctttgaacag

SEQ ID NO: 4987 - DNA, 487 bp, Hordeum vulgare
cctcgtgccgattcggcacgaggaggatttctccgtagggtgctcgtggatcactctatcgtgcagagctttgtgatgggcgggaggttgacggcgacgtcgagggcgtacccgacggaggcaatttatgcggcggcgggggtctacctgttcaacaatgccaccagcgccgccgtcatcgctgagaagctcgtcgtgcacgacatggactcgtcgtacaaccagatattcacagacgacgacttggtaatcgtcgattagactgatcgcttacaacaagttttgaatttttttgttcggtctgttgcttcctttttctcttggacacatagtggtggagtaccagccactcatctacctatcatcttgatttatgttccttgttctagttttggttttagtaagatgaattagatgatgttcgtcacttgtaaatcaattatggttgaattaaaagggcgtggatgccacaaaatataagcaaaaa

SEQ ID NO: 4988 - DNA, 480 bp, Hordeum vulgare
tttattttgtggcattccacgcccttttaattacacctaattgatttacaagtgacgaacatcatctaattcatcttactaaaaccaaaactagaacaaggaacataaatcaagatgataggtagatgagtggctggtactccaccactatgtgtccaagagaaaaaggaagcaacagaccgaacaaaaaaattcaaaacttgttgtaagcgatcagtctaatcgacgattaccaagtcgtcgtctgtgaatatctggttgtacgacgagtccatgtcgtgcacgacgagcttctcagcgatgacggcggcgctggtggcattgttgaacaggtagacccccgccgccgcataaattgcctccgtcgggtacgccctcgacgtcgccgtcaacctcccgcccatcacaaagctctgcacgatagagtgatccacgagcaccctgacggagaaatcctcctcgtgccgaatcggcacgagg

SEQ ID NO: 4989 - DNA, 424 bp, Hordeum vulgare
tggcttatcctctctttgcttcttgccatggccgcggccatcgccgtcgccgtcgccgtcgccatgcctactcctctcctctccccctccccctcccccgccgccactcaccccttcgccctcaccgctcccgctcctccgtccacccgccgcacccgcgcacgcccacgccgcctcttcgtgtcttccccggcggcccactccggctccgacggggcgccgtcggcggtttcgtcctcttccccctccccctccgccggctccggcgaaaaggggggcggcgcgctgaccttccagcaggccatccagcggctccaggagtactgggcctccgtcggatgcgccgtcatgcagtgcagcaacaccgaggtcggcgccgggacgatgaaccccctcaccttcctcagggtgctgggccccaaac

SEQ ID NO: 4990 - DNA, 417 bp, Hordeum vulgare
ttttttttttttttgaagaagaaaatggatttaatcaattggcataaacaacatactaattaatacagaaacccttataattacattctcattcttctcccagtaatttcccccaaaattgatgaccagtaacaaatgtaaaagaaatggctccaacttcaaaaatgggatgcacgctccaactcgaccgcctgctcgctccaaggctaactaaaaccctggtaaaaccgagaggtcggctatcccctttgtcagactcgcaaccttttgtagcagcgccaggcgattgttacggatcttctcatcttccgccatgacgaaaacgttgttgaagaaatcctccaggggctgtatcaagagcaaagaagactcggcaaaggttttgacgtcgacgccaggatggatcttattggcaac

SEQ ID NO: 4991 - DNA, 524 bp, Hordeum vulgare
gacgagcaaatcagcatcgatagtgctctgctcttagcatgatgatgcggaacagcaacaggatttgtagaaaagctggagaaggcggagaaaaattcacgaggaattctttcagaagtgaagcaagcccagatcattcatcaatgtaagatggcgaatctcgtctggactggtcaagacaagttaggccctctgcagccacaccagatggaagccattctaggctatccagctaatcatacggatctgccgggcgtagacccacaagagaaggttgcttccatgaggtttgcattgcagactgataccactgcatatcttttgtcggtcctaaaggaccggtatcctgatgggctgagagtgatctctatctacagtggagtcgggggtgcagaagtcgctctacaccgtctcggaattccactgaggtgtgtggtgtccgtggaggagtctgtggtgaaccgtacagttctaaagatgtggtggagaaaaacccagcagaacggagagctaagacaacttga

SEQ ID NO: 4992 - DNA, 376 bp, Hordeum vulgare
caaattaaaaccctcataaacaaaaacacttgtgcaaaacaaacagaagcagattttaccttcctttttatggcgtacaagctcgttatgcaaggatagcactagccatgaagatgaggtctcattgcggacatattgctacaagaagacagaaaacaacaggacttcacattttatagttttatacaggtgttagtattggtccttgataattcacacctcatgtgagaatgaccgaagaaagagctatgtgtgtcagtcaactccttgcatccgtctcaccatctggacaacccggacatactcgtagaaacgataggtgtccattcccatggttgtgcccaccatcatcactgcgcctctgtacacactgtag

SEQ ID NO: 4993 - DNA, 547 bp, Hordeum vulgare
  UNSURE (11),(18): n stands for any base
gtctcccgggnctgcagnaattcgtcacgaggattgtgaccaagtttatcgagaagatgcaggaggacatccctggccctggggtgaaggagcagcttcagaagctgtgcagcatctacgcgctccacctcctgcacaagcacctgggcgacttcctgtcgacggggtgcgtcacggccaggcagggcgcgctggccaatgagcagctcggcaagctctacgcccaagtgcgtcctaacgcggtggcgctggtggacgcgtttgactacacggaccactacctggggtcggtgctggggcggtacgacggggacgtgtacccggcgctgtacgaggaggcgtggaaggaccccctgaacgagacggtggtgccggacggttaccaggagcacctccggccgctgctcaagcagcagctcaagctctcgaggctatgatccttccttggtccctgaatctgtcccccaatccatgttggacagcggatgtggagcagtaattaataagaggatcaaatcaaggggagaggtgattggttgttgttcac

SEQ ID NO: 4994 - DNA, 531 bp, Hordeum vulgare
tcattattcttgccttttcctccttgtacacactagaaagaatcattcaacgttttgctactactaagtatctcgacacatttgctaaacatgtattaaccgaatcacaaccacagcagctgttctagtaataataccaccaaatgctaattaattacccaggagggagtaaaaatccttttattcttctaccaacaacagtgcctgtcgctcttgcctttccaacaaagtgaacaacaaccaatcacctctccccttgatttgatcctcttattaattactgctccacatccgctgtccaacatggattgggggacagattcagggaccaaggaaggatcatagcctcgagagcttgagctgctgcttgagcagcggccggaggtgctcctggtaaccgtccggcaccaccgtctcgttcagggggtccttccacgcctcctcgtacagcgccgggtacacgtccccgtcgtaccgccccagcaccgaccccaggtagtggtccgtgtagtcaaacgcgtccaccagcgc

SEQ ID NO: 4995 - DNA, 515 bp, Hordeum vulgare
agcacgcaagataaagaaatccttgaaataccgcaagggagctggtgttttcattatagtagcttcagttttccttcttctcctgttctacttcatgtcatcttggatcgcgtggctactgattgtattgttctgcattggtggtattgagggtatgcatgtttgcttggtgacaattatctctaggatttttaagggttggggcaataatactgttcaactgccgttctacggggaggtcttgaccttgtccgttggaatactaccattctgtatggtctttgccattctatgggctatttatcggcattcttcgtttgcttggataggtcaagatatccttggtatctgcttgatgataactgtgcttcagatggcgcgcttacctaatatcagggttgcatcagctcttcttagtgctgcatttgtgtatgacatcttctgggtcttcatttcgcctcttatattccatgagagtgttatgattgcggttgctagtggtgatagctcagggg

SEQ ID NO: 4996 - DNA, 541 bp, Hordeum vulgare
tggagatgccttagctagccttagtaaatttgcttctgttgtgtacaaatttaactccatatcaaacctgagttttcaagtttgacaaaggcaacctatatcgaacacatatctggctagtgctagttttacatccccaaaaaaggagcgtcatgttcagatccattggttaactagatcgaagaatgccgccgcctttttgcatacagactatgtcagattacatttcaaacttcgccgaccaaaatttcctgtcttcttccgtagttccacaggtgaggcagctcgcctcttatccagccaagcaccacaataagccctaacgtgcatggaactaggtaaagcagcgccggctgaccgtgtccatccattaggaagagcgcgagataggtcaggaaaaggccaacagcatatcccacagtcagccatagaaaatatccattcaagatgccttttttgcctgccctgtcaaatctgtagctgaatgcaacgagcaatccagggaaaataatatcaccaaagcctatcatgtcatagccac

SEQ ID NO: 4997 - DNA, 515 bp, Hordeum vulgare
ggttctctgagagatattgtcctgctcctcaccgtcgatgcgctcgagggacctgacttcatggtgaggacagcgaagaaatctatgctggaggaactcgagggcatgctcgagatcgtggacccgcagccaccagggaagcagaggtcgttcagccgccgcaagtttgatcttccagagggcggagcgatcccgaatgagaaaactgcaggcgtgaacaatgctgtcagagtcatcaacactggcaagggcaagcagtaggcaccgccgcgcgcctagtttagtggctggtaccatgcccgattgatggagcttgtagcgccgctttgtctgtgaatggtccggttcatcttagatttccagtacctttgagatttgagaaggattgaacttgtcgtgcaccattattcaggatgtcgtagcatgtaatgtatgatccgtaccggtaccatttgctttggatttgttgtactgtatgttgttgttgaactaccaggggaagagtttggtgcttt

SEQ ID NO: 4998 - DNA, 528 bp, Hordeum vulgare
  UNSURE (51),(52): n stands for any base
gttgttaaagcacccaaactcttcccctgggtagttcaacaaccaacatanncagtacaacaaatccaaagcaaatggtaccggtacggatcatacattacatgctacgacatcctgaataatggtgcacgacaagttcaatccttctcaaatctcaaaggtactggaaatctaagatgaaccggaccattcacagacaaagcggcgctacaagctccatcaatcgggcatggtaccagccactaaactaggcgcgcggcggtgcctactgcttgcccttgccagtgttgatgactctgacagcattgttcacgcctgcagttttctcattcgggatcgctccgccctctggaagatcaaacttgcggcggctgaacgacctctgcttccctggtggctgcgggtccacgatctcgagcatgccctcgagttcctccagcatagatttcttcgctgtcctcaccatgaagtcaggtccctcgagcgcatcgacggtgaggagcaggacaatgatcttctcagagaacc

SEQ ID NO: 4999 - DNA, 517 bp, Hordeum vulgare
gggacatcgacaacaaccatgtcggcatcgacatcaacagcctcaactcggtggagtccaacaccgccggcttctacaacgacgacagcagcagcagggaggatggcggcatgctcacgaacatgtcccttatcgggtccgggccgatacaggtttgggtggaataccatggggaatccacacgaatcaacgtcaccttagcacccctcggtgtcgcaaaaccggcgaggccattgctctcaacaacctatgacctctcaccagtgctcacagaccaagcgtaccttggcttctcatcctccacaggtttaagcacggggcatcactatgtgcttggttggagctttggaatgggcacccctgctccagtcatagatcccaccaaactacccaagctgccttaccttggtccaagacctcaatccaaactcctagagattgttctgcccatagcttctgctgtctttgtgttggctgtcggcatcctagctatcaccatggtgaggaggcatatcag

SEQ ID NO: 5000 - DNA, 555 bp, Hordeum vulgare
tataaaagtgccctttattattttataaggtacgcacacacacacacatcattaactacatcattccattacaaaaggggaagtacagttaattaagaatatgcatgtacaactacaccacacactaaccacccaacatcatgacttgaaggcggccatatgcttgcacatcacctcccatgtagtgagaagtctgatattgagccaaagctcgtcatcatcggcgaaggataggacggcatcgcggacgagtaaaccttgctttcgttcttcatcagggccaacatgtggaagctgaagtgttccggcagaagctccgggagcggcacgtcgccgtcgaggtactgcatagcttgccgcatgctgggccttgcttgaggaaatgggtgcgagcacaagagccctagcttgagcgcaaggcatgcctcaccggcgtcatagccaccttgaagcttggcatccactacatcaacaagtgaccccttgtgccagttctgaagcacccagtcgaccaggacgagctggttgccttgcgggtcctccttgataggcctt

SEQ ID NO: 5001 - DNA, 558 bp, Hordeum vulgare
  UNSURE (41): n stands for any base
gtcctcccgggccttgcaggcgcagaccctatgatacatantctttacattgacaactttgtgtttggtcgccattctgaaaagcaatgatcttgagcttcctcttgcaacactgccccgctgctgccgcgccagccgttcttccaatcatcggcgggcttgcggtgggcaagaaaactttggttgcgcatgtatgcaaggatgagagggtttgctcgcacttctcttcaattattcgcttgaatgaaacagattttcgtacaatagctgatagaagaagtatcatgtccgggacagggaggatattgatagttgttgagattttttcagatgtggatgaaaaggattggaccacattttattcatatgtggcgaccatggatggaggaagcaaagtgatcatcttaagtaggcttaacaagatgaagagatttggaactgtgaatccaatctttctcaatgtcctgacatatgaggaattcagctacctcttcaaggcactcgcgttcggaagcgcaaaccaggtggaacacccgcagttagtacaaatagcagaca

SEQ ID NO: 5002 - DNA, 552 bp, Hordeum vulgare
gaaatatacgatgtagaactttattgatactgggaaggttttataacatattacagcaattaagactacacatgcacaagacccctaagatttgaaattagggcactcctctacgcttggtcccgggcagaggactatcttgagcataacttgaaagaatgtgatcaaatgtagtataaggtggaattcttgattcaaatctcactacagtggcctgcatcttcggcctaagatccactaacatctccgtaaaggtcacctgtggtaattcctttgctggaacattgtttgagctattccaaatgaactgaagtggagaagcaggacgcagaaccatgtccgtcacgtcaatcggaagacctttttcaagacgtaatttcggatgctcaccaaacatggagaggtttctatcaactagtctcctgcacctgctcaatatactaagccagaaatgaacattcgggttagttctcattacatctgcaaacaaatttgcagcgagaattgaccatctcgattgtaactctctggcaaacctgtctgctatttgta

SEQ ID NO: 5003 - DNA, 458 bp, Hordeum vulgare
atccatccatcggccaggaaacaatctacccacccacctcgggatcatcgggcctgcaccggcggcgccatggattcctctcgcgtcattctcatccccggcacgccgccgctgccctacgcctacgagcagctgccctcctcctccgccgacgccaatggccaggaggagcagcgggccggcggtggcctgaggtggcgcgtgtgcgccgccgtgcttgccgcctcggccgtgctggcgctcgtcgtcgccgccgcggtcttcggggccggtgtggcgggccgtgacgtggtggccggctccgtgccggccattccggcaacggagttcccgaggagcaggggcaaggagcacggcgtgtcggagaagacatcgggggcctactccgccaacggcggcttcccgtggagcaacgccatgctgcagtggcagcgcaccggcttccatttccagccgga

SEQ ID NO: 5004 - DNA, 422 bp, Hordeum vulgare
ttttttttttttttttgccctgtcatcaacatcatctaattcatcttaattactaaatcaaactccagagaaggaagaacaaaaatggactgataggcagagtcgatagtactccattacatgtgtctaggagaaagggagccaccgaccgagcaatcaatccacaacttcttgtaagcgatcagcctaaccgacgactaccaagtcgtcgtctgtgtatatatggttgtacgacgagtccatatcgtgcacgatgagtttctcagcggtgacgctcgtgccggtggcattgttgaacaggtagacccccgccgccgcatagatggcctcggtcgggtacgccctcgacgtcgccgtcaacctcccacccatcgcgaagctttggacaatggagtggtccacgagcacccggacagaaaagt

SEQ ID NO: 5005 - DNA, 444 bp, Hordeum vulgare
gggcggagggggcggggagggtgcggaagccctacaccatcaccaagtcccgcgagagctggaccgacccggagcacgacaagttcatcgaggcgctcctcctgttcgatcgtgattggagaaagatcgaggcgtttgttggatccaagacagtcatacagatcaggagccatgcacagaagtacttcttgaaggttcaaaagaatgggacaggtgaacatctgccaccgcctaggccgaaaaggaaggcggcacacccgtacccacataataaagcctcaaaaaaggcccctgaagttgacttaccacaacaacctcctcatatcgtggagcaaggatgcgttgtacctatggatgcacctactgttgctacaaactcaagtgcagacgacacatttccttcctgggacaatgttcttacccaaccttatagcccaagacata

SEQ ID NO: 5006 - DNA, 536 bp, Hordeum vulgare
gaaaatctaaaagaacttatatttaggaacggaaggagtacaataataggcttacaaacaaaatcatgtcaaaaagaactacacacaaaaaaatggtcttccttcgtgggtaacaaataacactttccctcttccctctccaaatcaacatgcgcaaccatgtcctgactatacatgccacaagcctcgtctgacggacagataaaagttcccgaacctaaagagcccgagaacatctcgaaacaactatgtacaaccataggcggcgatgctgcaacatgtcgcacctctgacaacaatgtactgcactcttccctcatttgctcttttaccatgaatggatcgtgaagggggtctgagtagaccccggacctcctacgctctcgtgcttggcttagcccatgccggcaccatgcgacgagagcatcctcctctgcaacagtcagggatgctgtatgctcagatgtgtctcaaagtccggaccagacaggtttaccgatagatttttcatcagttgtagtactgtttcagcatct

SEQ ID NO: 5007 - DNA, 59 bp, Hordeum vulgare
ttttttttttttttttttttttttttatttttttttttttttttttttttttttttttt

SEQ ID NO: 5008 - DNA, 413 bp, Hordeum vulgare
  UNSURE (349): n stands for any base
gcctaccgctaacccatcccctctcccctctcggattcctcggctccggcgaccacgaccggcggcggccgtccctccctccctcccaggtgtacaggacagagtgcaaaggaacagggaagtgcgcgtccatttgattgaaatggcttcaaagcttcaagccttttggaaccatcctgctggccccaaaaccattcatttttgggctccgacatttaaatgggggatcagcattgcgaacattgccgactttgctaagcctcctgaaaagatatcctatcctcaacaaattgcggttgcctgcactggagtcgtctggtcacgctacagcatggttatcacaccgaanaactggaacctttttagcgttaatgttgcaatggccggtacaggcctgtaccagctttcccgaa

SEQ ID NO: 5009 - DNA, 516 bp, Hordeum vulgare
cacagaacagagtgtggtggatgacaaccaaagcaaagtggcacctctttcatggatggactgcatatccaatatcagttttggagcactgttatcgcaagctgtgccctctcaagacagcaaacaaccgcctttgcaaaatagctcgattttccagcagccgcctttgcaaaatagctcgattttccagcagcagattccagccacgtgcgattcattcgatgctgctattgcttccttgatcgctcggcagcaaacaggtaaccaaccaaaggtgtcaaatccatccccttgggatgcagatgaaacctgtcatgcattccctcctccccggaatcaaaatttggccaggatgtcctcttgtggtcctggcaacagtagtgctattacctcaactatccttggtgcaattgctgaatccaatacagatggcaaccagcaaccctggttaccagcgctctaccgaaggcaggaaagaggaaccaaggccccctcggataccaccaggcttgggca

SEQ ID NO: 5010 - DNA, 540 bp, Hordeum vulgare
gaacattttgaaaatacaagtagctgccagtaagaaaaaactagtttatgcgactaagatgtgtcgttaactgattatatatctgcacgatctgcttcagtaagcctaaagtaatgaattccgactgaagcagcgtgatgatctatctttacaggatctgtacatacttgaggtcttgcatataaaattcccaagccttacgaaacagacaacttcgggaatgcatccaaaccgctgtttccactcaaaaagcctagagtaaaatgcacaatcaccggtggtggattcaggctgaaagcaaaccatatataagaaccctatcatcaacaattaaatgaaagagaaagccaaaaaaaaacatctcaaagatatcgatgtttgtcttttataaggccctaaatctaaatggtaccgtcgacgacgcatcaggctttcacattatcattattgcccaagcctggtggtatccgagggggccttggttcctctttcctgccttcggtagagcgctggtaaccagggttgctggttgccatctgt

SEQ ID NO: 5011 - DNA, 518 bp, Hordeum vulgare
gtaactacgtacagaaaatatggctcgccccgctgcaagcactgatggcagtgcgttggccgtcaccctggtaggttggctacttgttctccagcttctcctcctgtcgccggcgcctaccgccgcgaggagggcgacgagcgtcaaccagacgcccaacttcctctccagaaagccgcctaggtcgggcaccaacgccctgctcaaaaaggcgcgccgtcgcaaccgcaacacggacctgctgggcagcgccgcggcggacgacgccggctacgtcgtcctctacaacgtctccatcggcgccacggaggcgcagccgaacgacgtctccggcgtggtggacgtcctcgatgatttcgtctggacaacgcagtgcctggccgcgccggtccgggtccaatgcgccagccagacgtgccggagcctcctggccaacgacaccacggacgcctgcggcggcaaccccagcggcgacgatacatgcagctacgtcaacgtgtacgcgccggggagcaaca

SEQ ID NO: 5012 - DNA, 431 bp, Hordeum vulgare
gaaaggtacaagcatcttacgaaacacagttacatgagatattgaatacaccacaatgctgaattatttcttttgccaaaacaatgcaacaagatggaacagtacacccgatggagatgctcatctagctagaagagtagcacccaagcaagcagcagagaggctatcgccatgagcgacaccacctgtgaggggagcggaggcgccgcgccctcctcgagcgtcagcgtgtcgccgccgacgtcgtagatcatgttggtgccagcctgcaccatgcttcccaggacagagccgaacggtgtgcccactggcatcggcagcatggtgaagcactgcagcccggtgacgttgtccttgaagaagtagtgcaccgtcgtgagctccaacgtagccggcgcgttcccgccgtcgaacaccagcgtaatcttggg

SEQ ID NO: 5013 - DNA, 520 bp, Hordeum vulgare
agcagcaccgggcgcatcaaaaggggacacaccgaggctaagggttgtggaccaatgcctaaggcggcaaagggcgttccagcaatatggtggtgccgccgccattgagagctgcccgtggcggccccaacgcggcctgccagagcgtgccgtcgccgtcctccgctcgtggctcttcgagcacttcctccacccgtatccaaatgacgtagacaagcacattttggcgcgccaatccgggttatcaagaagccaggtttccaactggttcatcaatgcaagggttaggctatggaagcccatgatagaggagatgtatgcagaagaaaccatacaacatgatgacaacggcgctagcggtggtagaggagaaccttcccccacggatcatcacaaaaacaagttagcggcatggacgaaggttgcgacgatacgagatgaaagtcgtcatcgccttagcagcacaaacaatcctagtgactgctttatcccatcctcccttgttgccgagggtggccag

SEQ ID NO: 5014 - DNA, 553 bp, Hordeum vulgare
ttggagctgaattacgttttagtactacatatacaggtactcaatcaatcggtgcaggtagcacctatatgggttgtggcactagattatgttcttgtctcctagcctgcaaaatcatgcagcagctcagaccccatgaggttcctatacggtagcaccacatcttcctcgtcagctccaaccatgagtgatgattgttgttgcatcatcatcgccggtgatgtgaacgctcgttgctgctggagtcccaaggtaagtgacaccgcgccattgccaacatcaccatgcaaagttgggtagccatggagctggccaccctcggcaacaagggaggatgggataaagcagtcactaggattgtttgtgctgctaaggcgatgacgactttcatctcgtatcgtcgcaaccttcgtccatgccgctaacttgtttttgtgatgatccgtgggggaaggttctcctctaccaccgctagcgccgttgtcatcatgttgtatggtttcttctgcatacatctcctctatcatgggcttccatagcctaacccttgcat

SEQ ID NO: 5015 - DNA, 519 bp, Hordeum vulgare
accgcctccagttcaagatgaggacactactggagctcctaggtgttgtatatgatcgccacggctcggtgcccattgccatatgtgtttcatcccgggatgagctagatgctgtctgtgctgctgttgccaacctccccttcgtatccttatcaccgctgtacagcgattaagatgaagttgagcgtgcatctgttcttgagaaatcccgtcgggcagcaatacagcggaatcagattgaagctgcttctattgatggaattcccaaacctgaaagtgtggtcttgaagctaaatattacagttgtaactgatgcttgcttgccttcggcggcgatgggagaggctccccttatgtctcgtgtgctgataaactatgaattgcctacaaagaaggaggcttacttgagacgtgtatcggcatgcttggcaacagatggaatcgcgattaatatggttgttggtggtgaggtagttcttctaaagtctctggaagaaaccggtggattcgtcattgcgg

SEQ ID NO: 5016 - DNA, 556 bp, Hordeum vulgare
gtaaagaaaggtcatttctcagtattagaagtataaacatcaatcccattattctgaaacctaattttaagacaaatccacatacgaaggaagcaaagagtaatcccacaagtcaaagtagcaccaatagaaatagttagtcctgaaggctaacagtaatttcagaagcggattgaaactctcataatatctcggaaacatgtattggcatctccgcaatgacgaatccaccggtttcttccagagactttagaagaactacctcaccaccaacaaccatattaatcgcgattccatctgttgccaagcatgccgatacacgtctcaagtaagcctccttctttgtaggcaattcatagtttatcagcacacgagacataaggggagcctctcccatcgccgccgaaggcaagcaagcatcagttacaactgtaatatttagcttcaagaccacactttcaggtttgggaattccatcaatagaagcagcttcaatctgattccgctgtattgctgcccgacgggatttctcaagaacagatgcacgctcaacttc

SEQ ID NO: 5017 - DNA, 890 bp, Hordeum vulgare
  UNSURE (11),(19),(51),(808),(856),(858),(889): n stands for any base
gtcccccgggnctgcaggnaattcggcacgagggtcggagtcctcatcggnggtgactgggccgaataagagcatgctcgtagtgtcagagttcattgggtgctcaccgtctttgagtggtgctattcgggttaacccatggaatgtagaggcaactgcagaggcgatgaatgaggctatttcaatgtctgatcaggagaagcagctgaggcacgagaagcattaccgttatgtcagcacccatgatgttgcttattggtcaaagagcttcatccaggacttggagagggcttgcaaggaccattttagaaggacatgctggggcattggattgggatttggtttcagggtggtggccttagaccctcatttcacaaagcttaacatggattctattgttatggcttacgagaggtcggagagcagagctatattgctcgactatgatggaacattggtgccgcagacttccatcaacaagacacccagtgcagaagttctgaggattatcaatgccctctgctcagataagaggaacatagtttttcttgtcagtgggagaggccgggataaattgggtgaatggttttcctcatgtccgaagctgggtattgcatctgaacatggctacttctttaagggtggagtagagatgaagaatggcaaacgtgcgcccaggcttcggacttcggatggatggaaatggctgaaccagtgatgaatttgtatacagaatcaactgatggatcgtacatttgagaccaaggaaagtgcttttgggtgtggcaccatcaagatgctgactcangctttggatcctcacaggccaaagagatgcttgatcacctgggagagngnactggcgaatgaaccagtctctggcaagagng

SEQ ID NO: 5018 - DNA, 551 bp, Hordeum vulgare
gagttgctaataagacttctgaatttttgtactagatgttgtccaggtccaaacatctaatgaacagaatcaagagaacaaatgaactagtatgatccatgacccacccaccgttttccgacaacacgaaaaaacacctaatttaaccacagggaacggtcagaatttacttttactccccaccagctacctgctgctgctggaacaaatggtatgtaactcatataagatgaagctagcttcaacgatcaggggaactggaaggagcctccgatctgcgagttctgggacggcgggttgatggcaacccacagcagggagatggtgatggcgaggaggccggaccagacgaagacgatggtcggcgtgcgcccgcggcgccccatgaggcccttggcaaatgggtacaggtgagccagtacccagaagctgaagaagacaccgcccaggagcttgctccactgcgggatctcgctgtagatggtgcggctgaagccgacagctatggcgatgaggttgaccatcatgatgacaatgggtgggatcatgag

SEQ ID NO: 5019 - DNA, 517 bp, Hordeum vulgare
gaggagttccgagaacaatctttatgttgtggagggaatgcagtttgagcgtggttatatctctccttatttcgttactgacagcgagaaaatgaccaccgagtatgagaactgcaagctgcttttggttgacaagaaaatcaccaacgcacgggatcttatcaatgttctggaggaagccattaggggtcaatacccaatcctgatcattgctgaggatattgagcaggaggctcttgcaacccttgttgtcaacaagctaagaggttctttgaaaatctgtgctatcaaagcccctggttttggagagcgcaagacccagtacctggacgacattgccatcctcaccggaggaactgttatcagagacgaggttggactcacacttgacaaggcagataacacagttctaggaacggctgcaaaggttgtccttacaaaagagtcgacaacaatagttggtgatggcagcacccaggaagaagtgactaagagggttgcacagatcaaaaatctc

SEQ ID NO: 5020 - DNA, 554 bp, Hordeum vulgare
gctaaatgtttctcttgctttatttcgccattctggcaggcacatcatattgcatttttcttatctcaaaactacatcatcatcaccatcaatctctcaaaacttggttcatgctaccaaaaattaaaccacatcctctggagagactccaccgtgtcgctcatcagtatccgaagccggagttgtccatggggttgacgaggggagcgggctcaggctccttgatctcgacgaccaccacgtccgacgtcaggaaggtcttggccaccgacgcggcatgctccaggcaacatctcaccaccttagtggggtcgatgataccagcagccatcaagtcctcgtactgcccagtggcagcgttgtagccgaacttgaagttgtcgttagaaagaaccttctcggtaacaacactaccattgacaccagcattcttggcgatcaacttgagtgggtagcacagcgccctcctcactatctcagctccgaccttctgctcttcgttctccagggtgtccttgatggcatcaaccttagcagccagcctcaaaagagtg

SEQ ID NO: 5021 - DNA, 517 bp, Hordeum vulgare
  UNSURE (37): n stands for any base
cctcctggtgccctcactgtccctcgtgaccttctcncgcctccacggtcgctgaggctattagtgtcatctcatgctggtatgaggacaagacagagtggggtcagcgtgtcggatggatttatggttcagtcacagaggatgtcgtcacagggtaccggatgcacaaccgtgggtggaagtctgtctactgtgtcaccaagcgtgatgccttccgcggcactgcacctatcaacctgactgaccgtctccaccaggtgctccggtgggctactggctcagtggagatcttcttctcccgcaacaatgcgctgctcgcgagccgaaggatgaagtgtcttcagaggattgcgtacctgaacgtgggcatctacccgttcacgtccatcttcctcatcgtctactgcttcctgccggcgctgtcgctcttctccggacagttcatcgtcaaggagctggacgtgaccttcctcacctacctgctcgtcatcaccctgacgctgtgcatgctggcggt

SEQ ID NO: 5022 - DNA, 521 bp, Hordeum vulgare
  UNSURE (13),(22): n stands for any base
ttttagtactagngatgttgtnccatggtccaaacatctaatgaacagaatcaagagaacaaatgaactagtatgatccatgacccaccaccgttttccgacaacacgaaaaagcacctaatttaaccacagggaacggtcagaatttactttttaccccccaccagctagctgctgctgctggaacaaatggtatgtaactcatataagatgaagctagcttcaacgatcaggggaactggaaggagcctccgatctgcgagttctgggatggcgggttgatggcgacccacagcagggagatggtgatggcgaggaggccggaccagacgaagacgatggtcggcgtgcgcccgcggcgccccatgaggcccttggcgaacgggtacaggtgagccagtacccagaagctgaagaagacaccgcccaggagcttgctccactgcgggatctcgctgtagatggtgcggctgaagccgacagctatggcgatgaggttgaccatcatgatgacaatgggt

SEQ ID NO: 5023 - DNA, 531 bp, Hordeum vulgare
ggcaattcggcacgaggacatcacaagcaacgcgagagctatcattccctgttgatgatcgcggtactgtgaagactgtggtgcaatacttcctggagacgtatggtttcaatattcagcacaccactttaccatgcttgcaagtcggtaatcagcaaaggccaaattatctccccatggaggtttgtaaaattgttgaaggacaacgctactcaaaacgactgaatgaaaaacaaataactgctctactgaaagtgacttgccagcgccctcaagagcgtgagaaggacatcttgcagactgtgcatcacaatgcgtactacgaagatccatatgcacaggaatttggcataaaaattgatgagcaacttgcatcggttgaagctcgtgttctgcctccgccaaggcttaagtaccatgatagtggcagagagaaggatgtcttacccagggtcggccagtggaacatgatgaacaagaaaatggtcaatggtggtagagtcagccactgggcatgtattaacttctctc

SEQ ID NO: 5024 - DNA, 554 bp, Hordeum vulgare
ttgcataggttataaatattttaaacaccagtgatacaaatataggactaggcagatatctcacgcggcacagccatgaaagcaaaagcttctcgcagcagcaccggcgcaacgcaacagacaaatgacgcccaattcagtcgaatagcttaaaaggtttgtgcaccggccacactagtcaccaatccggtgcaggtacttagaatggtgttgaaacagagtacagcagataactttggtttaggttcccacaatggtgttgaacagcatcaccaatacgactcacaggtgcttcaagttacctcacggtaactgcgaggatcttagcagtaaaacatgacgcgcttgacgttttccttgagggcggggagaggcctgacagcaacgttcccaaacctggtgctgctgcgtggaccgccctgtggaggaccgccacgtgcaccgctcgccacggacccgctgtcggaggtgtccggctccatgtagaaccgagcccggaaggctgccagatgggcatagtatgcaggaggaacaatcgatacagagcgggtgca

SEQ ID NO: 5025 - DNA, 345 bp, Hordeum vulgare
acggacgccgggctggtggagttcttcctggacacggacgcgcgcgagatcgagatcgagatcggcaggctccgccccaggctcaacaaggccttcttcgaccacatccagcgggagatcgcgcagatcaagttcgccgtcacccgaactgcggcaaacgaagacaggctgatcgagctggaagcgatgcagaaggtcatcggcgagggagtcgaggcctacgacaagctgcaaaacgacctcgtgacggccaaggagcggctcaccaacatcctgcaatccaaagataggaagaaaacactgctcgacatggtcgaacggaacgagctcaacatgtccatattg

SEQ ID NO: 5026 - DNA, 559 bp, Hordeum vulgare
  UNSURE (17): n stands for any base
aaggcccacatggcaanttgatttgaaccaactatgtgctgaatacaagtccaatgccagagataactggtcaccggcacaaaaatttatactgttatgtatttcaacatagatgagcgcacatcctccatgaaagccacagcttcctcctggttactcgccttggcgctccctatgttctcgtcgagaagcgtcaatatggacatgttgagctcgttccgttcgaccatgtcgagcagtgttttcttcctatctttggattgcaggatgttggtgagccgctccttggccgtcacgaggtcgttttgcagcttgtcgtaggcctcgactccctcgccgatgaccttctgcatcgcttccagctcgatcagcctgtcttcgtttgccgcagttcgggtgacggcgaacttgatctgcgcgatctcccgctggatgtggtcgaagaaggccttgttgagcctggggcggagcctgccgatctcgatctcgatctcgcgcgcgtccgtgtccaggaagaactccaccagcccggcgtccgtctcaggtatcacccgcgcct

SEQ ID NO: 5027 - DNA, 474 bp, Hordeum vulgare
ggtgatcgcgcctcgacctactcgcacaaccatctcggcgggagcatccctgccggcattgacatcctccgagacctccgtgctctactcctacaaggcaaccagataagaggcttcatcccactaggcctagcaaatctcacaaaattacgctccttaatgcttcatgaaaaccaagtctccggtgaaataccaaggcaaataggcaacatgagtaatctcgagactctcaccttgtcggtcaatcacttggttggtcacatcccctttgaaataggccacctaaagcacttggttacattagatttttctgacaatagtctttccggctcaatcccaagcagtataggtggcttgacaaaactcgctaccttgtacctcgacgccaaccgactctttggacgcgtccctcgagagcttggtcatttggtcaatttaaaggatctgggtcttagccgaaacaagctgacaggt

SEQ ID NO: 5028 - DNA, 539 bp, Hordeum vulgare
tgcagatggattatttataatgtttacagaaatagcaggagctctgccatacaagaatatatttatatgcagctaattgccaaacagcagctgcgaaagatatatagcacaaaacaaactatttagcgaataaaatgatgtgataaccagatgaacattcacgaccagcaggcagggatggcaatgctagtgtggagataatcaagattgttagcaggacgttcagctgttgacaacaccttggttacttgctgcatcgtcggacggtgtgatggatcaggctctatgcactgaacagcgatggcaaccacttgaaatatcttacttgcgacctcagcttcagggagtgggagccgggtgtccagcaatttctcaatcgatgtacttttgttgttgttgtccacggaagaaaggaaatcgcctggatgatgtcccatgaacagctctagaacaagtatcccaaagctataaacgtcgcacttctccgttacccttgttgtgtatgcaagctctggggcaagatatccttttgtccccgc

SEQ ID NO: 5029 - DNA, 546 bp, Hordeum vulgare
gggctgaggaattcggacgggatatgcgggattaagcgggctttctcggcgccatggcccaagacgctcaggtaccagggtgatgggcgaccgttctggaggattgtcgtggcggaagcaactgactgcacaaacagtgattattttgaagaagtatatcagtactatgcacatggagatgcatggcgtctgcctgatggagcttacagaacactgcgtgatttaaaggatgctggagttaagctagctgttgtatctaactttgacacacggctaaggaaattgctcaaggacctcaacgtctccgacatgtttgatgccattgtggtatcatcggaggttggatatgagaaacctgctccagagatcttcaaaatagcattagaacaaattggcgtggaagccagaaatgcagtacatgtaggagatgatgaaactgcagacaaggcgggtgctaacgctattggactcgagtgctggctgtggggagaagatgtgaaggaatttaatgagatacagcgccggatcgtagcaaaaggctcacga

SEQ ID NO: 5030 - DNA, 456 bp, Hordeum vulgare
gcaccccggttcacaaaactgctactgaaaagtttatgcacatgtaccattactattcttctcagcgcttattacaaggacgacaacagaccttgtggagaaacatatatattttggcaaattacaactgctattagggccccttaccaaacaaatgaacaaatcaggcaaaaagagtcaaaatgccctgcgctcatcgtgagccttttgctacgatccggcgctgtatctcattaaattccttcacatcttctccccacagccagcactcgagtccaatagcgttagcacccgccttgtctgcagtttcatcatctcctacatgtactgcatttctggcttccacgccaatttgttctaatgctattttgaagatctctggagcaggtttctcatatccaacctccgatgataccacaatggcatcaaacatgtcggagacgttgaggtccttga

SEQ ID NO: 5031 - DNA, 45 bp, Hordeum vulgare
ttttttttttttttttttttttttttttttttttttttttttttt

SEQ ID NO: 5032 - DNA, 557 bp, Hordeum vulgare
  UNSURE (17),(18),(40): n stands for any base
gtatctcacggcaacanntttcattttacgtttcgatgantaacgggtagagcgatcaagaggtttaaccatgagacagcactgggaagtacatggccgcttgggctcgcacacaaataacacaaagcatatatatcatcgtccaagtttctcacactcgaaagcccaaaggaaacacagcagtgctcttcactctccccgctgcaatgcgaagcgaggaccgggggagactggattttattttcaatcacaacacaagcgatgaaagagagacacaaacttggcagcgaccgccaggaaggagatcgccggattattgtggtcggggtggtggtggtggtgtcgatgatgcgaagaggcagatggatggcagaagggcgggcgtcggtgggatggtcctcagctgacgagcttcctttggaggagagccctctcgcccggcatctcataggtgcgccggaaggggtcgtttcgggcatgccacgtgtccctgggtcccagaggcacgggccgcctcacgggctccccgtgggctctggtagtggccttcaggtcca

SEQ ID NO: 5033 - DNA, 549 bp, Hordeum vulgare
gtcccccggtctgcagcacgactcctctcctctctcctcaccgcgctgtgcccaccacacgactcctctcccccaccccaccgcacggacggaagcaggcaggcgagcagctctccagcgaatcggcgaggatggaaatgctcttcagcagcctgttctgtgactcagcgtcatcggagaacttttctggccatcccggtgttgagagatgcccattcctgaggaacatcaatggagccacaaccttttcattttcttctgctttgcctgtagctgcccggggaggcaagggtccgatctttgaggatggaccaggctttgagtcggcattcaagcttttccatggacaggatgggatagtccccctttcaggaagatcatatgtgcctgatgagaacggcagtgagagcactgatgtcaagcctgaacctgctctgccctttaatccattggctgctagagccgctaccataagtctatcatcatttggaccatttgggttcaacttctttaatggcaagggcaaaaagcagaacaagaagcccaaca

SEQ ID NO: 5034 - DNA, 548 bp, Hordeum vulgare
ttttaaaacacatcttgtatatatatatagggacgaagctttttgttctgtaacaaccaaagtttcagataaagcataacaaattgcttcaaggacaaccacaatattattgtttctgagtagatatatatatcagcatcagattacagatgcatggactgacaacacaaccacgacaagtttcacagcaggacgtggtactatagcaccttattccacttgtctcacccaggggcaggcaagccaattacatacacgataaatagaaatcagtacccgggacggctaaattccacggttagaagcacatgctaggggtcggtgcaggagcgccggcgttagcagagccaggtatcttcagcgcaagaggatcccacgccttgccctcggcgtcgctgcagctgccgctcttgtctggatacatgacggtgactgtggcggcgggaccggcggtgccctttgcagcaagagtcttcagacggatgcgctcagccctagacccgatggtttgcccgaggatggaggctgctatggtgaacaccatcgcg

SEQ ID NO: 5035 - DNA, 552 bp, Hordeum vulgare
gtcctcccgggcctgcagggaattcggcacgaggcctcgtgccgaattcggcacgaggcccctcgcctcgcctcgaacacatcgccagcggagcagccgacgaaccgcagccggcgctcgatccgtccgtcgacatgggcctcaaggaggagtttgaggagtacgccgagaaggccaagacgctgcccgacaccaccaccaacgagagcaagctctgcctctacagcctctacaagcaggccaccgtcggccctgtcaacaccgaccgccctggccttttcgacctggcgggcaaggccaagtgggatgcctggaagtccgtcgaagccaaatccaaggaggaggcaatggctgactacatcaccaaggtgaagcagctgctggaggaggctgccgccgcgtccgcttcatcctaggccacaagaccacaatcgctattattgtcctggtggtgcagacatatgtgccaataaacacaaataaattcgaagtactagttgctgtcaagcttatcatcgttgtcgtggatgtgtaattacgttgaacaagccc

SEQ ID NO: 5036 - DNA, 545 bp, Hordeum vulgare
  UNSURE (2),(28),(35): n stands for any base
tnactggcgtaaactgagattgcacttntatgtantcacagggcttgttcaacgtaattacacatccacgacaacgatgataagcttgacagcaactagtacttcgaatttatttgtgtttattggcacatatgtctgcaccaccaggacaataatagcgattgtggtcttgtggcctaggatgaagcggacgcggcggcagcctcctccagcagctgcttcaccttggtgatgtagtcagccattgcctcctccttggatttggcttcgacggacttccaggcatcccacttggccttgcccgccaggtcgaaaaggccagggcggtcggtgttgacagggccgacggtggcctgcttgtagaggctgtagaggcagagcttgctctcgttggtggtggtgtcgggcagcgtcttggccttctcggcgtactcctcaaactcctccttgaggcccatgtcgacggacggatcgagcgccggctgcggttcgtcggctgctccgctggcgatgtgttcgaggcgaggcgaggggcctcgtgccga

SEQ ID NO: 5037 - DNA, 376 bp, Hordeum vulgare
gtcaagcggggtgctgttcctgctgttcggcataatgtccttgttgtcaggaccagaagggcagttgtaatttctccaggaacttcagcaggactcgccagccagtatggcctactggagtagttactaagcttaccttatttgatgggtgatggcgacgaaagccagccgtccttggcaaactggatggcgattcattagtttagtcaacaacacattgtaacatttggcttgccactcataaataacttgatgttactaaaatctctgctgatggcttcctattggtccagaaacctggaaatattcagtaaaaaccgctgtagaattgtcctgctcgcaaaaaaaaaaaaaaaaaaactcgggggggggcccg

SEQ ID NO: 5038 - DNA, 326 bp, Hordeum vulgare
attctcagcggtttttactgaatatttccggtttctggaccaatggaagccatcagcagagattttagtaacatcaagttatttatgagtggcaagccaaatgttacaatgtgttgttgactaaactaatgaatcgccatccagtttgccaaggacggctggctttcgtcgccatcacccatcaaataaggtaagcttagtaactactccagtaggccatactggctggcgagtcctgctgaagttcctggagaaattacaactgcccttctggtcctgacaacaaggacattatgccgaacagcaggaacagcaccccgcttgac

SEQ ID NO: 5039 - DNA, 351 bp, Hordeum vulgare
gggcacctgaagaacatacctggctcagtgactacagtgcctggtcccatgctactggacattagggccgactagtgattgcggtgcacatctattcgagcatggtgcgtctcttctctgccaacattttcgtaatttttgccgtggcactggtcagccagcaaaagttaccatcagaacttctttggacacttgggatctaacccgtagatcctccctgtcggttacaagctctaggttctggttctctttgcttctgtcagctctcttctcccctatcactgcgagttttcagtttgtccggcttgatctttggtgtgtatagtgtgcactgttcttcatcaggcttca

SEQ ID NO: 5040 - DNA, 245 bp, Hordeum vulgare
ttttttttttttttttttttttttttttgcaaccacttcgccactttctttattgattgcacgccaaacactaccaaacgtaccgtcacccacttccgtaataatgttatacctctccattttattagctagaatgcaacgctgtccttatttttgaacagtcctataaacacaaacaagactcatacgcgtattgccggaatgtctttggagagtaggtcaccaaagtcactgcaggctttttt

SEQ ID NO: 5041 - DNA, 510 bp, Hordeum vulgare
tgagcaagttcttggctggagattttgtctttacggagacttccttgtcatctccttcgtcaattgcacctgaagaacatacctggctcagtgactacagtgcctggtcccatgctactggacattagggccgactagtgattgcggtgcacatctattcgagcatggtgcgtctcttctctgccaacattttcgtaatttttgccgtggcactggtcagccagcaaaagttaccatcagaacttctttggacacttgggatctaacccatagatcctccctgtcggttacaagctctaggttctggttctctttgcttctgtcgctctcttctcccctatcactgcgagttttcagtttgtccggcttgatctttggtgtgtatagtgtgcactgttcttcatcaggcttcacttctgatggcgtgacgcgagggcataggtgttcaagtttagttgtcacaaagtatgggtattgcctacagacgtttgaaaaaagcctgcagtgact

SEQ ID NO: 5042 - DNA, 551 bp, Hordeum vulgare
  UNSURE (21): n stands for any base
gagtacattgggccgcttggngctcgcacacaaataacacaaagcatatatatcatcgtccaagtttccgaaagcccaaaggaaacacggcagtgctcttcactctccccgctgcaatgcgacgcgaggaccgggggagactggattttattttcaatcacaacacaaacgatgaaagagagacacaaacttggcagcgaccgccaggaaggagaccgccgaattattgtggttggggtggtggtggtggtggtgtcgatgatgcgaagaggcagatggatggcggaagggcgggcgtcggtgggatggtcctcagctgacgagcttcctctggaggagagccctctcgcccggcatctcataggtgcgccggaaggggtcgtttcgggcatgccacgtgtccctgggtcccagaggcacgggccgcctcacgggctccccgtgggctctggtagtggccttcaggtccacaaacctgtcggaaggcatgatcggcgcccggttggtggtggaggacatcgacagctgggacagcttctcggctatgtctg

SEQ ID NO: 5043 - DNA, 516 bp, Hordeum vulgare
attcgaagaaattcccatttgtaggtgattggcaaagccctcgagaagccccgcgagcgcctctcagtgctacggatggagcaagacattctcaagttcctccgtgaacctgggcagacgcagttcgagttccagggccttcggacttcgtacctacgtcttgctgcgcaccgtctggcacaacattattacctaatatcgatcgccctgtcggataacagcttgcttgatgggaccagttctcggatcatccttcgtaagacgtctgctgaatgccgattgcccgctgtccgcctagctgacattccagttaatttgcctcaagaagagaccagcgttgtggccaccaaagtagctattaagcaaaggcctcagaagaatcaccacgggggcgcaggcgcaggtgctaactcttccagaggcaaccttcagaaaagcgttgaggagaggaaagaggaatacaacagggcacgtgctcgcatatttaacaacagcagtggtagcagtagtccggtt

SEQ ID NO: 5044 - DNA, 554 bp, Hordeum vulgare
caaatttatgcgaataccaatagaagaattagtctccgaatacaattcatcatacctagtctccgaatttaaaataccgaacaaagttagaacattacaagtctcgagacagcgagtagcgagtttgtattcacattacaagtcgatatcgatcatctaaactaccatcacatagaagagagctacggtcatcacgagaaagacaggcaaaattatctaaactacaacatcgtcgacaccaagcatgttactgaagccgtgcctggagaatcacattcgcgtcctttgcctgctacccctctcctcgtcttcttccacctcgatgataaccttcctagatttccgcccaatctttgaacttgaatcagagtctgatcgcttgggtttctttcttactggctcttccatatcatattcatctccatcatcatcttcatcaccaaatccttcaaaatcttgcatatcatccatgtcacccatctcgatatcatcaccttcaacatactctatctcgccttcttctttctcttctgtctcaggagccaactcatctt

SEQ ID NO: 5045 - DNA, 420 bp, Hordeum vulgare
acgcacaacacgacttgtgagtgagagctgaagcaagctcgatcgctaggaaggaaggaagtcatggagatagcggggccgctggcgccgggggagaggccgcacgccgtgatgatcccattcccggcgcagggccacgtcacgccgatgctgaagctggccaagctactccacgccaggggcttccacgtcaccttcgtcaacaacgagttcaaccaccgccgcctgctgcgctcccagtccgccgacacgctacgcggcctgcccgcgttccggttcgccgccatcgccgacggccttccgccgtcggaccgtgaggcgacgcaggacatccccgcgctgtgctactctaccatgaccacatgcctcccacggttcaaggaactcgtcttcaagctcaacgaggaggccgaggcctcc

SEQ ID NO: 5046 - DNA, 334 bp, Hordeum vulgare
ttttttttttttttcagggaaggtctgccttatatcctttatttttaccatcttaatttgcttgtttcaggctagcaacacctcgtggatgagccgatcaacattgcgcatggaccttccgccaggacgtgcagaggccacggcgctctcccagagctccagcacgcgtcgtctcatctctcgccccttgtctccctccatggcctcccgtatgagggcctccacctcggtcctcttcacatcgtccccgatctccatcccgatgccccactccgtgcacttgtaacgacagttggtctgctgatccgcgaagaagggccaacacaccatcgga

SEQ ID NO: 5047 - DNA, 516 bp, Hordeum vulgare
cctcgtgccgctgccgtgagagatacacaggctcttaatgcttatatgagcgttttctacgtactgggcaaattcagtcctatggcgctggacctgctggtggatctgttaggcctgccgcgggagtcagtgctggcggctaccaagctgatgaccgcccggggatggctgctgggggtatgaatggtaggaatgttggttttggtggtggaatgccagagcctccccttcccccagatgcctcaaataccttgttcattgaaggcatccctactgactgtgaacgccgagaagtttctcatatctttcgaccatttgttggttttcaggaggtgagacttgtaaacaaagaaccaagacatcctggtggtgacccaatcgttctctgttttgttgattttgctaatgctgctcaagcagctattgccatggaagctttgcaaggctataagtttgatgaacatgaccgcagttcacctcagctgcggctgcagtttgctcgttttaagggtccaa

SEQ ID NO: 5048 - DNA, 519 bp, Hordeum vulgare
cgtttgtacaatacaattccagatgattcagacatggtcttgaggttgccgcagtcatattccccttccacgcttaaacagttcgtttcgtttggtccaggaaatcaccttgccagaccaaggtactaatgtctttggaacggtagagggagcaaaagctatcaatactagtactacagggagaaataaatacatctgcaacaacaaccaaaatattatagccgcgctttgaagcatgatcggacctacgaggtgatataagaaataaattagctcgcgttgtcgtccagcgccaagagcttgtggtcaaccgaattcagcaaacaacacggccgagacggttgaatcataggcgcaacaacttaacgcctaataccaccaccgccaccaccaccaccaggtcctcctgcttgcccccttggacccttaaaacgagcaaactgcagccgcagctgaggtgaactgcggtcatgttcatcaaacttatagccttgcaaagcttccatggcaatagctgct

SEQ ID NO: 5049 - DNA, 498 bp, Hordeum vulgare
  UNSURE (20): n stands for any base
gtctccccgggcctgcaggnaattcggcacgaggcgcggcggcgtgccgtgcgacagctggaggctgggcgtggaggcgtacaacgtgcgggactggaagacggtgccggccaactgcgagggctacgtggggcactacatgctcggcaaccacttccggcgcgacttcaaggtcgtcatcgaccaggccatcgcctacgtcgacggcctcaagctcaacggcaacggcaaggacgtgtgggtcttcgacatcgacgagaccaccctctccaacctcccttactacgccacgcacggctttggggctaggccatacaacgcgacgagcttcgacgcgtacgtgctggaggggagcgcgccggcgctgccggagacgaagcggctctactacaagctactcaaggtgggcatcaagccggtgttcatcacaggccggacggaggacaagagggccgtcaccgtcgggaacctccgcagccagggcttctccgggtggat

SEQ ID NO: 5050 - DNA, 542 bp, Hordeum vulgare
agtggattattactgatgcatcgagcatgcagataacaattactccatggagtatcaagagagcatggagcttgattattattcgtggagcacgagcatggggcaaccaaatggccgcagccgacctaggcgatgtagtaaatggggtcaggcagcttgaaggtgcgagcgccctcgggcgcgccgaggatgtcgctccactggtcgccgatgttgccgacgatgacgtacccggcgtcctgcagcttcttcctctcggcggacttgtaggatatggcggagcccttgaatccgtgctgcttgagcgtcaggttcatccacccggagaagccctggctgcggaggttcccgacggtgacggccctcttgtcctccgtccggcctgtgatgaacaccggcttgatgcccaccttgagtagcttgtagtagagccgcttcgtctccggcagcgccggcgcgctcccctccagcacgtacgcgtcgaagctcgtcgcgttgtatggcctagccccaaagccgtgcgtggcgtagtaagggaggtt

SEQ ID NO: 5051 - DNA, 552 bp, Hordeum vulgare
  UNSURE (20),(537): n stands for any base
gtacccccgggcctgcaggnaattcggcacgaggaagctttggaaaatgtatttcgtgcagctgaagcatgtgaagaatttagtggagttttagttaccctaagaatggctcttgatgatctttgtggtctaaccggtgagaatgtgggccccttgcctggttacttagaagaagctgtgaaatccgcctatagccgatacatgacatatctggaatcttttggtcctgaagagcactatctacggaaaaaagtggagaccgagttggggacaaaaatgattcacctgaaaatgagatgcagtggcatagggtctgagtggggaaagatcacccttattggcacctcagggatctcagggtcctatgttgagatgagggcatgatggaactctcattccagaaccatggccaaacactgatggtctgacgggaagctgcgtatcgatatcagaaccaggtgttccgtttccttttatctttccccagtagctgccatgccaataacaaggagatcgtcaaaacatgtgcactcactntaagtagctctttgc

SEQ ID NO: 5052 - DNA, 531 bp, Hordeum vulgare
tattaaatatattgtttctaacatgcgagacgtacaaagaccatccatcatggtttgagcaacaaaacaaaaccaacagaacctccagaaacatgtacttattacagcaggaaagtctggagcgcaaagagctacttaaagtgagtgcacatgttttgacgatctccttgttattggcatggcagctactggggaaagataaaaggaaacggaacacctggttctgatatcgatacgcagcttcccgtcagaccatcagtgtttggccatggttctggaatgagagttccatcatgccctcatctcaacataggaccctgagatccctgaggtgccaataagggtgatctttccccactcagaccctatgccactgcatctcattttcaggtgaatcatttttgtccccaactcggtctccacttttttccgtagatagtgctcttcaggaccaaaagattccagatatgtcatgtatcggctataggcggatttcacagcttcttctaagtaaccaggcaaggggcccac

SEQ ID NO: 5053 - DNA, 468 bp, Hordeum vulgare
  UNSURE (15): n stands for any base
ggcacgatggaaatngagccagggtatggtaagacatatatgcagaagcagaaaaatgaaccataactctgcaaagagcaatacataaacaagggaagaaaggtgattaagtactgacctcaccggttagaccacaaagatcatcaagagccattcttagggtaactaaaactccactaaattcttcacatgcttcagctgcacgaaatacattttccaaagcttcttgaccagccttatcatcagtagctttagatacttctttctttgcttcctcaacaagagaacccggaagctcattccagctggcagccatcaaatccttaaatgcagtctcaattttcgggtcagatattggaggcagatgtttctcatttgaactgaacatgcgccttgagttccatgagaaagcattgttgccatctgtgtatacaacatgaaaatgttaatgaacaatgagcacaaaaa

SEQ ID NO: 5054 - DNA, 441 bp, Hordeum vulgare
tattgttattaaattttatgttgtatcacagatggcaacaatgctttctcatggaactcaaggcgcatgttcagttcaaatgagaaacatctgcctccatatctgacccgaaaattgagactgcatttaaggatttgatggctgccagctggaatgagcttccgggttctcttgttgaggaagcaaagaaagaagtatctaaagctactgatgataaggctggtcaagaagctttggaaaatgtatttcgtgcagctgaagcatgtgaagaatttagtggagttttagttaccctaagaatggctcttgatgatctttgtggtctaaccggtgaggtcagtacttaatcacctttcttcccttgtttatgtattgctctttgcagagttatggttcatttttctgcttctgcatatatgtcttaccaaccctggctcattt

SEQ ID NO: 5055 - DNA, 533 bp, Hordeum vulgare
ccgggcctgcagggaattcggcacgagggtgaaggacgccgcgagcgccgccaaggccaaggccaagatcacgcacgccaaggtggccgagaagacggaggcggcacggaaggtacacgacgagcgtgagctggcgcacgagcggggcaaggccaaggtcgccgccgccgaggcggagctgtaccaggccaaggtgacccaccgcgaggaagccatggagcaccgcctccacaagcgcgggcataagcacagcggcggtcactgatgtgagccgaacagccgtccgtaaggctatgaagatgtgcgtcgttcatgcgagcaagccggcctatcctggtttcgtactcttcttccatttcttagttccattccaaatgtgtgttatttgacgtcgggcttaatttggagaggtgagaggtgcctgccccgtgtgcatatgtacttatatacgtactgtatgtgtgatgcgtttttgcttcttgaataattaatactaacggtatgttatatctacaacaaaaaaaaaaaaaaaa

SEQ ID NO: 5056 - DNA, 457 bp, Hordeum vulgare
taagaagcaaaaacgcatcacacatacagtacgtatataagtacatatgcacacggggcaggcacctctcacctctccaaattaagcccgacgtcaaataacacacatttggaatggaactaagaaatggaagaagagtacgaaaccaggataggccggcttgctcgcatgaacgacgcacatcttcatagccttacggacggctgttcggctcacatcagtgaccgccgctgtgcttatgcccgcgcttgtggaggcggtgctccatggcttcctcgcggtgggtcaccttggcctggtacagctccgcctcggcggcggcgaccttggccttgccccgctcgtgcgccagctcacgctcgtcgtgtgaccttgccgtcgccgcctccgtcttctcggccaccttggcgtgcgtgatcttggccttggccttggcggcgctcgcggcgtccttcac

SEQ ID NO: 5057 - DNA, 523 bp, Hordeum vulgare
ggatttcatgctcaaatacgcgatggagattttactttctgaatcaagtgttatcaccaatcactatttcaattggaatacaagttcagtggcaatatttctggcaattcttgggttgacagtgcttcctattaatgctgttgttggaacatatatcagcaacatgtttgaggacaggcaactcttgatggcttctcaaattacattgctagtaggcattattttcagcttcaaagtcacgagtacatactccgtcatccagtatgttgtctcagcactcattacatttgtgtctgctgaagttcttgaaggcgtcaacctttcccttctgtcgagtgtgatgtcttcccgcctatcccggggcacatacaacggtggcctcctctcaacggaggctggcaccctggcgagggtggtggccgactgcaccatcacagctgcggggtacctgggaattgggagcctcctcaatgtcaccctgctgccctccctggtgatctgtgccgcatcaattgcatgcacc

SEQ ID NO: 5058 - DNA, 553 bp, Hordeum vulgare
gtcacaaaccggatcaaattttgcaggacccaagactgcatcgggtacatgattatgctgcactgactgaaccgaccggcatgtacgattgtcccttcgggcaaccacagaatcaaagccggccagcagccagctatcgaattatccaacctggaacggatggtgagaacacgtacagtggcgatcaatcattgcagtttagaagagggagttgtaggtcaagaaggtgcatgcaattgatgcggcacagatcaccagggagggcagcagggtgacattgaggaggctcccaattcccaggtaccccgcagctgtgatggtgcagtcggccaccaccctcgccagggtgccagcctccgttgagaggaggccaccgttgtatgtgccccgggataggcgggaagacatcacactcgacagaagggaaaggttgacgccttcaagaacttcagcagacacaaatgtaatgagtgctgagacaacatactggatgacggagtatgtactcgtgactttgaagctgaaaataatgcctactagcaatgtaatttga

SEQ ID NO: 5059 - DNA, 527 bp, Hordeum vulgare
ggtctggtcaatcaagaacctccgggaggctgcccgctccgacgggaaagcggccgtgaacctgatgaagctcacactcttccgccagtactacgtggttgtcatctgctacatttacttcacacgtgttgtggtctacgccttggtgaccatcacctcgtaccggtacctctggactagcgtcgtggctggagagattgccacccttgcattctatgtattcactggctacaggttccggcctgaggtgcataacccatactttgcgattgatgatgatgaagaggaggctgcagctgaagcactcaagttggatgatgaatttgagctatgagtaccaaaatttggtggccttttccctgccagtgctacacaggtgttatattgtgcttccacaggaaaaatgctttcacaagacaattgcgatagactggtatctagcccatacccttttgttttttgtttaaagttagcttacattctgcgttactgtaatttggtatcaaccaccctgtgtgtgtgtgcgt

SEQ ID NO: 5060 - DNA, 552 bp, Hordeum vulgare
  UNSURE (21): n stands for any base
gaataacaaactgaatatagntaacttcttttaccagacagaaagtaaacatctagatacaacaatagctacagagatacaatgaagaacagctcatcttaggaatgtatttaagtacaatcaagctgctgcattgcttgacacacgcacacacacacagggtggttgataccaaattacagtaacgcagaatgtaagctaactttaaacaaaaaacaaaagggtatgggctagataccagtctatcgcaattgtcttgtgaaagcatttttcctgtggaagcacaatataacacctgtgtagcactggcagggaaaaggccaccaaattttggtactcatagctcaaattcatcatccaacttgagtgcttcagctgcagcctcctcttcatcatcatcaatcgcaaagtatgggttatgcacctcaggccggaacctgtagccagtgaatacatagaatgcaagggtggcaatctctccagccacgacgctagtccagaggtaccggtacgaggtgatggtcaccaaggcgtagaccacaacacgtgtga

SEQ ID NO: 5061 - DNA, 521 bp, Hordeum vulgare
  UNSURE (20),(21): n stands for any base
attcaaacctccccccccannatccgcaccagtcgccatgggcccgtaccaagcagaccgcccgcaagtccaccggcggcaaggcgccccgcaagcagctcgccaccaaggcggcgaggaagtcggcgccgaccaccggcggcgtgaagaagcctcaccgctacaggcccgggaccgtggccctccgcgagatccgcaagtaccagaagagcacggagctgctgatccgcaagctgccgttccagcgcctggtgagggagatcgcgcaggacttcaagaccgacctcaggttccagtcccacgccgtgctggccctccaggaggctgccgaggcgtaccttgtcgggctgttcgaggacaccaacctgtgcgccatccacgccaagcgcgtcaccatcatgcccaaggacatccagctcgcccgccgcatccgtggcgagagggcgtaagccatcctctccgtcgacgccgttagtggaccggaatgcgcttccggtcgtagttggttaccgattcccgtg

SEQ ID NO: 5062 - DNA, 556 bp, Hordeum vulgare
  UNSURE (71): n stands for any base
ataaggtttggctcaatcgcaaacccaaaggatcatcacatatcaagtcttgtcttactcgtaccaacaanccatatttcttctacacaacagcagagagacctagcacgggaatcggtaaccaactacgaccggaagcgcattccggtccactaacggcgtcgacggagaggatggcttacgccctctcgccacggatgcggcgggcgagctggatgtccttgggcatgatggtgacgcgcttggcgtggatggcgcacaggttggtgtcctcgaacagcccgacaaggtacgcctcggcagcctcctggagggccagcacggcgtgggactggaacctgaggtcggtcttgaagtcctgcgcgatctccctcaccaggcgctggaacggcagcttgcggatcagcagctccgtgctcttctggtacttgcggatctcgcggagggccacggtcccgggcctgtagcggtgaggcttcttcacgccgccggtggtcggcgccgacttcctcgccgccttggtggcgagctgcttgcggggcgccttgccgccggt

SEQ ID NO: 5063 - DNA, 519 bp, Hordeum vulgare
  UNSURE (9): n stands for any base
gtcatatanttcgtacaatgaaagcatcgtggaggcagccgctaagattgctagattctcatccgtgtcaaccccgacccagcgcctgcttgttgccatgctttcagaccagaagtttatctcgaattacctgaaagttaacagagagaggctgcacaaggcgtacaatttgctcgttgatgctttgaaacaggtgggcgtcgagtgcttcaagagcagcggaggattctactgctgggcggatatgagcaagttcatccggtcttacagcgagaaaggggaacgcaggctttgggacaggctgttggaggaggcgaaggtcaatgtcaccccaggttcatcttgccattgcattgagcctggatggtttaggtgctgtttcacaacgttgagggagcaggatattcctgtggtggtggagaggctcaggagagtcacagatggccacaaatcaaaccgttgagatgtccaaagtactctttttggcctgtagggtgtcgaaaaataactgcttcgcca

SEQ ID NO: 5064 - DNA, 541 bp, Hordeum vulgare
tgaacctgaattacaaaccggatactttacagatgatgacagcaacggaagaaaccgagttcatcgactctaatttatgttaccaaagaacaaaattgccaggagagagaggaagaagggtaacaggagcgaataggtgaatgaacacactgatttttgactcggactatcatgagacgggcaatttaccgcatgcgacacctacgagagaagcagacgaggatcaacaatttacaaccttccaaagagctaccacgcttggattcaacaggagcggaggaacggagggggcatgaccaatatgaacatgatccctgttcttcgttccaccaccgaagacatgcgccactgcttccaccaactgccagcttcaaaactcccccgatggtagatgccaagatggaaattctctgatcggagttcggaacagatcaggttaaggcattttttttcctgtgtgctcctgcgtttcttgtgaagcacctggcgaagcagttatttttcgacaccctacaggccaaaaagagtactttggacatct

SEQ ID NO: 5065 - DNA, 502 bp, Hordeum vulgare
aagataagagcggccagataaggtgctgccggcgatgacgagcatcgaaggggacgtggtggagttcgccggcggggagcggcaccgcttcgatgccatcgtcttcgccaccgggtaccgcagcacggcaaagaagtggctcaagagcgacggcggcgggctgatcggtgacgatgggatggcgtccgggagatgtcccaagggggagaatgggttgtaccgcgctgggctggcagggagagggatctacggcagcggcacagacggggagttcatcgcggaggacatcagcaggcagctgcttcagggctctggcgatgacggaggcgatggagccatcaccgccaacgacggtggcgatggggtatagagcttggatgaatgcatgtgggcgacgagtggttatgcggggttaaacggattttattggtcaactgtacgcatgcttcttcagttcacataagatgcttaaatattttaatataagaaaatctaaaaaaaa

SEQ ID NO: 5066 - DNA, 495 bp, Hordeum vulgare
gattttcttatattaaaatatttaagcatcttatgtgaactgaagaagcatgcgtacagttgaccaataaaatccgtttaaccccgcataaccactcgtcgcccacatgcattcatccaagctctataccccatcgccaccgtcgttggcggtgatggctccatcgcctccgtcatcgccagagccctgaagcagctgcctgctgatgtcctccgcgatgaactccccgtctgtgccgctgccgtagatccctctccctgccagcccagcgcggtacaacccattctcccccttgggacatctcccggacgccatcccatcgtcaccgatcagcccgccgccgtcgctcttgagccacttctttgccgtgctgcggtacccggtggcgaagacgatggcatcgaagcggtgccgctccccgccggcgaactccaccacgtccccttcgatgctcgtcatcgccggcagcaccttgatctggccgctcttgatctt

SEQ ID NO: 5067 - DNA, 525 bp, Hordeum vulgare
  UNSURE (49): n stands for any base
atgaaagttatgacagctgggtttggttcttgatgcagctgaggattgnctctccaatatcacaactacccgttggatgctatgacattcttgtccaatggacgaaagggtctggatgctgctgtcccacgtgtgtttgaagatagccaccacgccttctgtttacattatatcatggaggaattcagaggagaactgaggaagggaccatggtcgcaacagataagagatgcgatggtcgaggattttactcgtgcggccgaagcatgtagcattgatgagtttaatgcatcaattcagagcataaggaatatatccactgaagctgccgactggatcattgcgagtaagccagagcattggtcagatgccgtcttcggaggctgtcggtatgaccatttctcatcggacattgtggatgcatttaataactggataccaacaaagaaggaggggtcgatggtgctgatgatagactctctgagaataaaaatagcggaggtaatggaagcaaggcgtgaagcc

SEQ ID NO: 5068 - DNA, 542 bp, Hordeum vulgare
  UNSURE (33),(47): n stands for any base
tattgtactggcgattgggacactctccagtgnacaatatgacacanagggcatctgactagcaataactatgacctaaagaacaatctgagatataccatgacactaggataaaatacctacagctatgactaaacagctaaccatcggctactctgttttcagctgacactgtccagaagctagcaccttatctccacctctagtcaatccctacagaacctcaagttccacccttcatataaacaagtgatgtcaactgatgtatcattatcgccgtccttccatctacacacagcagccaccaccataaactctctttcaccacatcagacctctaggtgagcctgctatacatactgtagatgaagaatttgctttgtctacagagcagcttcacatgttgccttgttgtggcctgcctgcttgcacctgctacatagccgtataagagtggttaccttgttcggattaaacctctttcttctcggtttatctgatgtacgaggcttgggaggtgggatcgttgccccagcactaaa

SEQ ID NO: 5069 - DNA, 491 bp, Hordeum vulgare
taaaaaatttcctggtttagattctttgatgtctcactctcggaattcgcagcctagagagcagagcaatggacctaaggcgccagtcgctaaactctttgagcaagttgggttacagaagatattgtcattacttgagtcggaagaacctgatgttcgtgttcatgccgtgaaagttgtcgcgaatctggcagctgaagaggcaaatcaagaaaagattgtggaagcaggtggcctcacttccctcctaatgctgcttaggagctctgaggatgagaccatacgccgagtagcagcaggagcaattgctaatcttgcaatgaatgaaacgaaccaagatcttataatggctcaaggtggtgtaaccttgttgtcaatgacagcatctgatgcagaggacccacaaactctaagaatggtggctggagctattgctaacctgtgtggcaatgacaaactgcaaactcgtttaagaggagaaggtggaatta

SEQ ID NO: 5070 - DNA, 549 bp, Hordeum vulgare
tgtctactgtacaattaatacaagtatacaaagtatgatccatgccacggcccaacccaagccaacctatctgcactgcaagccactcagctgcacatatcccgaccatgctcgtggattttacaacacagattctcctacaggttacatccaggtaagtaaagctctcacacgctaggatttgaaaaacgaatcccagccataaacaaaatgaatcatcttggggagaatgatggcgcagaccaaactcaacgggtccgctgcccggcctggccatgtatgcttgcttgcttgcttgcagaagctgggcatatcaagggccgacgcgcctgattaccagtgcttgcccaccagcagcgcctctactaaacttgggagatttgggcgagaaacataagtccacacggtgtgaggatgaggcacacttgcatccttttatgttgattcatcaacactctatccgcaatctcctcatctccgattgaagagttgggctggatgtcagcgtgcggtatgccaacatccttatatcttcccgagaacaatccc

SEQ ID NO: 5071 - DNA, 431 bp, Hordeum vulgare
atggcggccccttgtcccgcggccacccgcgcccgcgcccgccacctccgccaccagcaccctagccgatgcagccgcgccatcaacctccggcatggcgtcaacacgcacctatatcggccgccaggggttgcgctcggatggcgtccacgatgacggctacaccctcggcaagctcaaccccgacgccgcctcatcttcttcaactccgtcgcctcgtcgtctatctacaccgtcgcgacgtctcgagggtgggaactctgtggccagttcccctcgccgaccaccacatcggtcggtttccacgaccctgttcgctagccgcaaagacagtgacgctgatgtcagggacttgggatctatgcctgcacatgtgtctgtcatggctagcgatgctcctgggacccttgagccggtggtggtaaccgaaa

SEQ ID NO: 5072 - DNA, 549 bp, Hordeum vulgare
aatgtaggaaaacacttgaaccatgtacatgcatatagacaatgagaatcatgtagaagatttctcagcaatgtttgcttagacacagagcttataatacaaataaagctgatatgcacacacatgtcatttacagggaatacttgtttttgcacatacatgtgcagaaaatttagcttgtctactaacatagctaggccaagacctcgaagaataatactctgctaggcgccttcagttcacgaagcattcatgagtatccatgtgtatagagtcgagttttgttgagcaactcatcgtaggttacttcttgggctggtaccacaattgtggacagaattgcaggttactcctccatctctactggaattagagcattatggacaaaattcacacactgcctggaatatatcatcttcacttaaacaaatccagtgtatataaatagaaccaattattattataccgtcgcttaaataccatcctcgaggagccatgctacacaaaattccattagaagctgcaccaacgataaacaattgaatattc

SEQ ID NO: 5073 - DNA, 519 bp, Hordeum vulgare
gctcaaagcaacacattcaatcacataattaaaccaagaaagggagagagagcaatggccactcaggcagagaccattgaggttcccgcggacgctgagctgctgcaggcacaggcagacctgtggcgccacagcctctactacctctcctccatggcgctccggtgcgccgtcgagctcgagatcccgactgcgatccaccgcctaggcggggtcgcctcgctgcccgacctgatggccgcgctgtcccttccctcggttaagatgtctttcctcggccgggtcatgcgcgtgctcgtcaactcgggtgtcttcgcagccgataacagctccgagtacggggtggagctctaccgcctcaccccattgtcccgcgttctggtgcacggcgtcctagcggacgagcaccatagccaaaagtattttgttcttggtgtcacctcgccgcactacacggaggcggcgttggggctggccgactggtttaagaaggacacagaacttccagtgttgtcacct

SEQ ID NO: 5074 - DNA, 553 bp, Hordeum vulgare
tacgaggacaatactatattaagcacgacaacaaactacaagcacacaccattggagcacactaacatgacaaacacatacatatgccaatataaagtgctttaatacttttccgagcgaacgctgcatggaccttgaagcaactaatctttatactttagctacttcaagacccctggaacattcccttagaaaaataagcacctcctttatttttacctttaaagcacaatatcttacgggtagacctcgatgactgatcgggctcccaatttcttcacaattttgtagtcagtgaatcccgccttcttaaatagctcacaccagtgattttcatcacgttgaccccctctcgtgttcaccatcatgagcatatccatcaggagttgggcttcaaacattactggccctaaggaaggtccaaccacaatctctatgattattacctttcccccctcctcccgcggaggaatggcctttctgcactgggctaggattttcacgcaatcctcatcactccaaaagtgtagcacaagcttgagcatcaccactt

SEQ ID NO: 5075 - DNA, 517 bp, Hordeum vulgare
ggcgacatcttcaggggctcgagtccctgactgactgctgcggtggcgatggtacgacggcgagggccctcgtcaaggcttatccgcacatcaagtgcaccgtgttggaccttccgaaggtgatcgacaaagccccaaaggatggtgtcgttaactatgtagcgggtgacctgttccacaccgtcccatcttctcaagccgtcatgcttaagcttgtgctacacttttggagcgatgaggattgcgtgaaaatcttaacccagtgcaagaaggccattcctccgcacgacgagggaggaaagataattatcatagacattgtgattggaccatccttagggccaataatgtttgaagcccaactcctgatggatatgctcatgatggtgacaacaagaggggtccaacggagtgaaaatgactggcgcaagctattcatggaagcagggttcaaagactataaaattgtgaggaaactgggagctcgatgcgttatcgaggtctacccataagatgt

SEQ ID NO: 5076 - DNA, 518 bp, Hordeum vulgare
cttagagcacaacatcttatgggtagacctcgataacgcatcgagctcccagtttcctcacaattttatagtctttgaaccctgcttccatgaatagcttgcgccagtcattttcactccgttggacccctcttgttgtcaccatcatgagcatatccatcaggagttgggcttcaaacattattggccctaaggatggtccaatcacaatgtctatgataattatctttcctccctcgtcgtgcggaggaatggccttcttgcactgggttaagattttcacgcaatcctcatcgctccaaaagtgtagcacaagcttaagcatgacggcttgagaagatgggacggtgtggaacaggtcacccgctacatagttaacgacaccatcctttggggctttgtcgatcaccttcggaaggtccaacacggtgcacttgatgtgcggataagccttgacgagggccctcgccgtcgtaccatcgccaccgcagcagtcagtcagggactcgagccccttg

SEQ ID NO: 5077 - DNA, 162 bp, Hordeum vulgare
acagcatcatctagtttggactagcaagacttcatggctacacaaggcagcgcccgtctagccctcatcgcggtgctctccgccgtgtgcttgctgccggtgctggccaccgcgcagctccgggtggggttctaccagaagacctgccccaacgccgaggcg

SEQ ID NO: 5078 - DNA, 416 bp, Hordeum vulgare
gcacctgtggcctttttttttttttttttggtgttgcaattcaaattagcataattaaggcgtagagtttaattccgattggcgacaaaacaaacttggcacacgcggcaagtactagcactagtactcaacaaagtaataaaagcgcacacatgcatgcgcatcctggcatgggtgacgacgcgtgaaaaactcataatttgcaaatcccaagtgaaagaggccggcggggaaagcacatggactagatcggtgcccgcgtctcgtctagctcgtggcgacgaggccctcctcttccacggatccctcgaggtgaaccgacgtcgggttgacgacgttgcagttgaggcgtacctggccgcagcttcccgtctgcacctggatgcggcccatcttcaccatggcacgccgcgaag

SEQ ID NO: 5079 - DNA, 525 bp, Hordeum vulgare
cacccgacctgaccgaagtgaccaacccccaatccaacccttctttgccgcctcgccggcgagatgcctggcgcggccgacggggaggccggctccacctccgccccacaacacctcagggctctgctccgcctctggagaattccggcagccagcgccgccacggcggatccgagtattcgacgctgcataccctcgggccccgcctcctccggcgtcactgctcctccgccccgctgctcctccgcggccgtattcggccgacgcgctgttctatgctcagggccaccagacgctccctgtaaggtcagaaactcttactacttgttgctgccaccctagtcctacatcatagtactacggctaatggggcagggtcctctgggggcatcagcatggcacagcctggctgcccagataagtgtggcaacatcagcatcccgtacccgtttggcaccggaaaaggctgctttcaagaaccctttaatgtcacatgcaatcagaccggggcgtatctggcctcaa

SEQ ID NO: 5080 - DNA, 548 bp, Hordeum vulgare
gagaggagtacagtgttacttaataaacagggagtatctgcaggagcacaacttctaggagactgcaatataattgctatctttgactgcagtttatgattactccagttcaaaattatgattactgcagtgccggccgagctaacctcgctgccaaaacgaattctaatgagtagttgaacaacactgcatgcgaattctcatactggaaaggaacacagaaactggcaagtcaaatgtcatggaaaactccacacaggaacacacaacacacaacaaattccaacttctacttacatacttggtacctccaacacagcacagctacctgtacatttcagctgggacagtataaaccctgaagctctaagcctctaaggcacacactttctcctggcaatactgctccaaaggaaggttcagatgaaacttcatcatctgggcgcctctatgcccattccagacatgtacggcaccgtcgagggggcacccgaggacgacgacgcgagatcccaaggcatcggagcatccacaggtggcatgtgcac

SEQ ID NO: 5081 - DNA, 518 bp, Hordeum vulgare
gacagtcttcttccgcgagtgcctctcctaattctgcgacaggtaactgcccatcttgagaaaatgaagctcccaacaaaacagtcagggataactggggattctagtcgccttggttcagatgatactgcccggcggcctccttcagtaaaggcttctctgtccgtctcttttggacagcgtgctccacaccgtgcatccacaagggactcgtccccagtccgaaagacattgccttctgtacgagaaagggaaaggagccatgatggcggtcatgccaaatctccaccaaggaagcaccggagtcagagccgtgagcgcagtcgtgacactgagagggaccgttcagatcgtgaccgtggcaggtataaggatagggagcacggccggcaaagccgtgataatagagaccgtgactaccgccgctcgagctattcagacagggatgtcgagaggcgaggccatgaaaggcgggacagggactctgatcgaaacgggcgttcgagtggccgccgaag

SEQ ID NO: 5082 - DNA, 552 bp, Hordeum vulgare
gagctacaatgcataaagcatatatcagatacagaatttgactattcaaagtgaacaaacaatttatctcagcttagccggccaacagattttgcattgtacacgctaatcagagacatttttccctagggaaggcagagagcgcaggggagaccaaacccattatgtatgtctgctgcgcaacgccagcagcgtatagcaatgttagtacaacacaaggatagaatccccatggtttttggcttctgacagtcacctccacctggcgcctcccaatctgatcacctcttcagttccggaatccctgcggggggctctatcatcgccagcatcgtcctttgcgtttgtagcatcaccatacagatccttcagcttcgccaggttggatgactccggagctttaccaaacgggctggaacgatggctgtcgccattggtcctgccacggcttggactcctgctcctgctcctgctcctgctcctgcttcggcggccactcgaacgcccgtttcgatcagagtccctgtcccgcctttcatggcctcgcctctc

SEQ ID NO: 5083 - DNA, 550 bp, Hordeum vulgare
gtctctcccgggctgcagggaattcggcacggaggaaagcccaggaaaggagagcggagcagagcacaacccttggaggcttcttcttcttcttcttcttcttcttcttcttccatagtaacccaccctaccctttgccaagatgtacgacgctccgtcggggcaggagatgtcctacaccgaccacgtgcagaggcgccacgaggagaagggctgcctctacgcatgcgtgttcacggcgctgtgctgtttctgctgctacgagacctgcgagtgctgcctcgactgcctctgctgctgctgcaactaaaccagccatggccgccatggacggaggccgcaaggcgcagcggagacccccaccggcctcagccgcctttcataataagcatatatgtgtgtctagtgtctcagctcgatcagaagaactgtatcagatatttctgtactgcctttcacaataagcatatatatggtttctagtcttattttacgccggttgtggctttcttttacttccaattgtttactttacagccttttcataggc

SEQ ID NO: 5084 - DNA, 554 bp, Hordeum vulgare
  UNSURE (16),(19): n stands for any base
ggaagggaaactaatnctnccagcctctgcatcagaaagatgcatacggccacatttatttaaaataacgggaaatgtctagtctagaaatagcctatgaaaaggctgtaaagtaaacaattggaagtaaaagaaagccacaaccggcgtaaaataagactagaaaccatatatatgcttattgtgaaaggcagtacagaaatatctgatacagttcttctgatcgagctgagacactagacacacatatatgcttattatgaaaggcggctgaggccggtgggggtctccgctgcgccttgcggcctccgtccatggcggccatggctggtttagttgcagcagcagcagaggcagtcgaggcagcactcgcaggtctcgtagcagcagaaacagcacagcgccgtgaacacgcatgcgtagaggcagcccttctcctcgtggcgcctctgcacgtggtcggtgtaggacatctcctgccccgacggagcgtcgtacatcttggcaaagggtagggtgggttactatggaagaagaagaagaagaagaagaag

SEQ ID NO: 5085 - DNA, 269 bp, Hordeum vulgare
ctcagctggagttcctcaaccaggaaggagcgcaggccgaggtctgggcgctgtcgaggatacatcctcgacacactcgcggaagagactggccaggtagttaaggccatcttccctgacgctggagtggctgcccttctcaagcatcaggggcgagatgcaaagttcaagtgtgcaagtcttagcgaccgaaagccagttgataccgatgatggagttgttgttatgataatccctgatcaccagatgcttgaatcagttgaacgcat

SEQ ID NO: 5086 - DNA, 504 bp, Hordeum vulgare
gatccgatatgatgtgtgtatactgtacagtacacatacacagttttaacctttgctaacgaccatgtgcaaaccattgttttgaacttctgatttctgaacatcagtagtgagtaaccctgcccaagcaccatccttgacaaacctttgtcttatgatggcttcaaatgtgaggaaagctgtctggaatttttcacttggagatgactctcataaaccggctcaccgaactaaacgcagccatgacgttgttcatcattgaaggttcctcgtcaggttgctcgctggcgcccccaccgccgaatattatctcaatatctgttgcatcagggcgacttgaagattctctggcgagcaaataccggttgggtctttttggatcatcataaaacactttccacttttccggatagcatctgaagattgcaccagtaggcaatggcctcatcgagtaaacagtggtaaaggtacttaagaaatttctgcgtagattccgaacattat

SEQ ID NO: 5087 - DNA, 319 bp, Hordeum vulgare
caggtatcgtggacgcgtccaagctgctgcccgaggccgagaagcggtgccgcatgctctggtgggtggacggccgaaagcgggtgtcatctccagagctccggtcggcgttgcgcaactacgcagggaacgtgacgtcgtacgtgctggcggacgaggctgtgggcacggtgctgagcaagccgctggtggaggtggcgagcatggtgcgggaggccatcacgtccgtcaactacgacgagctgtaccaggacatggtggactggctggaggtgcacaagccacaaaagttcatcgagacgtccttcatcggtctcgg

SEQ ID NO: 5088 - DNA, 244 bp, Hordeum vulgare
tttttttttttttttttttttttttttttgcgtgaaggcaaactggagctttatttattcaatggagaaacttttacaactcgcaacacaatgcacaaccaagtagacatgcacttaaacaacaggaatcgatcttcaaaacatggatgcatttgcatttgcaggagaagaattaatttagagacgaggtcttgaaaacacggcgtcacgcagcgcatagtttgcacgggtaagaccaaggtac

SEQ ID NO: 5089 - DNA, 517 bp, Hordeum vulgare
ggactctcaagcaggtacacctactgttaaggcaacttcgtcatatgatgaaggttcccagacattctctttgaaattaagtcaagaagtgccacctacccctggccaaccgatgaaagagccaatgttcatacctgttgctgttggacttgttgattctaccggagaagatatgcccctgacttccatctacagtgatgggatggtccaaacactctctaatgatggtcatccagtcttcaccacagtgcttcagtttaagaagacggaggaagagtttatatttaataatgtacctgagagaccggttccttccttgttgaggggatacagtgctcccatccgtcttgattctgatctgactgagagtgacttgtatttcttacttgccaatgattcagatgaatttaacagatgggaagcaggtcaaatattggcacgcaaattgatgttcagtcttgtggctgacttccaacaacagaaaacactggcgctaaatacaaaatttgttgatgga

SEQ ID NO: 5090 - DNA, 549 bp, Hordeum vulgare
ggtcgtgtactcaaaaatgccctgagtaccccgaggcaccgtccttcagaaaacatgattcaacacaacgtgaagacaataacgaagccagaattcaaatgtattgccactatagtagcctgttatttcacgcatgctaaatacagcagaatatattcagttaagtacactttcagagcgctggtaatggtgaaagggtcgactggcagaatcaaatttgtttctttgcatcaggaaactaagctgccagacttttcgaggctatctcatagacattttcagagagtccattggctgagataatcatctccaactgggccttagcaagagcttgtctcgtctcgtcatatctcctccatcgagagaatgctgacaccatgcgggatgccacctgaggatttattttgtcgagctgtaaaacaacttcacccaagaacttgtaaccagaaccatctttcgcgtgaaaactcacaggtgacccacaaaagcctccaattaaagagtataccttgttcggattccgcatgtcaaaagcaggatgagccagta

SEQ ID NO: 5091 - DNA, 510 bp, Hordeum vulgare
  UNSURE (4): n stands for any base
gggnaaaacctcgctcgctctcgcgaccgaacgcgacggcgcgagcttatctccttatctctccgacgaccaggagcagcggatccacttcggagatccagcccgacccggcggcgcggcgttcctcctcctcctccttcgaccaagtatcaaagattgcctttctcctcttcaaagaggggttccccagggaacaaggactctggctaccgcgctaatttaacaaaggagggttcacactggacaggaacaaggtccaattccttgttgtcattacatagttcaaagtctgtcagcaagaggacagcttgtttgactgcaacagagccacctcctgctgcagccgaagaaccagagatggaccttccgaaggagatattcttgaaagactacaaaaaacccgactacttgtttgacacggtggatttagaatttcaacttggtgatgaaaagaccatagtcacttctaacatagctgtatctccaggcaatgaaggcacctcatctcca

SEQ ID NO: 5092 - DNA, 549 bp, Hordeum vulgare
tacgaagccgaattaaatgtattggccctatagtagcctgttatttcacgcatgctaaatacagcagaatatattcagttaagtacactttcagagcgctggtaatggtgaaagggtcgactggcagaatcaaatttgtttctttgcatcaggaaactaagctgccagacttttcgaggctatctcatagacattttcagagagtccattggctgagataatcatctccaactgggccttagcaagagcttgtctcgtctcgtcatatctcctccatcgagagaatgctgacaccatgcgggatgccacctgaggatttattttgtcgagctgtaaaacaacttcacccaagaacttgtaaccagaaccatctttcgcgtgaaaactcacaggtgacccacaaaagcctccaattaaagagtataccttgttcggattccgcatgtcaaaagcaggatgagccagtaacttccgaacattggctacatttccaggaatgtccgaggtagcttgaagagcaaaccacttgcttacaaccaaataatcttg

SEQ ID NO: 5093 - DNA, 508 bp, Hordeum vulgare
gggctgaggaattcggacggggccctggcacttccatatcctcctcgtgatagcttttatgaacttcttgaagctgttgtcgaccaaccatcaccttctgcaccaccagaccagttctcagcagagttctgttcattcgtttccgcatgtatccaaaaaaatgctacagataggtcatctgcccaaaccctatcggctcatccgttcctgagcatgtacgacgacctgaacatcgatctctctgactacttcacgaccgcgggatcgccacttgccaccttcaagcaaatcgcgttgtgaggtgacaaatgctcgaccacgtgccgtgagctggaggacaatctgtagagcgaagctaactaaagcaagtgattggggtttttctttaccttccttttgttcagaacttgggctatgatggtatgtttgaactgagtatgacattattggctgcactgcataatcgtacaaaaaatacagcattctagcgtgaaaaaaaaaaaaaaaa

SEQ ID NO: 5094 - DNA, 471 bp, Hordeum vulgare
gctagaatgctgtattttttgtacgattatgcagtgcagcccataatgtcatactcagttcaaacataccatcatagcccaagttctgaacaaaaggaaggtaaagaaaaaccccaatcacttgctttagttagcttcgctctacagattgtcctccagctcacggcacgtggtcgagcatttgtcacctcacaacgcgatttgcttgaaggtggcaagtggcgatcccgcggtcgtgaagtagtcagagagatcgatgttcaggtcgtcgtacatgctcaggaacggatgagccgatagggtttgggcagatgacctatctgtagcatttttttggatacatgcggaaacgaatgaacagaactctgctgagaactggtctggtggtgcagaaggtgatggttggtcgacaacagcttcaagaagttcataaaagctatcacgaggaggatatgggaagttgccagtggc

SEQ ID NO: 5095 - DNA, 534 bp, Hordeum vulgare
ggcaattcggcacgaggggaggggttcgtgctgctccagttcgcccccgcggtggggccccggcagtatgattgggcacgcaagcaggtgttctcattatctgtgtgggagatgggaaccttgcttactcttggtctaacagattcgtgcgagttctttcatgatcctttcaagggaaggagcgacgaagggaaagtgcgcaaggttctcaaagttgagccaacgccagatgggaatggtcgctttttcaacctcagtgttcaaaaccgtcttttgaatgttgatgagaacatatacatccctataaccaaaggagaatatgcagtcattgtatcaaccttcaattacatcataccgcacatcatgggctggagcacgtttacaaattctatcaagcccgaggagtcgcagccatacaataggccgcagtcctcgcccgaattggagtggcgaaggtgaagaatgacgacggttctcggagggagatggcagggaggatgaacttttggtggagttccttccagaagaggaatt

SEQ ID NO: 5096 - DNA, 551 bp, Hordeum vulgare
tacagggtggtaacctttttaatacgcaaatcgcagagcttacacaggtttcagtatatgaccagtgcacaatatagaatttagaattagcaaatgaacaacttggattgcaaatgcaaaacagttcagggttcagagcctcaggtaccctgaggcaggtgtcatgatccatggggggaactgcaatacctccaagcaaaaatgctacagtaagtcccacgtaagccattcctgcattaagaagtgagaactaggtgtgatttccaccgcctccgattctaaggccagactgagatctgtagtcttgcagatgaacccatgtaactctgcatggcaaaggcgaaatggttgactaacagaactccagcctgctgtaaggaaaaaccaaaggaataggccagaacccaatatatcatttcctaactaaaccagagattagcagccaaattatgcaccaaaatattttccaaacagcacttccaagaattcctcttctggaaggaactccaccaaaagttcatcctccctgccatctccctccgagaaccgtc

SEQ ID NO: 5097 - DNA, 492 bp, Hordeum vulgare
cctttggaagacccagctttagtccagagaagttcttcacttggcaaaagtgtcagtattcctgaagttgagcgccccaaaccccttttgatgccatcagaagatgaatccaacattctttttgttgatggtctgccaactgattgcaccaggagagaagtagctcatttgttccgtcctttcgttggcttcaaggacctcagacttgtgcacaaggagcccagacgtagtggtgacaaggcttatgctctgtgctttgtggagttcagtgacgcaaaatgtgcagggactgctatggaggctctccaaggatactgcattgacgagaggaaggccgacggcccgttccttaagatccagtttgcaaggttcccgttccgacctccgccagccaatgaagagcggaaacgccctagcgctcgttgatcaccgtcatctatatatcttcccctttgccagcagtgtattgtaggcagtgggccattgtagatc

SEQ ID NO: 5098 - DNA, 362 bp, Hordeum vulgare
  UNSURE (3): n stands for any base
ggnctaacccacacgacagggatttctctgaaaaccccaaaccaggtcgccagtcagcctccttcgggaagctccagcagaaaaaaccgttgcgagagcgaaggtgaacgcgtacgacaggcgggcacttgtcaccaccgtcgacgtcccgccttcgtctcaagcgctcacattccacggcaaaatcaacggtaagtccagcagacctgagcatcttgtctcttgtggttcctgtccccaattgacagctctggcctgtggtggctgtatcaggctccggctacaagatgccactctccagcatcactagtggcaagcccaggacatcagccagattgtactctactgctgccactggagtt

SEQ ID NO: 5099 - DNA, 517 bp, Hordeum vulgare
tgtcctaacaaaaacctaaatatggttgatgaagatgacccgattttggagaaagcaatcgggactgaaattgagtggtatcctggcaaaaatgtgacacagaagattctaaagaagaaacccaagaaaggttcaaagaacacaaagcctattactaaaactgaagagtgcgagagcttcttcaactttttcagccccccacaagtacctgaagatgacgaggacatagatgaagatgccgctgatgagcttcagggtcaaatggagcatgattatgacattgggtctaccataagggataagatcatccctcatgctgtttcttggtttaccggcgaggctgtgcaagctgaggattttgatgatatggaagatggtgatgaggacgacgacgatgaggatgacgacgaagaagatgacgaggatgaggacgaggacgaggatgaggatgaagacgaggaagagctaagcaagccaacgaagaaggtggctggcaaaccgaagggacctgcaaagg

SEQ ID NO: 5100 - DNA, 551 bp, Hordeum vulgare
tactaaaagctctattcagaagagttaaaatataattacacaatcttagggtgcccttcgactgcatatagctagagaccataccagaataagaatacgccaacacgaccgtcccaaaccatccatccacacaagcacaatcaccacgccacctgatacaaaatcatgcctacgatactatccacaccaaacgtctcacccgtgcacaacacaaccagcataaaagctcccttcctcctgggcagttcaacgagaaaacaatgcacaactgcatccaccaacttctactgctgcttgcagtccgccggttgctcggcattgccttgggcgccgccctttgcaggtcccttcggtttgccagccaccttcttcgttggcttgcttagctcttcctcgtcttcatcctcatcctcgtcctcgtcctcatcctcgtcatcttcttcgtcgtcatcctcatcgtcgtcgtcctcatcaccatcttccatatcatcaaaatcctcagcttgcacagcctcgccggtaaaccaagaaacagcatgagggatgatctt

SEQ ID NO: 5101 - DNA, 494 bp, Hordeum vulgare
atcctatgtgtcaaaattaccaacaactatcttacaaccattggagatgccctcagttggttgcttctgttagcagcacacgtaattctcacggtatgtgtttcagaatcatcttttgctgcctgttcggtaaccatgtctattcaaatgttgtgtctgtcctagccatctcttccattcacatgttccctcggcatggatggtggagaaaaatccttcatgttcatcgcatggtcgtccacggttgacagtcagcccctgataatttctgtacggcatcattccatgtaaatgttcttttcacctgctcaatctaacctggttttccatgctcgcaactgtcccgagaggccgatcggatctgacggctagaaaatgtggtggcacacatttctttagcaatgctgccatcaccctattattttctatttttgttttttgtgtgcttttctgtattccagtctcctttaaaatttccttcatctgcacgaatt

SEQ ID NO: 5102 - DNA, 553 bp, Hordeum vulgare
  UNSURE (16): n stands for any base
ctaaaaggcgatgatngccgcatagatactaactaatgggtgcccattgttggccacgcgacgaacaccaaggatttcctccaccatccacgcagaggaaacttatttaggtgaaaactacaattatttaggaacgaaaggagtagaaaacaatagactcgaactacgaacaaatcatgggtatcatctcggagcctatgcctttgtattccatggatccaggtgatacacacaaccataaacttcatgtgcagaaccaaatccgccaatccgcattctcaaaagcaggaagggcaaggcgcgttttgccagccagcatgtcttcatcatagctgacgccgtctagccgctgctagaggagataactttgaagctcatggtgacccgcgggccttgcggtagacgaagtccgccgccgttttgctggttgaacgacctcaacatggcacgagcagatcttttcttcctgatacctgtcaaggaagaggcggtcgacatggtgaggtcgttcaaccggcaaaaacaccagctcctcgtcgggaagctcatcgtc

SEQ ID NO: 5103 - DNA, 371 bp, Hordeum vulgare
  UNSURE (21): n stands for any base
gtccccccgggcctgcagggnccgataagatgagaggagcatcatcaaaagatataaatggctacacctgatctcgatcgctgaccaatcactttttttttctggaaagggtggaatgcccccgacctcggcatcaaaaggatgcatgcaatcatcttattaaataaggtacaaatacaaagtcttagatccaaaacagactcataaaatgagcgtcacattcagcgataaaaaacagggtacgatacctatacatttttcctattaactattagctcgtcttttaaattgggtgaagatagcccgtgctaccgtctttcaacggttgcatccaataaacaaaagctccttgaaaaaaaaaaaaaaaaaaa

SEQ ID NO: 5104 - DNA, 329 bp, Hordeum vulgare
ggagcttttgtttattggatgcaaccgttgaaagacggtagcacgggctatcttcacccaatttaaaagacgagctaatagttaataggaaaaatgtataggtatcgtaccctgttttttatcgctgaatgtgacgctcattttatgagtctgttttggatctaagactttgtatttgtaccttatttaataagatgattgcatgcatccttttgatgccgaggtcgggggcattccaccctttccagaaaaaaaaagtgattggtcagcgatcgagatcaggtgtagccatttatatcttttgatgatgctcctctcatcttatcggc

SEQ ID NO: 5105 - DNA, 402 bp, Hordeum vulgare
tcaagcaacaacaggccaggcagcgcatctcatctcactctatcgcactccttgtactgagccgtttctgtacaagatcacggccaagatgtcgtcgacggccaccgtcaccggcgccaaccccgagaacaagctcgccctcgccaaacgctgctccagagaggcgacgctcgccggagcaaaggcggcggccgtcgccacggtcgcgtctgcggcggcaacgctggcgagcgtgaggatgctgccgtgggccaaggcgaacctgaaccccaccggccaggccctcatcatctgcactgtcgccgggatggcctacttcgtcgccgccgacaagaccatcttgtcgctggcgaggaggcactcatacgagggcgcccccgaccacctcaaggacacctcctt

SEQ ID NO: 5106 - DNA, 417 bp, Hordeum vulgare
ttttttttttttttgatgataaagcttatttttttttctgttgtaacgcatggacaattttcctagtttagatatagagaaagtacatgttgggttaacaacgatggtaacataaatagaagtagcagtttcaatttcggcgacagatattcaattattcatgccgcaccagtttcttgggcactgacgacgatgcatacagcactagctcatgggctgaagaacgccggtggcggtggacgtggacgagcggcggtgccatggaaggaggtgtccttgaggtggtcgggggcgccctcgtatgagtgcctcctcgccagcgacaagatggtcttgtcggcggcgacgaagtaggccatcccggcgacagtgcagatgatgagggcctggccggtggggttcaggttcgccttggcc

SEQ ID NO: 5107 - DNA, 519 bp, Hordeum vulgare
  UNSURE (41): n stands for any base
ctcgtatggttgtcaatcaggcttgcaatgagcttcgccancatggatggaatctggtgtgtctgaagacgctgtttctggtcatatacagctattggttcctggtgaaactgcatgctttgcatgtgctcctccattggttgtagcatcaggagtggacgagcgtacacttaagcgagatggtgtttgtgctgcctctttgccaactacaatgggtgttgttgctggactgctggtccagaattctctgaagtatctgttgaagtttggacaagtttccccttacttgggatataattcacttaaggattttttccccacaatggaaatgagaccaaatccacaatgttcaaacccagcatgtcttgagagacagaaagaatatatgcaatcaaaacctgctagagatgcagcggcaaaggctaagatggaagctgaagcatccgcagcaattgaatacccggttcacatggataacgagtggaacattagtgttcttgatgatagtgacacagcaac

SEQ ID NO: 5108 - DNA, 554 bp, Hordeum vulgare
gagttagtcagattttacagtttatgctgtacggttacaagttctattcaacctctgactatggcggaactctcataacacccgcctcttaaaatctgaatcgcccgatccaaaattgcatgactggaaaacacagctaacatttctccgttcggttagaacaagcagatgctacatcgactgaaatcgctaactctgtcggaagggacgcaaacaatggtatctggtttgggtttccaacacaccatttgagccggatccgcacgaggtcaagatgagtttagtgcgtcgagctgccgctggagatcctcgagatcatcgtcgatggcaccagagctagctggtgcgggtggctctatgtaggaatcttcatctggaagttcacggacaaggccttctggaaggatgtctgttgcggccctttgaacgcttgatgttgctgtgtcactatcatcaagaacactaatgttccactcgttatccatgtgaaccgggtattcaattgctgcggatgcttcagcttccatcttagcctttgccgctgcatctctagc

SEQ ID NO: 5109 - DNA, 287 bp, Hordeum vulgare
tgctatgctatgctcggccgccgcgcgcaccgaccgcactaaccactggccagctagccttctcgtctcctccaagaagcagagcatcctcattcctcagcctgcaccatccatggcgcgccgggctgccgcgtgcgccgtcgccgtggccgtggccctgctggcggcagtggcgtcgtcgtcggcggacgcgtggctgcacgaggagttcgagacggagggcaacgtgcgggcgggctacgacgcgcgggggcggcaggtagcgtccatcgtcctcgaccggcagt

SEQ ID NO: 5110 - DNA, 359 bp, Hordeum vulgare
ttttttttttttttttgaagaattcattcacctttatttactatcttcatcaatccgtctcggcaacaatcaccatacgacaggtgagaaaacagggagagcgagatcaagaagagtgcggatggatcaatggatggctgccgaaatgtatacatgcacgatcgaccgacgatcagagggagcgagatcatgcccgggagcactcggcggggaaccccttggggaaccgccagccgtcggcgcagtagtcgtagtgcatgtagttcctcctggcccagtcgagggtgccgcgctcggcggcgctgggccggcgcgtcatccagcggtcggtgccggcggggcatgcgagcgggcggccg

SEQ ID NO: 5111 - DNA, 568 bp, Hordeum vulgare
  UNSURE (25),(29),(34),(42),(52): n stands for any base
gtacccccgggactggcaggaattncggncacgnagggggtnctggcagggntgaaatatctctttcttggctggctctggttcaaaggctctaagggtgcactcgaagccaagctacggaggatttgccatatgcttgtcaaggttcacagtgcagtagaggaggccaaagggaagcagatcacaaactgcggcaccctcgagtggctttcagagctcaacgacggggtgtaccagggccgctacttgctcgacacggtcagatgcagacagcaggagcttgaagatgagcatgatgacaaggtagttggacagcctttctctttatccttgcttaatcctgcaaagcgcgtccgcgtagcagcgtgtgccgtgaagagcctattgtctcgccatgatgttggtgttggtgaggacatagatagagtggtagagatcttggaaaccgtatctagtgatctcaaggagttcatgatgctcctacacaactgccagcccatccatcgtcctttggctactaatatctttgtcgaggggcagatgttcggccgacatgtcgagaaagaga

SEQ ID NO: 5112 - DNA, 559 bp, Hordeum vulgare
  UNSURE (49): n stands for any base
agtaactagagtggcaactaaaaaccagagtattcaactctgcattggncaagcaattccatgtaaatagctataattcctttctgatcttcacacacatatattactaatattaggaaatcttttcttgatgggagtaagacgggccaatctacttctttcaagtttgatgaactctgatgaatagttcggctcgaggacactgcaatgagcagtgtagtacaatacttggaatggcaacactgacctgcacaacaagactcttgcaaacccgttatcaccacccggggcaacaacactagcgctaggacttgcctgatataccaacctggctagttctgtctgagagggatatggactcttgcaaatggtcaccttacacatgtctgcgccgatcggtagcaaattctctgtcaaatctgcaatgtactcaattccgtcgcccaacagagataacccccctatattgcttctcagcaccttgcgccagaaccaaggattcggatgagccttcagcaccccaccgataattttcgcaccgaagaaggatccatttagc

SEQ ID NO: 5113 - DNA, 40 bp, Hordeum vulgare
gtcctcaaatccatccatccatccccaaatctcccagcca

SEQ ID NO: 5114 - DNA, 397 bp, Hordeum vulgare
tttttttttttttttttttggaagataactgaacttttcattgccatttcatttcagcatcacgacatcaggaaagatcaccagacagcaggcatcatatcagcgctacagagacagccggcgcatttccttactacaaccagatcgcaagacgcgaactgctacagcggcgaccgaaaacctaggcgcgctcccctcggatgcggcgggcgagctggatgtccttgggcatgatggtgacgcgcttggcgtggatggcgcagaggttggtgtcctcgaagaggcccacgaggtaggactcggcggcctcctgcagggcggagacggcggaggactggaacctcaggtcggtcttgaagtcctgggcgatctccctcaccaggcgctggaaggggag

SEQ ID NO: 5115 - DNA, 520 bp, Hordeum vulgare
acgagggagcatcagttacaagcagaccgtgcccattgagctcatacagtcttggaacaagttacaggctgagttaaggaaccggcgtgctttcatggtcaccgaagggcgcaacaggaagaagaagcaagagaaccaagtcaagcttgatgcgaagctccaaaatctgcaggttgcgtggaatggaggctcgaataccatggatgaaatagttgccaggatacatctaagggaagaagcagcagtaaagcgtgagcgagccatggcatatgcgtttaaccatcagtggagggcaaagtctgccacaagccaaggaaacttcaactacggggtcgggaacggtggctggggctggagctggatggaccgctggatcgctgcacggccatgggagccccgatctatggtcacccctgaaaacccgaagaaagggcagtcaaagaaagacaacgccagcacaaaccagtcagctcttaagctgcaaggtgcaatcagtctaagtaacaacaccaatgaccgg

SEQ ID NO: 5116 - DNA, 550 bp, Hordeum vulgare
ttgatttttgttagagtggaaccattttgtccagcagacagatgacgacgtcatattacaaacccgcactcggtgcacagtagagatcctagtcctaaccaaaaaccactctcattaggtatgtgttcaatcgcacaaaccaaatacattctacattggtcacttcttgttccagtaaaacagcaatgtaagagacaaaccacataagagtgtaaaagaaaagacaacttcacaggatgtatcatacagcgtctggtaaccgtttcgcggcgtgtttcaagcagtgatcgcaggaactgcaggttgttgctgcttcccttggttcctctttatgtcattcgacttcgccttgggagggccggccgcctttggtttctgctctgttttcgctactggtttctgctccgttttcgccatcggtttcttcttgtcaggagagggagatgactttttcttgggaactttccggtcattggtgttgttacttagactgattgcaccttgcagcttaagagctgactggtttgtgctggcgttgtctttctttgac

SEQ ID NO: 5117 - DNA, 516 bp, Hordeum vulgare
gctgggcgcctgtacatcgtatccccggggtgctccccgtgggctgcttccccatctacctcacgctgtaccagacctccaacgccggcgactacgaccagtacgggtgcctgaagcggttcaacgcgctgtcgtcccgccacaactcgctgctccagagcaaggtgactagcctgcagagcaagtacccctacgccaagatcatgtacgccgacttctactcccacgtcttcgacatggtcaagagccccgccagctacgggttcagcacgaacctgagggcgtgctgcggcgcgggcgggggcaagtacaactaccagaacggcgcgcggtgcggcatgtcgggcgcgtcggcgtgcggcaacccgtcgtcgtcgctgagctgggacggcatccacctgacggaggcggcgtacaagaagatcgccgacggctgggtcaacgggccgtactgccacccggccattctgtcctagtcctagtcctagtcctagagcgagctccggcgtcgggttg

SEQ ID NO: 5118 - DNA, 548 bp, Hordeum vulgare
tacccgccccatcgcattccttaccaaaccgaaattacacgagaatcaatcaaattcaaaccgatgcttattcttgcaacacatcaccaccatcttcttcttcttcttcgttcttttcttctgctagtaaataaaaataatggtgatcctcccctcccctccccagcttcgaggaaggaaaccgaggaacaacccgacgccggagctcgctctaggactaggactaggactaggacagaatggccgggtggcagtacggcccgttgacccagccgtcggcgatcttcttgtacgccgcctccgtcaggtggatgccgtcccagctcagcgacgacgacgggttgccgcacgccgacgcgcccgacatgccgcaccgcgcgccgttctggtagttgtacttgcccccgcccgcgccgcagcacgccctcaggttcgtgctgaacccgtagctggcggggctcttgaccatgtcgaagacgtgggagtagaagtcggcgtacatgatcttggcgtaggggtacttgctctgcaggctagtcaccttgctc

SEQ ID NO: 5119 - DNA, 552 bp, Hordeum vulgare
  UNSURE (12): n stands for any base
gtcctcccgggnctgcagggaattcggcacgaggccgccgagaaggagaagctcggccggaatgtgccgcaggtgtcgtcggcgctcttcttcagctacaacatggcgctcgggccgccctaccgggtcatcgtcgacaccaacttcatcaatttctccatccagaacaagttagatttggagaaaggaatgatggattgcctttatgcaaaatgtaccccttgcatcactgattgtgttatggctgaacttgaaaagctaggacaaaagtaccgtgtcgcgttgagaattgcgaaggaccctaggttccagagattagcatgcacacacaagggaacttatgctgatgactgtattgttgagagaattactcagcacaaatgctacattgttgccacttgcgatagagatttaaagaggagaataagaaaggttcctggtgttccaatcatgtatatcacccaacacaggtactcgatagaacgactccctgaagctacaatcggtggagcaccaagaatctgattagctgaaatacaccgtcacagttgc

SEQ ID NO: 5120 - DNA, 550 bp, Hordeum vulgare
gcactgaacctatgacggcacttgcatattaataaaattattcttgagtctgcaacattaacaacaccaagcaatctgggaagttggctacagttcagctcaaaacaaaggacaaagatagacattcttctaaagttccttacaaaatttatgaaaatgatgccctaaagaggttggtacacaattttgaagtggttacaatcagctcgattcagcacggcagtactcatgtccatcctaaatcaaggaacttgggcaactgtgacggtgtatttcagctaatcagattcttggtgctccaccgattgtagcttcagggagtcgttctatcgagtacctgtgttgggtgatatacatgattggaacaccaggaacctttcttattctcctctttaaatctctatcgcaagtggcaacaatgtagcatttgtgctgagtaattctctcaacaatacagtcatcagcataagttcccttgtgtgtgcatgctaatctctggaacctagggtccttcgcaattctcaacgcgacacggtacttttgtcctagc

SEQ ID NO: 5121 - DNA, 468 bp, Hordeum vulgare
catggacgcccccttcttccgctccctcggcctctccgacaagatctggaacaacgggcccatcagcttccagctccagtggttccagaccatcacctcctccgtctgcggcagcagctgcaagagctacctggccaactcgctcttcatcttcggggagttcggggggaacgactacaacgcgatgctgttcgggaactacaacacggaccaggcgagcacgtacgcgccgcagatcgtggacaccatctccgccggcgtggagaagctggtggcgatgggggcgacggacgtggtggtgccgggcgtgctccccatcggctgcttccccatctacctcaccatctacggcacctccagcgccgccgactacgactccctcggctgcctcaagaagttcaacgacctctccacgtaccacaacagcctgctccaggccaaggtgtccaccctccaggccaagtacaa

SEQ ID NO: 5122 - DNA, 548 bp, Hordeum vulgare
tttcttttattctttttttcctcctgggacaaaacaattactactatcaggttacaggttcacaacaacaacagcagcacgggccgcactactattccacgacgcttgccgtcatcttcttcttcttcttccttcttcactcgtcaccacagacgcgccccgattcttttgccaccggatcagaccgggaaccttagccttggccggtccccagacacgttatgatagttaacccgactgaacaaataataataattataataataatataatgataatcgatcggttgattgattgattgattgattatggattcatggacgacgacgacgatgaggtttttgatgcgcccatgcatgcatgcacagactgaggtggggtggctagtgggtgatggcggggtggcagaaggcgccgttgagccatccgtcggtgatctgcttgtatgcggcctcggtgaggtggatgccgtcccagctgaggtgcgacgccgggctggcgcatgcggaggcgccggacatgccgcacctcgcgctgttggcgtagtt

SEQ ID NO: 5123 - DNA, 518 bp, Hordeum vulgare
acatctccaagtccgcggcgtcttctcccgtgctccgcgaccgcgacggcgacggcgacggcgaggggaggaggagatgaagctgaagcagctggagggcctcctggggggcctgacccagttccccgaccccaaggtggagctggagcagtacgcgacgggcccccacatcgcgtcgaggatgctctacacggcggagaacagcttcgatgacatagctggtaaggtggtggctgattttgggtgcggctgtggtaccctggccatcgcgagtgctctgctggatgctgagcatgtcactggtattgatattgacctccagtcccttgaacttgctcaagaaaatgctactgatctggaggtatgttgttgctttcgtttccaatgcaataattgcttttgtctaaagcagataaaccttcatattgactcttttgcctcaataatgagtttccaaaggtctgcttggtctattatctcgagtgcttactacagttgatcaaagaatgacgacttgc

SEQ ID NO: 5124 - DNA, 549 bp, Hordeum vulgare
tgaacaggactttgaagacagaggtgggcgcagaggcgatctgtcgccgacccggggcttaactttgaattcgacgctgtttttcctcaggccggatatccagcatgacaaaaacaagatcatacactgaaggaagtactggtacagagagaacgccagccaaccctggcaaggtgctgtaaagttccatcgctacccagggcatggctgctaaaccaccggggtttgcctgccgctcacaaggggagcaacatgtgtaaatcgccccatgccgacgtcttcttctcctggcaagtccagccatcgtgccgtggtggtggttaaaccaggcgcgatgtcataatctcgtcatgttgccactacgtcatgctaggccgctagcttgctctttcgtctggagctcgtgggacgaagcgccacagatcgactgcgatgtcaagctccttctgtttgtggaacctgtaggtccgtggtagatcgtagcgaagctcacacagaacttcagcactgattgcgttgcagttacgcaaggctgacttcttgatgtat

SEQ ID NO: 5125 - DNA, 256 bp, Hordeum vulgare
aagatgctctcaccaagaaaatgagaagatccattgagcagctcagtaccggcatagtgaacaggcttctccatggcccattgcagcacctgagatgcgatggcaccgacaaccgcacccttgatgaaacactagaaaacatgcacgccctcaacaggatgtttggcctcgacaccgagaaggcggtcatggaacagaagatcaagacaaaggtggagaaacagaaaacccaaaactgagatgagcggtctagtct

SEQ ID NO: 5126 - DNA, 464 bp, Hordeum vulgare
agggcctgctgcagttcttgatatgcaaaaagctgttgtggagtacaaagattttgctgtctaacatatttggcgcctgcaatggcaggcgctaattccctatacaattgacgaactcatcaaggaggggccagtaagagagggttaaacaaaactggaattagaatgtcaggacaaattgggagtatatatgtagatctacaggcagagactagaccgctcatctcagttttgggttttctgtttctccacctttgtcttgatcttctgttccatgaccgccttctcggtgtcgaggccaaacatcctgttgagggcgtgcatgttttctagtgtttcatcaagggtgcggttgtcggtgccatcgcatctcaggtgctgcaatgggccatggagaagcctgttcactatgccggtactgagctgctcaatggatcttctcattttcttggtgagagcatctt

SEQ ID NO: 5127 - DNA, 515 bp, Hordeum vulgare
gtgctgatggacctgagcgcattctggtgtatgactatatgccaaactcaagtctttttgcacatctccatggaacacattcttcggagtgccttcttgactggcggcggagaacatttattgccattggtgctgctcgggctctcgcgtatcttcaccaccacgcgacatccccaataatccatggaagcatcaaatcgaccaatgtgctactggattcggatttccaggcacatgttggggactttggtcttatgaagctcatctcagatgaaatagatcatgacaagattatcggtgaaaaccaacgaggctaccatgctcctgagtacgtcatgtttggcaagcctacaacaggttgtgatgtctacagctttggcataatacttctggagcttactagtgggagaaagccagtagaaaaatcaggctcccaaaaaatgctcggggtccggaactggatgctcccgttggcgaaagagggtagatacgatgagatcgcagactcaaagctc

SEQ ID NO: 5128 - DNA, 554 bp, Hordeum vulgare
  UNSURE (15),(16): n stands for any base
gtgagtatattgggnntcttcacccagtgcacacaaaaagcactttctataaaagccaactcacctctctacatctcccccgctctcaaaaaaagggaggagatcatcataaataacaaaccaatcctatacatttcagtcaagccaaaccatgcagaccaagcttccaattcagcaaagaatatccactctaccaatacctaggggccagggtacaccaacccatcaagccccagccagcccttcatcgttcttaagaatgtagtcggtgctcccttccggagtcgacattccgatggaactagccttcgagtctggcctaaacagctcttccttttcaagcctcaggagcatctctttcgattcgcctttcagcagggacacaacctcaagcatcgttggtctcttttccggttctctgtgcgtgcacgctaggccgatcagcaccgccctttttagctcagactcggaatacttgtcgttgagctttgagtctgcgatctcatcgtatctaccctctttcgccaacgggagcatccagttccggaccccga

SEQ ID NO: 5129 - DNA, 542 bp, Hordeum vulgare
  UNSURE (16),(46): n stands for any base
gtcccccggctgcagnattcggcaccggggaagaccctccgccggngggagtccagcatattcaacaaaacgcgggagcaccttcccgacgctgaaagactacaacgattacctggaggaggtcgaggatatgacattcaacctgatcgaaggaattgatgtcgaggcgatcgaggctaggattgccaggtatcagcaggagaatgctgagcagatatacctgtcgcgagctaaaagggctgaagatcttgctgcggcgcttaaagcgagcagaatggtccctgtaaaggctggccccagtgatacggctgctggaagctcccagggtattagtggtggggcgggagttcaaggccagtatgcgcctgccgcggttcctggtgggttgaatcagcctcgtccgacaggtaatgccccgcagccaattggtggtccatctgatcctctacatggatatgacgaggagaccatgcgactacgcgcggagagaggagctcgggcaggtggttggactgctgagttgggcaggcgaagagcactag

SEQ ID NO: 5130 - DNA, 508 bp, Hordeum vulgare
tttgacgaacaaaaccatgccattacagaggaacaatgacaagtttcgccacctcgatgtactcggaggctggcaactacatgtatcagtcattgccatgagcataggtacatctatacgcaacttctcgacttgcaaaaggggatgaacactgggccgcctgatgctgatttgacacttcaatcccttctgcttgaggtccaaaatataggccacaaccaacatgttatagccggacaactatgcgctgtggtataagggtcgtcgtaagttaaccatgcatcctccaggacagctgctgcgcctgatctaacctttttatacgaatatgctgttaaatgcctcctctagtgctcttcgcctgcccaactcagcagtccaaccacctgcccgagctcctctctccgcgcgtagtcgcatggtctcctcgtcatatccatgtagaggatcagatggaccaccaattggctgcggggcattacctgtcggacgaggctgattcaaccca

SEQ ID NO: 5131 - DNA, 492 bp, Hordeum vulgare
ctacagtggaagcttgcgcattacggtatcaaataatgattctggtgttcgtgaattcgacatggaaagattccagctcttgaatcacttccgttttaactggccagtgaatcacacatccgtgagcccggacaagaaactgttggcagtagttggagatgaccgggacgctcttcttgttgattcacgaaatggcaaggtaacttccaccctagttggccatctggactactcatttgcctcggcgtggcacccggacggtgtcacctttgcaaccgggaaccaggacaagacctgccgggtgtgggacatccggaacccgtcgacctccctcgcggtcctgaggggcaacatcggcgcgatccggtgcatccgctactcctcggacgggcggttcctgctattctcggagcccgccgactttgtgcacgtctacagcaccgccgagtgctaccggaagcggcaggagatcgacttcttcggcgagatctc

SEQ ID NO: 5132 - DNA, 550 bp, Hordeum vulgare
ggtgaagaggttaaattcctatactgggtctcattaaagttacagttcggcagatctttagcaattccgctcttcctttacacgaacgcgctaaacttagcaccaagctttctttctctctctctctacatgtacagagtccaggcgcccgtaggcacacctggactatcctgtaatggagcccgctggcatatctcgcccctcgaacaacaggggctcgtcgcccgggccgagcgagatcttcagattttcggcagttccggagctctttctttcacatcaaacacaaagggttttattcctctacatgtatgagtccaggtacccgttggcgtgcaccaacctgtaattcagcaggctggcgtagacgcggtcgcacacccccacaaacagggactcgtcgtctgggctgagcgagatccccgagatctcgccgaagaagtcgatctcctgccgcttccggtagcactcggcggtgctgtagacgtgcacaaagtcggcgggctccgagaatagcaggaaccgcccgtccgaggagtagcggatgcac

SEQ ID NO: 5133 - DNA, 519 bp, Hordeum vulgare
gcccctgcttccaccgtcagattcttggcaacaatgagtgctttgaaccctacacatctaacatctacagtcggcgggttcttagtggggagtttgttgtggttaacaagcatcttctccatgacttgactgagatgggtatctggacacctgctttgaaaaacaagataatttatgaagatggttctattcagaagatggaagaaatccctgatgatcttaaagcaatttacaagactgtttgggagatcaagcagaaaactctggttgacatggctgttgatcgtgggtgctacattgaccagagccagagccttaatgtccacatggatcaaccaaactttgcaaagctaacttcgttgcatttccatgcttggtccaagggcctgaaaactgggatgtactatttgagaacaagggcagctgctgatgcaatcaagtttactgtggatactggctttctgaaggtcaatggggatgctaatggcactaatggcactgctaatggcaaactagcag

SEQ ID NO: 5134 - DNA, 542 bp, Hordeum vulgare
  UNSURE (14): n stands for any base
gatacatatatatnacagctgcagcaacccatgtttttagatagtacaaataacaagccaacattggcaactcagccatcaagggctgcccagcaaaggaactcatcagttcttaaacacaaccgcacctacataaacgactctcttctcgcattattcaatgccaatgatcagaccgtttggttgtgtaatgctgccttggttaagagaaaaatagatgcaacagatccgtctaacttccgcatgccaggcactcttcccggttgttcaaggagcagacaacttgcgccattttggcttcatcgtcctcctctgctagtttgccattagcagtgccattagtgccattagcatccccattgaccttcagaaagccagtatccacagtaaacttgattgcatcagcagctgcccttgttctcaaatagtacatcccagttttcaggcccttggaccaagcatggaaatgcaacgaagttagctttgcaaagtttggttgatccatgtggacattaaggctctggctctggtcaatgtagcac

SEQ ID NO: 5135 - DNA, 542 bp, Hordeum vulgare
  UNSURE (11): n stands for any base
ggcctgcaggnaattcggcacgaggccgaggagtcggaggaggcggatgccgtgctgatcatcgacggggaagaggacgacgaggaggagttcggcgacgacgatctgtccgggttccgggggctcgttcttgatctctcctacaggcctgtcaatgtcgtctgctggaagcgtgcgatctgcctggagttcatggagaaggccgatgttctggagtactacgatcagacggtctcttctcccagggggtccttctacatccccgcggttctcagggttccacagctgctgcaagttgtaaagaggaggagagtcaagcactgccttagccggaaaaacatactcttcagggatggattcagttgccagtattgctcttctgaagatgacctcacgattgatcatgtcatcccggcctcgcgtggcggcaaatgggaatgggagaacttggtgactgcatgctctagatgcaactccaggaagggtaacaagacgctgctgcaagcaaacatgaagctacgcaagatccccaaggggcctaa

SEQ ID NO: 5136 - DNA, 551 bp, Hordeum vulgare
ttaagtctgtatcttattttatttagtgacaaatcagtgacatgtacagatttattttcagaaatcagaaggtagctaagcatgtacagagctcgtgatggatagacacgaatcttttggctggagatgagcctggtaaatatatatacatggagacgaggtgatggctactggtcatggtctgaactctgaagggagtcctcccttggtcatggcgatgagccggcaaggtactgcagccactcttcaggcaggccgtgcctcctcctgatcgtcctgaaggcggatttcgtcaagggcaccgcgatgatgtcgaattccttaggccccttggggatcttgcgtagcttcatgtttgcttgcagcagcgtcttgttacccttcctggagttgcatctagagcatgcagtcaccaagttctcccattcccatttgccgccacgcgaggccgggatgacatgatcaatcgtgaggtcatcttcagaagagcaatactggcaactgaatccatccctgaagagtatgtttttccggctaaggcagtgcttgac

SEQ ID NO: 5137 - DNA, 517 bp, Hordeum vulgare
ctccctgatgcttccatcaaggagatgatccctccgggtgctttggtcatgctcacccccctcattgttggaaccctctttggcgtggaaaccctgtctggtgttctggctggtgccctcgtttctggagtgcagatcgccatctctgcttccaacaccggtggtgcatgggacaacgcaaagaagtacatcgaggccggcaacagcgagcatgcgaggtcccttggtcccaagggttcagactgccacaaggccgccgtgatcggcgacaccatcggagaccccctcaaggacacctcaggcccgtcgctcaacatcctcatcaagctcatggccgttgagtccctcgtgttcgcgcccttcttcgccacgtacggaggtctgctgttcaagtacatctagaggactcgtgatgagtcgagcgatgatctacagacactgtcacgaataactcccccgcccgcccgccgttcgtacgttgtgcgctgctgttatttttggttgtcatgtcattcca

SEQ ID NO: 5138 - DNA, 543 bp, Hordeum vulgare
tgatatattgttaagggtgggttaaacattatcgtcgtatcatgggacgaggaaaatttgccagacacataccaacgagggaggacatctggtctctctcttctactacatggagctacaagccggtaatgtaatggtgagactaacataacgccttcaagaggccaggggaaagggggtaggtaaccgcggcaatcctggaatgacatgacaaccaaaaataacagcagcgcacaacgtacgaacggcgggcgggcgggggagttattcgtgacagtgtctgtagatcatcgctcgactcatcacgagtcctctagatgtacttgaacagcagacctccgtacgtggcgaagaagggcgcgaacacgagggactcaacggccatgagcttgatgaggatgttgagcgacgggcctgaggtgtccttgagggggtctccgatggtgtcgccgatcacggcggccttgtggcagtctgaacccttgggaccaagggacctcgcatgctcgctgttgccggcctcgatgtacttctttgcgttgt

SEQ ID NO: 5139 - DNA, 519 bp, Hordeum vulgare
gggaagacggtcaagatacccccgatcgtgcaggagctggcgaccggcgtgcaagagccaccgagccggtatgtgatcgctgagcacaaccgccccgccgtggctgcttctgagatgcctgatccgatacccatcgtcgatctcagccggctgtctgacaactgtgctgatgaggttgccaagctgcggtctgccttggagaactggggcctgttcctggctgttggtcacggaatggaacaaagttttctaggtgaggtgatgaaagtggccagagaatttttcaagctcccactggaagagaagcagaagtactcaaacttggtgaacggcgacgaagtcaggatcgaaggttacgggaacgacatggtcgtatcagagaagcagatcctggactggtgtgaccgcctctacatcatagtggaacctgagaatcgaagaatctacagcttgtggccaacacagcctccatcgttcagagatattttgagcgagtacaccgtcaggtgccataagatc

SEQ ID NO: 5140 - DNA, 544 bp, Hordeum vulgare
aagttgtctgtagatggtatattaggtgatacatcatagcacattattttagaaggtcgaagcataaaccaactccacgagaatagtacatatcgctggaagaaatatcaccacactgcgactaatcttctacacttcggaaccaggttcagatcttcaccgtgtcgatagctagtgtccccctagcaaaagtttcaaagagttttgctatgtagtcattagttgttgtcttcctgtaccgcctcggtcttttctcatccaccagctctggcagtggctcaatctccttctcagggttcatcgtgtagaacatcaccaaagataaccgctctttctctgcattggtcacaaccctgtgaatcgggctcttgaagaatccattgctcattatctccattacatctcccacgttcacgagtaatgcatttggaacaatgggtacgttgtaccagacgccatcattctgaagctggagcccactgacattatcatcgatgaagacgatagtgatcaccgaggcatcggtgtgaggcttcatgccgaa

SEQ ID NO: 5141 - DNA, 534 bp, Hordeum vulgare
aggcaattcggcacgaggcacgaatggcatctacctcgagcttggatttgggaaagatcgtgccgccggccggcttcctcctccaccgccgcaccgccgttcccagcgcccctgttctccgggggaggagcaagagcgggcagtgcggcctcgctgtctcggcctcgtcttccaatggtgcagctggcctcttcccattgagcgacacggagaagaaaggccctgtggtgatggagatcccgctggaagatatccgtaggccgctaatgcgaacgcgtgctaacgatcctgagaaggtgcaggagctcatggacagcatccgtgtcatcggcctccaagtacctatcgacgtgctggaagtcgacggagtctactacggattctctggatgccatcgatacgaggctcaccagcgcctaggactcccaaccatccgctgcaaagtccgccgagggaccaaagaaacactgcggcaccatatgcgatgaatcggtggttagcgatgaatggacaatccatggattgcttcagcca

SEQ ID NO: 5142 - DNA, 551 bp, Hordeum vulgare
ggccctgaatttgctaatgaagcttagggggcactgcatttctgagagtttagaccctgcactccagcctgaaccttcagttgcattcttgcccaaacagagttgtagagattactgtatgcaacagaaggagcagaagcgccagctgaattgtgctattttatacattggattgggtaacatttacacgtatagatgattacaggaggagaaagttttttttagcactagacataacagacgacacttcctggctgaagcaatccatggattgtccattcatcgctaaccaccgattcatcgcatatggtgccgcagtgtttctttggtccctcggcggactttgcagcggatggttgggagtcctaggcgctggtgagcctcgtatcgatggcatccagagaatccgtagtagactccgtcgacttccagcacgtcgataggtacttggaggccgatgacacggatgctgtccatgagctcctgcaccttctcaggatcgttagcacgcgttcgcattagcggcctacggatatcttccagcgggatct

SEQ ID NO: 5143 - DNA, 525 bp, Hordeum vulgare
ctgtgtctaactacaccttgctgataacgttggtgttacaatggagataatgaccaacgggatatttaaagggccagtacatagggttgtaaccaattctgagaaagagagactctcagtggccgtgttctatggtctggatcctgaaaaagagattgaaccgatagctcagatgttgaacgaggaccaaccggcgcgatacaggaaaatgaaggtcaaggatttcctagtcgcgcaccttgagcatttctctcgaggagaaagagtcgtcgattcgttaaggatatgatcaagggaaaagagtggcacgacattgctgtgccgtggcgcaaggtcatgatgttcgttgggggtggcggggtgctctccagagatgctcactcaaggtcgctggatccatgcgtggagatgagccatgtcgacctggacttcgttctaaaggaccactgagaaggtggggtatttgatcaggtgacctgcgccttctgctaaatgctctgctcctctgctgggtgttacgtggtc

SEQ ID NO: 5144 - DNA, 558 bp, Hordeum vulgare
  UNSURE (28),(42),(43): n stands for any base
gggcaagcaccagcgagtgtaacttaanccaagagcatccannggttttcagaaattaccagccagaccacgtaacacccagcagaggagcagagcatttagcagaaggcgcaggtcacctgatcaaataccccaccttctcagtggtcctttagaacgaagtccaggtcgacatggctcatctccacgcatggatccagcgaccttgagtgagcatctctggagagcaccccgccacccccaacgaacatcatgaccttgcgccacggcacagcaatgtcgtgccactcttttcccttgatcatatccttaacgaatcgacgactctttctcctcgagagaaatgctcaaggtgcgcgactaggaaatccttgaccttcattttcctgtatcgcgccggttggtcctcgttcaacatctgagctatcggttcaatctctttttcaggatccagaccatagaacacggccactgagagtctctctttctcagaattggttacaaccctatgtactggccctttaaatatcccgttggtcattatctccattgtaacac

SEQ ID NO: 5145 - DNA, 546 bp, Hordeum vulgare
gtcccccggctgcaggaattcgcaccaggccctcgtgccgaattcgcacgaggcagctattcaagttttaatgcaggacggtagtatacaaccatggtgtccttcacatctgtgtgtacttttgtgcctatgctgatttccgcacttatgtgattgatacctgcctgggctctgagatgcttgctttatatgttttcttttccttaaagagacactggcattagatacaccagtggcattaaatggaccagcatatttcattattctactagatgggctcgccagcgaggagacatattgagcaagtaaaggtcgtacttcctgccatccttcgagttatgcatgctaatttatcagaatgtgatggggaacatggaatggctgctgttgatctgttgagtgcagccctccgaattggcaatgctatacaagaaatgtgcaaaacaatggtcaaccacaggaaggaagagctatgttccatacttggtctatacgcccttcaaaacatagctcttgtatcatcagaaagcaaacatcagaatattc

SEQ ID NO: 5146 - DNA, 503 bp, Hordeum vulgare
gcactgtacgaccatttcaaacctttcatcttttcctccaccaactcaatgcagcggtgaagtactagctgaacaggatttaacaagcacaccatctgattttcttcctcaccaccgtctttctcgagttccgattgcgtccctgaaacgattgatcttagtgggatcagccaatctgcgtacacggcttgtattgttttgtcccggaacattgttgctgatctggatcctcttgaatctattatcagaatcagtctgagcaagttcagagcagataatacctcttcactgtgatcacgaagacaaggaggaccaccttctggaggcctcaagatcagctccactaactcgagcacctgcgaagcccaatgtggcggttccccaacattttttgatcgatcagattcattaacctgatcagctcgacggctctctctcaaaacttcattcttcaccagatccaaaagaattgcagtcaaggaggggaacatgctattctcaat

SEQ ID NO: 5147 - DNA, 521 bp, Hordeum vulgare
  UNSURE (7),(8),(29): n stands for any base
gtctcannttgcagcaggagcacacatgnggagctgaaaatgctaacgggttgagtcctttgatggtggctcgttcatggcacaaaaccagtgctgaaggcatcctaagcaaacaaccagaagggagactactaattcttccgtcaccatatctgtctcttccactgatgagcattgtcaaaatcgctcgggaatgcggatggagaaaaacctcggtatcatctagtagttgccatgatccatgtgtcatatgtttggagatggaatgtacggtggctgcagaaggctgtggccatgagttctgcaccaaatgtgcactctatctgtgctccaccaccagcagctccacgtctacccgcggggtgcctggctccatatcttgccctctgtgcaggcacacaatagtctccttcgtgaagctcacaggcaccacctccctgaaggagcttccgtggactacctcatcattggctctatgtgcggcaggcgcaagcactggctcgttgcgtcgccagtcggac

SEQ ID NO: 5148 - DNA, 486 bp, Hordeum vulgare
ccaaactccctatagctcacaaaacgaaagggaggcagaaccgaacacaaaaccaacaaaaggagcagagcattatgaaaactctgaatatctactaccgactctttccctgtacgaagatgattgccgcacatccggcctgatacagttgacaaggcagggcaacgtctcgtcaagcctgccgcaattcaatttaccggagcgaatggatcgaaaagaggagcatcctaggtgaactgaggaggagcgaaggcgacggatgtccgactggcgacgcaacgagccagtgcttgcgcctgccgcacatagagccaatgatgaggtagtccacggaagctccttcagggaggtggtgcctgtgagcttcacgaaggagactattgtgtgcctgcacagagggcaagatatggagccaggcaccccgcgggtagacgtggagctgctggtggtggagcacagatagagtgcacatttggtgcagaactc

SEQ ID NO: 5149 - DNA, 1570 bp, Hordeum vulgare
  UNSURE (1),(2),(19),(40),(1163),(1295),(1307),(1357),(1445),(1460),(1553),(1563): n stands for any base
nnttctatctttttttttntttttttttttgctttttgcnattgcgtggtcgatgttctgcgtggctgttaggggacgatatgggcacgacaggatggagctatcagtgcgacagagacatgggagtgaggcagtgcgcaggtgggcactgtgagtatcttactagtatataggcctagtgtgacccagtgacactggtcagccgacgcgagacagtggaagaactgtaagtagtcatgcatactgccgtgggctgtgcgcgagaggcgagtagcatggaatgcgcagcggaggccatggtgcagtgtatgatgtggcgtctatgtatcgcgaatggtttatctggcgctaggcgagggactattcacgcatagcacgttgcccgtggatagattctatgtgtttcggaacaatggagcgtgattccgctagacctagcgttctatagagtgcacgagaggagctcgcgagtacagcacgcgatagcggagctagggagtgtgtataattatattggggagtgagagtagagaataataatagcaggaatgatggagtgtatagagcacgttgtgaccaaagagaaaacaagagtcgctgtcgcagtggccggaggccaagaggacgatgaccctacaataatcgagttcagccagtattatatatccgccccccctcgccatccgctatcctcacccgtcaataccctgcgaattaatttcggcgacccgtggtgcgagacgcactacggccgtaccatccgaaagagtcgcgattgtgcgggctacccgtatacggcattatatccgcgtagttatggccgataaagcataatgtcccgcaggcaggcggaggaggtccaaatcgcttacgtgctagaagacgcatcgtacgagagatgggggcgggtaaccaaacggaggagaaaacgcgtagccgtaatggtaagtccaagacagacgctagaatccctataacagatcgcatatgtgcatccatttgcttcaacgattagcataccaagcctatactttcgccttataccgttccgccgcaaagagtatgcgtttagacatatcgccgatgtagatcgcggcgatttaggtagtagggaaggtgatgtgaccggcccggtccccgcggtagtagatacgcggcggtantataagcgcatcaggaccgtaatcagagtccggtaccgaagttttgccggccattgtcggattaccgtatgaagtcagcagcatgtagcacgagttataacagagcccgggtagaggccgtcgcgccgcgcnatcagagtcagngtggagtgagttcgcgcgttagccggacgatatagcaggtgcagtctagntcggtagagcgatatatcgaggtaaggccaatgagaccagaagctcgattgcaatcagacgtcactagcattcggagattcgcgatanatgtaggcgagtctngagcagaatatcatccgcgcagcgtggcgagcaccgagtaatgcgtgcgccgcgctcgagcttattcggcagatcatcggcgcgacgttgtgntcgtatattntcggtag

SEQ ID NO: 5150 - DNA, 550 bp, Hordeum vulgare
tactaatggaaaccttgcactgcagacacttttcacaacattattataaacaatttggcgcttgatcttgcacaatgaaatacaagtctcgagttaaaagaaccaacgaacgatcttcgactacccatccgaatcatcaaacacagctgaagaaggaacctaaatgggtcgcatttacagggcggggaatcggcttgctgaatccgaacaggcgagggggggcttacttattgctcgggtacaatttttacaggcgacttgcttcatctgggacgcagagcttcagttctcggaatcctctggtatcttgaacaggaactgcggtatcgaggcgatgcgggggaggttcatcagcaggtctccgaacgagtcctttcgggacatagctggtggcggctgattagcatctgcgttttccctcgttgatgctgaactgaattcatcgtctgatccttccgagtcctccccgccaatgctgccgctgttgtttggctcgggcttcggctgggctgtcggcgctgcgtctttctgaagcaagcagcaaagtgag

SEQ ID NO: 5151 - DNA, 518 bp, Hordeum vulgare
ccatccctgccccggcgcgccgtcgccgtcgccgtcgccggtcggtcatgtcggggcgcaaggagacggtgctggacctggccaagttcgtcgacaagggcgtccaggtcaagctcaccggcggcaggcaagttacaggaactttgaagggctacgaccagcttctgaacttggtgcttgatgaagccattgagtttgaaagagagcaagatgatccattgaaactatcggcaaaaaccagacagcttggtctcattgtctgcaggggcacagcggtgatgcttgtatcgccaaccgagggaacagaggagatcaaaaaccccttccaagaggctgatggggaacaaaccactcgctcgtaagaatgacccgagaagctggttggattccccatggagagacttacattagcttatagtattggatatggcaatctatgttggagcacttgtcgccgaggttcatatttgtgccaagatgattatgagtcgcactggactgtctcgtgtatatgttaa

SEQ ID NO: 5152 - DNA, 553 bp, Hordeum vulgare
tgcgggatatggggatatatgcataaacatttgtcagagatcaccaataggcgaatatatacgtaaatacatccgtgttaacatatacacgagacagtccagtgcgactcataatcatcttggcacaaatatgaacctcggcgacaagtgctccaacatagattgccatatccaatactataagctaatgtaagtctctccatggggaatccaaccagcttctcgggtcattcttacgagcgagtggtttgttccccatcagcctcttggaaggggtttttgatctcctctgttccctcggttggcgatacaagcatcaccgctgtgcccctgcagacaatgagaccaagctgtctggtttttgccgatagtttcaatggatcatcttgctctctttcaaactcaatggcttcatcaagcaccaagttcagaagctggtcgtagcccttcaaagttcctgtaacttgcctgccgccggtgagcttgacctggacgcccttgtcgacgaacttggccaggtccagcaccgtctccttgcgccccgacatgaccg

SEQ ID NO: 5153 - DNA, 499 bp, Hordeum vulgare
  UNSURE (1): n stands for any base
nattgctgagcttgtcatggtccatcttgtagaggacacaaatgactcaccaacctatgcagatggtgtgccgaaggaaatgcgtgctgatgagacattgatcagactagccaaaatatcacttgtggaagagaaggtggctgccatggagcaaggaaaaatttcgaaactcttccccaactacttgttgtatgaatttactggcttatcaggtggaagaatatggaaaggggagcatgatctactgttactgaaagcattaataaagcacgggtatgccaggtggcaatacatatcagatgacagagataacgggctatttgaaactgctcgacgagagcttaatcttccttctgctaatgaattgattggctctcagtcaaacaatgaggcaaatggaaatctggaaagcacacaggaagtgcaggtgaacccaacaagcctatcccaatacagggacatccagagaaagattgttgagtttatcagaaagagatac

SEQ ID NO: 5154 - DNA, 552 bp, Hordeum vulgare
ggggccaggaaaatttggtatagggtaatcatcagtactgactactgagtgcctaactttgagttacaacaaggtagactagaaccagtttagtaactaaactgaagggggtttcgattcagttttcatccctacacattaaccatcgatttccattttgtcctccggctttacagtcgaagggccgacaccatttgccgccacggcgcctgcgtcttgtggaggcacttgtggaggcttggcttcttcgacgatggcatctaccacttcctctttgggggtagcagcgccgttctcttggactctcaagacccgatcaacgtcctcacatactttctcaaactgatggaggctgttggctagactcgcggaagctgccttgtcaccgcagaacgaattgagtgcacgtgcaccgctgtcttcaagcacaccacacatcttgttgtaaagatgggaaaggtgtgcctggtcagttgagccatcagaagccacttctttggcagagattggtacaagagggggaagttctctcaacacttcactgatatctgg

SEQ ID NO: 5155 - DNA, 515 bp, Hordeum vulgare
tgcagcattcggcacgaggcgcagcccggtggtgaagctggggccgtgggggggcgacgacggggtggcccacgacatcacggtggcgccgcagcggctggagagcatcaccatccgctggggcaaggtcctcgactccgtcgccttcacctacagggacaaggacaaccagctgcacaccgccgggccctggggcggcgccggaggggagaaggaagacccggacacgatcacgttgggcccctcggagtacataactcaggtcgactggtcggtgggaccgttcaagctcaaggagatcgagcactgcatcacctcgctcaagtttgtgaccaaccaggccagctacggcccgttcgggtacgcggtggacagcacgcactacagcctgcccgtgctcaacaacggcagcgtcgtcggcatgttcggccgcgccggagactacctccacgccatcggcttctacgtcctcccagagaccagtctcgcatcttgagttcccatgttcattgatc

SEQ ID NO: 5156 - DNA, 542 bp, Hordeum vulgare
aacctttattgaaggaactcgtatattaaaaataagacgaaccatttattttaaatgctaaacaatggacaggatcaatgaacatgggaactcaagatgcgagactggtctctgggaggacgtagaagccgatggcgtggaggtagtctccggcgcggccgaacatgccgacgacgctgccgttgttgagcacgggcaggctgtagtgcgtgctgtccaccgcgtacccgaacgggccgtagctggcctggttggtcacaaacttgagcgaggtgatgcagtgctcgatctccttgagcttgaacggtcccaccgaccagtcgacctgagttatgtactccgaggggcccaacgtgatcgtgtccgggtcttccttctcccctccggcgccgccccagggcccggcggtgtgcagctggttgtccttgtccctgtaggtgaaggcgacggagtcgaggaccttgccccagcggatggtgatgctctccagccgctgcggcgccaccgtgatgtcgtgggccaccccgtcgtcgcccccccac

SEQ ID NO: 5157 - DNA, 938 bp, Hordeum vulgare
  UNSURE (698),(701),(702),(711),(714),(717),(720),(722),(726),(727),(733)..(735),(738),(754),(755),(793),(794),(796)..(938): n stands for any base
gtcccccgggactgcaggaattcggcacgagggatggatgttgcatttggtatggaatatttgcacgggaagaatattgtgcacttcgatttgaagagtgataatctgctcgtcaacctaagagatccccaacgccctatatgcaaggtcggcgatttgggtttatcaaaggttaaatgccagacactgatctctggtggagtgcgagggacacttccctggatggcccctgagctgttaaatggcagcagtaaccttgtttctgaaaaggtcgacgtcttctcatttggaatcgtgatgtgggagctgcttaccggtgaagagccttacgctgacctgcattacggcgccatcataggtgggatcgtgaacaacaccttacggcctctggtgcccgagtcgtgcgaccctcagtggagatcgctgatggagcagtgctggtcagccgagccgacggagcggccgagcttcacggaggtcgtcaagaggctgcgggccatggcgacctcccccaccaagccgctgctgcagaagtagaccgcccttagctccttacatgagtaaggtgacgaaatatagagaagaacgcggcgatgctgcctgcttacataggaatagtggagagctggggggggtttgcctgacgcttcatgtggtgctgttaaaactgatggtgatgaaatgtaagagcatgtccnggnnaaaaaaaanaanaanaananaaannaaaaannnaanaaaaaaaaaaaaaaanntttggggggggggcgcggccccaccccctaagtatatnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5158 - DNA, 539 bp, Hordeum vulgare
  UNSURE (8),(12),(16),(17),(26),(37): n stands for any base
cattcacncatncagnnttttaacangcaccacatgnaagcgtcaggcaaacccccaccagctctccactattcctatgtaagcaggcagcatcgccgcgttcttctctatatttcgtcaccttactcatgtaaggagctaagggcggtctacttctgcagcagcggcttggtgggggaggtcgccatggcccgcagcctcttgacgacctccgtgaagctcggccgctccgtcggctcggctgaccagcactgctccatcagcgatctccactgagggtcgcacgactcgggcaccagaggccgtaaggtgttgttcacgatcccacctatgatggcgccgtaatgcaggtcagcgtaaggctcttcaccggtaagcagctcccacatcacgattccaaatgagaagacgtcgaccttttcagaaacaaggttactgctgccatttaacagctcaggggccatccagggaagtgtccctcgcactccaccagagatcagtgtctggcatttaacctttgataaacccaaatcgccgac

SEQ ID NO: 5159 - DNA, 241 bp, Hordeum vulgare
ctgagctgacctgagagcttgcttgctcgctccgtcacccggagtgtcactgtctgtctctgcctttcttttcccctctctctgtgtttgtgtccttgctctcctttggccttttgctttcccaacctctccccggcctcaataatgatggagtcgccgttgcagtgggttcgctcctgattcctcaaggccaaaatcccctgtctcgtctctccttctccaccggcgcgccaaaatccaa

SEQ ID NO: 5160 - DNA, 472 bp, Hordeum vulgare
tgacgaactgagcacaatccttcattgccactgcaggagaaagaaagtacagattactacagagcccttaagttcctagctagctacctcagatatctagtagtgtacacaagcatagctgataagtacccctaggaataactgtacagtctcctctaggtctgtagtggactagcctaagtagtactagctctcatatgcaggcaccaagcgggaaaagttcacaccccaggtcgttttcggcgaacggcacctcgtcgttctccacttttattacggaattgagaaggccatcaaagttgcagccgctggagttgaacccaccctgaccctgcagctttggaacttccaaatcatacatatgggcctgttcaggcacaatgacaccaccatcatagctaaaacctccattgttcagcctttggtcttgtctcattccatccattctatgccttgggttgcttgcaacccc

SEQ ID NO: 5161 - DNA, 387 bp, Hordeum vulgare
agccccaacaactggcgacatctccggctagctctaacagctcagtcctcactcatggcagtggagatcctcgagtcctgcatggtgacgcccagcgaggcgacgccgaagcacgcggtgtggctctccaacctcgacctgctggtggccaggggccacacgcccacagtctacacctaccggccatgctccgacccggccttcttctcgccggacgtcctcaaggccgcgctgtccatggcgctcgtcccgttctacccactcgccggccggctcgcgcaggacgacgcgggacgcccggagatcagctgcagcggcgagggggtcctcttcgtcactgcgcgggcggactccacgctcgacgtcctcggtgatttcgccccgtcc

SEQ ID NO: 5162 - DNA, 374 bp, Hordeum vulgare
tttttttttttttttttttagacgcctagacggtgttcaatatctatcaatctcacatcaaatggcaacgccatacagcttactagtaccatcgtagactactttggaattgatttcgagcgctgtggcagtttttattttagctttgcacttatttttatgctcagatgatgagcattttatgaaccgaagacttcgttttcgaacttctagcgcatgagctcctggtagaacgcctccttgaacctggccaggctctcgggctccatggccaccacgacgtccagccggccgtcgtcgtcggggccaggcacgaggtacacgaggccgctgaactggaggcaggccctgcccatgaacgccggccgccccca

SEQ ID NO: 5163 - DNA, 444 bp, Hordeum vulgare
aactcgcacaagctatccagtcacgcgtccgcgccgaaaatgtcgcctccggcaccatgccagctcctcggcgctgagagcgcccacgcgacggcagagccattccgcgtgtacgtgggctacgactcccgcgaggacatcgcataccgcgtgtgccggcgctcactgctgcggcgctcctccgtgccgctggaggtcatcccgatcgtccagcaggagctccgcgaggccgggctgtactggcgggagcgcgggccgacggagagcacggagttctccttcacccgcttcctgacgccacacctcgccggctaccgcgggtgggcgctcttcgtggactgcgacttcctcttcgtggcggacgtggcggagctggcgcgcatggccgaccctcgctacgccgtgctctgcgtgcaccacgactacacgcccaaggaggccacc

SEQ ID NO: 5164 - DNA, 435 bp, Hordeum vulgare
ttttttttttttttttgatgaaaacttagatatgcaatatttatttcatatctagatgtgttttagcaaaaccgataattatattggatacttggccctcaaggaacgcgccttacaggtccttattcttacacatggtactcgatcgttacacttgcagtaggaactaacttgacaacggcacgtacgcagtgacacgaccgcgcgtcaaacaagcaaattaaccaacaaagacgaacggaacacgtggtgtgctgtgtaaaaaaattaaaccggaacacgtggtgcatcatgcgtccacagcaactgcagacgatgatggcactcttgtgccttccacctcgccttctttctcctccgactcgtacgcgtcgcgctcctggatccagaggtcggcgaactcgcagtctttgtacagctcgaaccacggcccgc

SEQ ID NO: 5165 - DNA, 348 bp, Hordeum vulgare
ggctcgccagatcatcctcctactcctactcctacctacataccccgtctccctcccctcccctttctcctccccccgcgccctgccccgagtaaaaaaggaaggaaggaaggaaggaagagcagagtccacacggcagaggccagaggcgggatgccgatcctgtacggggtggtggcgcggggcgcgacggtgctggcggagcacagcgcggcagcgaccaacgcgggcgccgtcgcgcgccaggtcctcgagcgcctccccgacggcggcgccgatagccacgtctcctacacccaggaccgctacgtcttccacgccaagcgcaccgacggcatcaccgccctc

SEQ ID NO: 5166 - DNA, 337 bp, Hordeum vulgare
ttttttttttttttttacgttccaaacggagtcttcacaatccaaggcgtcacaattacagaataaatagcaggcccgtctcctttctctttctacacacacaaaaaatactttttgcaatgcgaccggttgcgctggcgctgcaacggtcgctcccctgggctgggagacagacaagccatgggcacaggcacaccacgagacgaatttatatgaccctgggccctctcaccggatgcaagtcggcaaggtgaagccgtggcacacgaagaagagggcgatgtatactactacaaggaggaggagtatcaacgcggccgcgagtttgacatttctc

SEQ ID NO: 5167 - DNA, 388 bp, Hordeum vulgare
actgccacactcgcacactcctcccggccggcatggctgctctctcgtcacctctcctcatctccatcctggtggtcctcgtcgccaccgccaccacaacccaatgccgccctcagaagcaccaccgccatgccgccaagcccacccttgcaccgctggccgccgtccacgccatctgcggcaccaccccgcacccggcgtcctgcctcgcgtcggccgccgtgcacctcgacgccgccacggcccatctcctggcgacgtccatcaccgcccccctcctccccgcgaacatcctctcggtcgcgctcgcctccctccgcggcgcgctctcggccgtctcctccctctcccccgccctctgctccacgctctcggccccgtcgtcctc

SEQ ID NO: 5168 - DNA, 366 bp, Hordeum vulgare
tttttttttttttttttttttgcaatggtaaaaactgctgattgattgcacgcttaagtcttaacagatccaaaaatcatctgattcagttggataatgtgttcatgacacagacggattcaacagaacttactgaacatctcaccggaatttaacgcagtaacggctcaagattagcctctgaattctgcagaccccgcgtagttcagatgccttggtcgtaggggaaggaggtggcggcgagccagtcgtcgccgtaaatgaacttgtcgacggcgaactgggcggcctcgtcgtagcccatctcgtggaacccggcccagcccacgcgcccgtccgtgccggcgccgggcccctcgttcccgt

SEQ ID NO: 5169 - DNA, 442 bp, Hordeum vulgare
attgcttgctcctctcctctccccttcttcctcctctctccgttgccagagcgtcgtcacccagccatcttcgccgggaaacgggaatcacttgttgttgagacgggcaggatgtcttcgcctccgacggtgtctggagcggcggcggacgcggcgacggcgggcgcgccggcgcagctggccatcagcaacggggtgctgctggcggcggtgatcttcctcttcatggtggtcgtcttcgtcttcctcctctacctctacgccaagcgcttcctgggggccaaccccatgctccacggcgccggaacggcctcctcgcgcttcatcttcgtcggcgactccccgttcccgcgccgcggcttgccggcctccgtcctatcgtccccccccgtcgccgtctacggcggcggcgcctcgcccaagacccccggaggccagggga

SEQ ID NO: 5170 - DNA, 361 bp, Hordeum vulgare
tttttttttttttttttttcaggggcaccaatgccaaacatccctttgtttacatcagaattgctggccaaaatccttggcggaaagagagaaagacaaaagaaattgaagcaagggaagaagaaagaatggacacatgtatgtatggactctccggtgatcggcgaggcgagccaatgcgtcagagagccacgccggatggatcagttcgacgacggaggcggcgtcttgggcgggcgcccggcgccgaggccctgctcgatgtcgcgcgggctggaggaggacgttgcgcccaccacggcctgcttgcccctgctcaggagccggcggagcgagcggagccgggcggacatcggggacc

SEQ ID NO: 5171 - DNA, 552 bp, Hordeum vulgare
gtacccccgggtctgcaggcaattcggcacgaggcggacgcccgcccgccgactccaccgaggcgaagctccgtccctccgcctcctccgccgcctggcgacgaataagtagcaaatctttacgccggcaagatggtgcagtataatttcaagaaaatcactgttgtccctcctgggaaggacttcattgacataatcttgtcccgcactcagaggcaaacaccaactgttgtccacaagggctatgctatcaaccgcattcgccagttctatatgcgcaaggttcgctatactcagcagaacttctatgagaagctttccaccatcatcgatgagttccccagactggatgacatccatcctttctatggcgatctcctccatgtgctctacaacaaggatcactacaaacttgccttgggtcagatcaatacggctaggaatatcattgcaaagatctccaaggactatctgaggctgctcaagtatggagacaccctgtaccggtgcaagtgcctgaaggttgctgcactaggtcgcatgtgtactgtt

SEQ ID NO: 5172 - DNA, 548 bp, Hordeum vulgare
gagaattgcttgagcttaaaacagcctgaggaatgcaagtaggcctatctctgttgtcacgaggcttgggcatagcaacatgaaacctatttaagcagtcattgatcttctttgacttcatcttgatctccaccctctgctcaagaagcctctcacatgcagcatttttaacagccatcacaccctcatctgttaaagcactcatagtcaacaaaacaccctcttcactaggatctccaccttgaggtatagtcttcatagcctctgacttcatctccattacgagcttcatgtcctcttcagaaagcccatcaagcggctgcaaatcagtcttgttgcacacaatgaccagaggcttattcatgaacagggattttatactgtggaagagtgcagcttgctgagcaatagtgtacccacaagaaccagagatgtccaagaagaacagcacagcagccctcaagtgggcaagagcggtgatactgcacatttctatgatgttcctatcctcaaaaggccgatcaaggatccctggagtgtcaatcact

SEQ ID NO: 5173 - DNA, 518 bp, Hordeum vulgare
ctaaaggcgcctgcttctgcagccttggccactcgggcgcgtacggcgaggggtcctgggcgcggaggaagggcgtcctcgatttggcggctggccggaggttcgcgccgggcagcgcgctgagcctgaagggctgcctggactggcaggacggcggcagcttcaggagggtggatggtggtgcggtggagatcaaggcgcgggttctcgccccgcagcggcagttcgtccgtgatgcggaggttcggccgtcggaggaggtgggtgtgaagagtgtggatggaaatggcgcttaccggcgtgggaagcgccttgattttcctgagcagcctgtgccgaccaagatggtggttgctgttgatgtggatgaagttcttggaagctttcttgctgctctgaacagatttatcgctgagcgttacgcttggaatcactcagtatcagaataccatgtctatgagttctttaggatatggaattgttctcgagaaaaagctaaccttcttgtccatgagttc

SEQ ID NO: 5174 - DNA, 554 bp, Hordeum vulgare
ttgatccattataggatcgtgtgcgtcagatcaattatatcaactttttgattcaacaaatgcatatagcagtggcagtatatacaccacagtaccacagaagctaacatgctgaaaaagaatacatcttcgaagcgtgactgtgtgagcatatcttcaatcatctcagggcatgctagactgagtctgattgtcttccaggcccttgacatgttcatgtatgagatgttgaaagggaaccaacgacctctttcttgtgtgcttgagcataattctgctcatcacaccggatgaagaagaatgtcaactctcaggtgctacccacgagagaagtttctgctcaacctcctgccagttatgaacctttgtcaccagaggatgtgattgatccacaccagttttggaccagggatacgtgttatcgtaatcaaagagcaaaactctcatgccatcctcagcgcattctaaagcgtatctcgggttatcatctattaaaacctgagcaccaaaagatctgcaaatctctgattttgaccttgattgaccttccaggg

SEQ ID NO: 5175 - DNA, 169 bp, Hordeum vulgare
atcttatcctcaccgaggcaactcaggtgaagccatccattggaacagctgtagctgttggtccgggctcactcgacgaggaaggcaacaggcagccggtgtcggtgtcaccaggcagcactgtgctgtactccaagtacgcaggcggcgagttcaagggcactgatgg

SEQ ID NO: 5176 - DNA, 537 bp, Hordeum vulgare
cagatcaccaggtttgcttactccactcacagacggaagatatgtgtaggaaccctttcacacaagtagtaacgccacaacaataggcaatcagcttaagcactaatgtacatacataatgtagaagtaggggaaaaaggcatcaaacttgctttgtaaacaaattcgtaaatgtttttaacccggataagtggtttgctcatgcaattctataaccatctgaaatagcatcaagtgattaccacagcaatctcacccctgatgctcgcctccgttgtgaactcaaaactgaaacaaagtaacaaactccacgcttaagagagctcagccatcacatctgacactctcaacacaatgtagttggtgccatcagtgcccttgaactcgccgcctgcgtacttggagtacagcacagtgctgcctggtgacaccgacagcggctgcctgttgccttcctcgtcgagtgagcccggaccaacagctacaactgttccaatggatggcttctccttggttgtctcggtgaggataagacca

SEQ ID NO: 5177 - DNA, 518 bp, Hordeum vulgare
gggttttgtgtcctgagcctggctgccaagctgacccgcctccacagcctcagggagcgccttggtgccaccttctcctcccatcccaatgagctcattgcactcttctccaggtatgttcaccagggcaagggcatgcttcagcgccaccagctgctcgctgagtttgacgccctgttcgaatccgacaaggagaagtatgctccttttgaagacatcctccgtgctgcccaggaagcaattgtgctgcccccatgggttgcacttgccatcaggcccaggcctggtgtctgggactacattcgggtgaatgttagcgagttggctgtggaagagctgactgtttctgagtacttggcattcaaggagcagcttgttgatgagcatgccagcagcaaatttgtgcttgagcttgattttgagcctttcaatgcctcattcccgcgcccttccatgtccaagtccatcggaaacggggtgcagttccttaaccgtcacctgtcttccaagttgttcca

SEQ ID NO: 5178 - DNA, 541 bp, Hordeum vulgare
ccgggcaggcgtttattcgaggcggctggcatgaaccagcaagcagcactgcccaagacctcacgaatgtgccgagacatcaaatcgcacaccccacgacagacagaccaaatggaaactacggtagacaaatcatagcgcagccgacacttcaccctcctgctcgatgaatgcgccctcttcatgccccaaatccgcgctagttgccgctgctctcgccgtcgaccgccaatggaactgcagcagccaggctgcggtacttgagagcgtagaacatctccaggtaacggcgagtctcgcgcctctccaggttgctcacgtacttccagaacccatacacaccggtcagggtcatcagcctctctgagtagagcttccaggtgtacttctcataaattctcttcaggcctccctgggagattttgtcccagtagcttggatccgccgtgctcttctcaaagaagttgaccaagatatctgcggccttgtcgctgtggtaaggatcaatgtgcagaccagacactccatccacgatgatctc

SEQ ID NO: 5179 - DNA, 499 bp, Hordeum vulgare
gcctcgtgtgccgaattcggcacgaggctggtgaatatgactgtgcctcagggtctgctaaaaggaagagaaagaaccagttcaggggcatccgacgccgcccttggggtaaatgggctgctgaaataagggatcctcgcaagggtgtccgtgtctggcttggcacttacaactctgctgaggaagctgccagagcctatgacgttgaagcccgcagaattcgtggcaagaaggcaaaggtcaatttcccagaagaagctcctatggcttctcagcaacgctgccctgagcctaccgctgtgaaggtgcctgagttcaacaccgaacagaagccggtactcaataccatgggcaatgcagatgtgtattcctgcgctgctgttgactacaccttaaatcagcaatttgtgcagcctcagaacatgtcgttcgtgcctaccatgaatgcagttgaggctcctttcatgaatttttcctctgatcaggggagcaactcttt

SEQ ID NO: 5180 - DNA, 557 bp, Hordeum vulgare
  UNSURE (20): n stands for any base
ggccaacataccaaacattntggcttaaaggttaggtttacaggcctcttgtagcaattacaataaggtagaaacaggaatacaaaataagcagttcccattacatactaagtttcatacacatatagatatatagtcccggggtacaagacaaaagtctattgcaaaagacttcagtctcctgaccatttaagctagacataactatagactgacatcgctactgctcgattctagaggcaccagacacaagcacttgttgatgtccagaatacttattccctttgtctatatatacaggcacccagcaacctcaattccctcagtagaaaccagcagacaagggcatgtcatcaaaggtccacaggtccatgttgccgaccacatcctggggcacatcacagcttagaatgctgtcaattgactcatctgaacgatcgtccatcaggaacttcatgtatggctccaagtcggcaagatcaacattggcattacccatcacaggaggtgccgttgaattactgccattgttctggacaaatgcagattcattgacc

SEQ ID NO: 5181 - DNA, 452 bp, Hordeum vulgare
aacctgaagggtgttgtcggggcaacgattgtcagtgccgcgaccggtggtcacaagcgttgctgcgtggggcaccggcggcaccataagtgaagggggcgactctgcagcgtcgttgtgatgcggggtggtcaccggtgctgcgacagctgagctgcaacgcaacaccgatggcgaagctgcgatactgcgtgcatggacctcgatgtcatcggcagcacggttgagatgcgatgcagcccgtgtactgctgcgatggagcatggacaggagctgcacatgctgctatggagcatcgtcggaccaccggtgcttcgatgaagcgtctcccttgctgctatggagcatcgccagaccaccggtgcttcgatgaagcggctcccgtgctgctatggagcatcgccggaccaccggtgcttcgatgaagcggctcccctgctgctatggagcat

SEQ ID NO: 5182 - DNA, 468 bp, Hordeum vulgare
ggctaagggcgttgctagggatcaggcggatgatttcttagataatcatccggctgcacagccgttcaatccttccattacaaccgttggatcgatagtttgccagcaggagcagcaacacgaggatggatctttgacagcagcacggggatggatgctcgacagcaacaacaacacggggtgctccattgcagccgtcaactccggcgaggccgcactccatcgcggcgccggtagagcttgaacgcggcgctggccgcccgtcgcaactccggccatgcttcattgcagctgcatttctgacaacaactccagacaagtgctgcatcgaagcatcggtggtccggcgatgctccatagcagcaggggagccgcttcattgaagcaccggtggtctagcgatgctccatagcagcaagggagacgcttcatcgaagcactggtggtccggtgatgctccatagcagc

SEQ ID NO: 5183 - DNA, 543 bp, Hordeum vulgare
  UNSURE (16),(41),(53),(55),(65),(79): n stands for any base
gtcccccggctgcagnaattcgcaccaggcctctgcccggngccgtacccggngnaccaacacgnagttcctcgacaanaacgggatcaagctccaccagttcggaatcgagggccgcaaggagccattcgtcgagatacccgatgagaaaatccgggaggcacttaaagttgtcctagatgtaagaaatcaacctctgcttattcactgcaagagaggcaagcaccgaactggatgcgtcgttggttgcatgaggaagttgcagaaatggtgcctgtcatcggtctttgacgagtaccagcgcttcgctgctgcgaaagtgaggagcaccgacctgagattcatggagctgttcgacgtcgcgagcttgaagcacctgaccacctcacattgttaaccaaaggacgagtgatcgctcgcccccgccgtcctcccagatcctagtatatctccatcctgtcctccggcggtcactgaaccgactcagcagtgaataatttttggaacccgtagaatgaatccatgagatagcgacgagacctc

SEQ ID NO: 5184 - DNA, 532 bp, Hordeum vulgare
  UNSURE (4): n stands for any base
tgtncttattgcatgttagacgaattacattatctccttgggaggttgaaaatttcctcgtatcgattgcaaatgaacagcacccccgtggagttgtggtctcaaatgtcgtacatattactcatccgccactcagacgctcattactcattaagttgtatgtgtgccaatgccagcccaatcagtcagatgcaatgctaaaagactctgattaatttagatgcattcatgcaaagaagagccaagctctctgcctagcaatgctgctcgagtacagagcttcagtacccgaaaacaatggtgaattcatcgcaagaaaaagaaaacctcttgcaatcctacccacaactttctggttcttaggatctgcagggacctgagcagggaaaaaatagagctctcaagttcttcttcaatcttctgttttgcagaggtctcgtcgctatctcatggattcattctacgggttccaaaaattattcactgctgagtcggttcagtgaccgccggaggacaggatggagatatacta

SEQ ID NO: 5185 - DNA, 517 bp, Hordeum vulgare
gttgataccgctccaacgccatggtgtcctctcgctgcgccgtcctgccacaccctgccggagtcgcccctcgtcgccggcaacacctgcccgcgcaggcgttatgggggccggagaggaggaggcggcggcggctggtgagcttcgaggccccgccccggtgccacaagatgtacgttcccggctttggagagggctcgccggagaaaaaggcggcgatcagtctgctcaacttcttcaattacctggctgtcaggattgtgctggcacagcttgagagttacaaccgagaagcatatgttgagctcaaggagttcacaagccgcaactccgtgaacgacgctgacagcttctgcaaaaacctaatccgtgagtcgccaaggcacaaagcattagctatgaggattttggaggttcgatcggcttatatgaagaatgatttcgagtgggacaacttgaagaaactatcgttcaagatggttgatgaggcgaacataaagctcatgagggactatgt

SEQ ID NO: 5186 - DNA, 554 bp, Hordeum vulgare
gcctggccaaaactaaaatggcattacattgcgaaacagagtgagcaatgcttgattcagcatgtcgtgtaagcaacaaactgttatctatatgacccaaccactggttcagtgtcagggtggtgtaaccccatagcggcgtcatcacgtgatctgaccatttccagtcccaaatacacggagtttgaactgcacatagtaataaaagaatataatcagaccctgtgcggatcgactgagacctgcacggcagatgcgccgaggatacatgggatatcttcactcttcgtcttctatgtggctggtctccaggacatagtccctcatgagctttatgttcgcctcatcaaccatcttgaacgatagtttcttcaagttgtcccactcgaaatcattcttcatataagccgatcgaacctccaaaatcctcatagctaatgctttgtgccttggcgactcacggattaggtttttgcagaagctgtcagcgtcgttcacggagttgcggcttgtgaactccttgagctcaacatatgcttctcggttgtaactct

SEQ ID NO: 5187 - DNA, 244 bp, Hordeum vulgare
aattctagcttggcaaccttttgtggaagtattttcaatataaatcctgctcaggatcgcactagttgttgaagtgatatccgctggatgtttcatgagcttatacatagggcacatccataaatacaactctttgaatgagcagcctgacattctacggccactttattctgcactgcaaccatctagttcgttggaagagataaggtactatgattctcgtctgtctgatcaacaaatggca

SEQ ID NO: 5188 - DNA, 551 bp, Hordeum vulgare
gcttgtgcaactctttttctaacaggactgagcaagatttcatgtttcatggagtacttcaaattgctgcattacatatttacatgtgctcatttacagctaacaaacagacattcttactctctttttgtaacagaatctaatctctcatttggtactgtacatcaacgtacaaccgtgtactgatcttcacttctttggacgttcaaatcttcacacgatgccgcaatcttctcctagttacctgcctcggcataatgtttcaattgatagacccaatccggggacataagctaaggcacacctatggaggaattctctgattgaggaatgtcatgtattttctccctggttgattgacgtctgagctttgtgcggttcttctgcagttccatgttggacaccctctcggcctcaagcgctcgctcaagctttgctgctcgagtgctccattcaccaaggatagctcgtagtctctcgttttcttcgacatattgattgttgttcccacgaatgtgctggatctctgagtccttctcagcaatcaaacc

SEQ ID NO: 5189 - DNA, 515 bp, Hordeum vulgare
tacacgagctcagaagcaagaaacagagcaagtcgctagtgattcctctgcaagtcggcatccagtttgcacaagagaagatggtggccaaggaggcgatcccgctgctgacgccccacaagatggggcagttcgagctctcccaccgggtggtgctcgcgccgctcacgaggtgccgctcctatgccaacgtgccccagccgcacgcggcggtgtactactcgcagcgggtcaccaagggcggcctgctcatcgcggaggccaccggcgtgtccgccaccgcgcaggggtacccggagacccccggcatctggacgcagcagcaggtcgacgcctggaagcccatcgtcgacgccgtccaccgcaagggcgctctcttcttctgccagatttggcatgtcggcagggtctccacgaacgatttccagccggacaaacaggcgccgatctcaagcactgacaagcagatatctcccgatgccgagcccggcatggtctattccaagccccgacaa

SEQ ID NO: 5190 - DNA, 552 bp, Hordeum vulgare
aaaatcttcacatatgtggcattacatggcgagtcataagtaaattgtttgtggaaatgatacactacacatgcccgtgcatatacataccggagaaaaaattattacaattatataaaccaagcaaatcattaactatagttgagcagatgaactattcagcgttcgagccatcaaggaaaggatagtctgtgtagccaatgataggatcctgcgtgtagaaggtgttgcggtcgtacttgttcaaaggagcgtcgagctcaaatctcttaggcaaatctggattagcaagaaagatccttccgtaagcaacaagatcagcatagccgtcggccaccactttgttgccttcctttcgatcataccctccagcggcaatgaacgtgccgttgaatgctttcctgaagggcaagagcctgtggggtatctgcctgcggccatccacaatggccattcggggttctaccatgtggcaatagacaaatccttgatgcttgttgagttgttgcaccatgtacattccgagtgcatgtggattggagtcgaagcagt

SEQ ID NO: 5191 - DNA, 202 bp, Hordeum vulgare
actgtctcctccttccagggcgcaacgcttgctcgtttcatctctgctgccatgccacaggtagcacagtacaaggtcgcgctatgccagctgccggtttccccagacaagcacggcaacatcggccgcgcgcgcgcccgcatcgaggccgccgcaaccgccggcgccaagctcgtcgtcctgccggaagtatggagctgcc

SEQ ID NO: 5192 - DNA, 550 bp, Hordeum vulgare
gaggacgtaagtttttgttttaaatacaacaagtatacacctaccaagatacacacaatccacacaacaaaatatgaaagtctcaacaaggaaaaacatcctagtaaccgggttttagcagaatccggactactcaaatacacatgcctttctctaggagagcaaacatctgaaggcaatccacatatagttcatgctaagagaacaaatacaagtataggaacatatccactagaaaaaaggtataggaacatatcctgagtaacggggttctggtagacaggcatcccgaacctttgcatgccactacacaattgtgcaaaccccgaactgtcttcctgaacagtgaacccatcgtgtgaccaacacagaacggggcctattatctcttcctcgagcagcgcagctagctcgaacattccctttggacatcgatcagcctgtacagatcccctctaccctgcgtttccaaagggaggttctcccttacagcttgaatcaaagacaagtcgatctcgccgatgacggtcgcgtcctcgtgccctgccgc

SEQ ID NO: 5193 - DNA, 528 bp, Hordeum vulgare
  UNSURE (3),(11): n stands for any base
ggnctgcaggnaattcggcacgagggggatgtgacgggacgccccttacttacaccagccaatgcgtcaaacccatggtggtctgtgtttgaacaggctatcatctcttcgggtggaaaactagcaaagccagagatcttatcttcaaccacggacgcccgattcgtgaggcagatgggtgttccagcccttgggttttctccaatgataaatactccaatattgcttcacgatcataacgagtttctggaggataaagtgttcctgaggggcatcgaagtgtatcaacatcttatcagagcgctgagctccttcaaaggctgattcgaaataagcacataagttgtaacattattgtattccgatcccatgtaaattaattgtagcgaagctaattcagatgcccgcgatgccacaaccatcatgctccaagccacagataaactggttagggctcatccagtcagaataaactttttctgaaataatggaaatctgctgacggcgatctcagcaggttgatttgta

SEQ ID NO: 5194 - DNA, 491 bp, Hordeum vulgare
atacagcccgtaacttcgtatgtcatcattacaaatcaacctgctgagatcgccgtcagcagatttccattatttcagaaaaagtttattctgactggatgagccctaaccagtttatctgtggcttggagcatgatggttgtggcatcgcgggcatctgaattagcttcgctacaattaatttacatgggatcggaatacaataatgttacaacttatgtgcttatttcgaatcagcctttgaaggagctcagcgctctgataagatgttgatacacttcgatgcccctcaggaacactttatcctccagaaactcgttatgatcgtgaagcaatattggagtatttatcattggagaaaacccaagggctggaacacccatctgcctcacgaatcgggcgtccgtggttgaagataagatctctggctttgctagttttccacccgaagagatgatagcctgttcaaacacagaccaccatgggtttga

SEQ ID NO: 5195 - DNA, 512 bp, Hordeum vulgare
cccccgcggccggcccttccccgcctcggcgcgcctccgcggcccgttcgggggcatgaattcgtggaagaatccaatcctcaaaaactcgtggagaatcggtgatgtcccggcaatgtttgggctgccgtctggactgttcagatgcacggcttcaggtggctctggggatggcgggttttctcgtcctcaatcaattgatgaagcaccgatgccgctgtacccctggccagacaagcagcggccacgagtatgcattttgggtggtggatttggtgggctgtatactgctctgagactagaatctcttgtatggcctggtaataacaagcctcaggtaatgctggttgatcaatctgacagatttgtatttaagcccatgctgtatgagctcttatcaggagaggtggatgtctgggaaatagctccctattttacagagttactgaagaacaccagtgttcaatttgtgaaggatagtgtaaagcttcttcgcccttctgatcacttaa

SEQ ID NO: 5196 - DNA, 550 bp, Hordeum vulgare
ggacacgtacttttatttaaaatccgcatgttcagaagttaggtgcaacgtacactcggaattgaaaatttgtacataaaaccgacaccgaatacatcatccagctcgctcagttcatgaattagcaggtcccctttaccatcaggagcttgcaattatgttacttactgcatcctgcagagacgcaagcgaatcgacagcgccctttgcgaaccaactgattccaaccttcacccggtgctcatccgtgggcatcctgaggcagtacacgagcttccgagcagcatgccctataggcccttccaaggttagtccctcgatgaaattcgctgttatcgcagcgtcgtttctaccaagcgtcatcatctcaccaaggttttgaaacctgaacggcaaaaggggccggtcgttgattgccgcccagagattccatccagcgaaatctgcttgctggaaagcaacctgtgcgttggctgggagaaattttcctgatgggtctcttagagctgctgaatcaccaattgcaaatgttcgggggtggccctttact

SEQ ID NO: 5197 - DNA, 519 bp, Hordeum vulgare
gctcgccgtgctctgcgacgccgacgtcgcgctcgtcgtcttctcctccaccggcaagctctcccagttcgccagctccagtatgaacgagatcattgacaagtatagtactcattcaaagaacctggggaaatctgatcagcagccggctattgatttaaatttagagcactgcaagtatgacagtttgaatgaacaacttgcagaagcaagtcttcgacttagacacatgagaggtgaggaacttgacggactaagtgtcggtgagttgcagcagatggaaaagaatctcgaaacaggattgcagagggtgctttgtacaaaggaccggcaattcatgcaacaaattagtgacctgcaacaaaagggaacacagctggcagaggaaaatatgcgcttgaaaaaccaaatgcatgaggtgccaactgctagcatggtggccgttgccgatgttgtccctgaagatgtccattcatctgactctgtgatgacggcagtacattcggcaagctcgcagga

SEQ ID NO: 5198 - DNA, 547 bp, Hordeum vulgare
ttatagctgagcacggtgccatacgcttcacataaaataatacacatagccgcggcaggtgcatacatggtttgcacgaatgatacatgtcgctaagagagcaagaggatacgctacaagtacagttactgaatacccaggcaaaggtggacaactgcgccgtgcgcattgcagacataaaacaacgacaatttgatcgggttaaactgatctggcttctactataggatcattccagtcagcctatcttggagtgagtctccatagcattggacatcttctctctactaaggaactccctcatggactcatagtggtctgtctccccgcggaccttacttccaaggtaacgctagtttaagggatatatcagaaccgtcgtcattgtcctgcgagcttgccgaatgtactgccgtcatcacagagtcagatgaatggacatcttcagggacaacatcggcaacggccaccatgctagcagttggcacctcatgcatttggtttttcaagcgcatattttcctctgccagctgtgttcccttttgtt

SEQ ID NO: 5199 - DNA, 514 bp, Hordeum vulgare
cagcacttaagacgggcctagttttactgaagctgctatgggacggctggctcaaggaacaaaagtcttagcggaaggtggctatgaaaaaatatttaaacagacgtttgagattctgccggatgagcagctgaaaatgtcttacgcatgctatctatcaacatccgctggtcctgtcatgggagttatgtacatttctacagctaaaattgcattctgcagtgacaatcctctttcttacaaagcaggaaataaaacagaatggagttactacaaggtggtcattcctcttcatcagctaagaacagccaatccttcagtgagcaaagtaaatcccgctgaaaagtatattcaggttgtctctgttgaagggcatgagttctggttcatgggtttcctgatgtacgacaaggccgtgtccagcctgcaagaagcacttgacggtgctcgtgagttgcaaccataggtagatatgaaacggaagtttcagttcagcctgtaacatccccagggg

SEQ ID NO: 5200 - DNA, 509 bp, Hordeum vulgare
atcatcattacaacacagggaacgcttagaacaagaacaaacacgtatacaagctcgtgagtgtaccgaaccgaatgctccaaggggcacagcatgaaggatatatgtcttaaacaggagacgctcagagcagaagacgtcgagtggagaactggcgatacccctggggatgttacaggctgaactgaaacttccgtttcatatctacctatggttgcaactcacgagcaccgtcaagtgcttcttgcaggctggacacggccttgtcgtacatcaggaaacccatgaaccagaactcatgcccttcaacagagacaacctgaatatacttttcagcgggatttactttgctcactgaaggattggctgttcttagctgatgaagaggaatgaccaccttgtagtaactccattctgttttatttcctgctttgtaagaaagaggattgtcactgcagaatgcaattttagctgtagaaatgtacataactcccatgacaggaccagcg

SEQ ID NO: 5201 - DNA, 710 bp, Hordeum vulgare
  UNSURE (630),(710): n stands for any base
tatttgcgggaactttaggtgacacttgagaatactcaacctatgcatccaacgcgttgggagctctcccatatgttcgacctgcaggcggccgcactagtgattaagcagtggtaacaacgcagagtacgcggggaacccggaggacaggaacgctaaggtgtgaaggggcaggcagatcgtctcgtctcccccatcctgccggcattgatctgtcctattcttatcatccatcaatggggaggccaccttctagtgatgagaatggcctcaagaagggcccctggactagtgaggaagacgagaagctcatgagctacatccagaagcatggccatggaagctggagagcccttcctcaacttgcaggcctgaacaggtgtggtaagagctgcaggctaagatggaccaactacctgaagccggacatcaagagagggaagttctcccaggaggaagagcaaaccatcctccagctgcacaccgtccttggcaacaagtggtcggctatcgcaaagcacctccctggacggacggacaacgagatcaagaacttcttgaacacccacctcaagaagaagctcatcaagatgggcatcgattcaatgaccaccgtccaagaacgacttnttgttgttctccgcagattattgactgcaaccttggccagtaataatcaacagcggggaagaccccctgcggctgaaaan

SEQ ID NO: 5202 - DNA, 361 bp, Hordeum vulgare
aacccggaggacaggaacgctaaggtgtgaaggggcaggcagatcgtctcgtctcccccatcctgccggcattgatctgtcctattcttatcatccatcaatggggaggccaccttctagtgatgagaatggcctcaagaagggcccctggactagtgaggaagacgagaagctcatgagctacatccagaagcatggccatggaagctggagagcccttcctcaacttgcaggcctgaacaggtgtggtaagagctgcaggctaagatggaccaactacctgaagccggacatcaagagagggaagttctcccaggaggaagagcaaaccatcctccagctgcacaccgtccttggcaac

SEQ ID NO: 5203 - DNA, 439 bp, Hordeum vulgare
ggcaagcaaccgagcatagctccatacccactaatcacacgcctcatcttctcttccgggcagctccgagctgtatgtagcgagagtcgaccactgctagctgatacaacagcttgccgatcgataccatatatcgtagcctgcctgtgatcaagagatctccgggatcaacctcgaggcagaggcagaggcagaggtagagagggagggtagtcgacctgagatcagcagccaaccaaagatgtcggtgacttccaacacgccgacgagggccaactcgcgagtgaactactcgaacgagatccacgacctgtccacggtgcaggacggcgcccccagcctcgcccccagcatgtactaccaggagaagtcattcgccgacttcttccctccccacctcctcaagaaggtgatatcggagctggtggcgacgttcctg

SEQ ID NO: 5204 - DNA, 399 bp, Hordeum vulgare
ttttttttttttttttagctgcatgggcatcatattaacttatgcaacctcagacgcagtacaaagcgaaagagataacacaaagtgcacatgcacgtaggcacatggagaaaatcacaaacgtgttacaccagccatgtactcacgctatctacgtgcgtacccatggtatacacgtacacgaagctggctccatccagtacttcttcagttcctctggaacagagctcgctggtacatggtagacccgtacaaacatgtagatgcatggatcgtacatacttcgactggtacaaatgacttcccgcgcttgtacacgtgcgcacttacgtacgtacgcatgcaaatccaaatcaagagcatatatatagctggggtcgatcgggtgtagtggcacca

SEQ ID NO: 5205 - DNA, 542 bp, Hordeum vulgare
ggtctgcagggaattcggcacgaggcaaagtacgtgcttcgtaaatacaagtcggagcaagtggatttgttgagggagggtagtctggaggaagctgccatggtagacatatggacagaggtcgaaacacaccaataccacccggccctctcaccgatcgtgctggagtgcttcatatacccgaccttacggggtcttctcacaaatcaaaggattgtggatgaaagcctggagaaggcaaagaaggttctagaaatctacgaagcccacctgtccaaacacaagtatttagccggtgatttcgtcagctttgcagatctgaaccattttgcgtgtactttctacctcatggatgcgacgccatatgcgtctctgttcgactcgtaccctcatgtgaaagcgtggtgggaggatttgatgtccaggccgtccatgaagaagcttggtgcaagcatgaccacgagggtttagctacaagcagttgcatgaataatgctgctaccgggttgaattttttctcccttgctttgtagcaacatcga

SEQ ID NO: 5206 - DNA, 553 bp, Hordeum vulgare
ggcaaacgttagtcattaatgtatagttggtaaagattgagtgccaaccaaggtgcacgcaggattacacaagtgaaccttcaaatcgttcgatgttgctacaaagcaagggagaaaaaattcaacccggtagcagcattattcatgcaactgcttgtagctaaaccctcgtggtcatgcttgcaccaagcttcttcatggacggcctggacatcaaatcctcccaccacgctttcacatgagggtacgagtcgaacagagacgcatatggcgtcgcatccatgaggtagaaagtacacgcaaaatggttcagatctgcaaagctgacgaaatcaccggctaaatacttgtgtttggacaggtgggcttcgtagatttctagaaccttctttgccttctccaggctttcatccacaatcctttgatttgtgagaagaccccgtaaggtcgggtatatgaagcactccagcacgatcggtgagagggccgggtggtattggtgtgtttcgacctctgtccatatgtctaccatggcagcttcctccagactacc

SEQ ID NO: 5207 - DNA, 518 bp, Hordeum vulgare
agatcgccaatgacggcacagttccattcaggcatggagagcgcattggcttcagttacctagtttcacagaagtatactggtgagaaggcacgtgtcaaagttctccggagttcaaaaattcatgaattcaacataaagctatcaatccacaaaaagctcattccagctcatataaagggcaggccaccgtcatactacattgttgcaggctttgtttttatggtcgtatctgttccatatcttcgatccgagtatggaaaagattacgaatttgatgcccccgtcaagttgttggacaagcatctacatgcaatggcgcaatcacctgatgagcagcttgtggtggtctcacaggtgcttgtggcagatatcaatattggttatgaagaaattgtcaatactcaggtgcgtgcgttcaatgggaaaccagtaaataatttgaagcaactggcgacaatggtggaagattgcaacaaggagttcttgaaatttgacatggattacgaccaggttgtt

SEQ ID NO: 5208 - DNA, 525 bp, Hordeum vulgare
gcaaacgtgacgatgcggatacggatacgcaaatgcaagggtacctttctggtattgattcaataaatcaaatgagaacataacttcgattgctgctattctacaggtttcccagttgctcggtgccacattttttaacctagacagtgaggatacgatgttggccaccattcaacttttttgcccaaccataatgctcttccacgtccaaaacttcagcagcactcattgctgaagaggggttgctcgtgcacttggcgttgtataatccaacacaaagtacgtgccaataggatggccggatatagtggcatcggccaacaccgtgctttcactcaggccttcaggtcatctgacatcgctgaaggtatgcagtgtgttgttagaatgtcctgagtcgcagcccttgctgtttttgtctcgagaacaacaacctggtcgtaatccatgtcaaatttcaagaactccttgttgcaatcttccaccattgtcgccagttgcttcaaattatttactggtttccca

SEQ ID NO: 5209 - DNA, 520 bp, Hordeum vulgare
gtcagggttcgaggccatcgaaactgatagccaggaattagagctggacctatccagtctcaataccgtaaacaccatgttcgcagctattttcagcaagcttggtgtaccaattaagacaactgtttcagcaaccgttttggaagaagcattaaatgggtctattgtggtttcccagctccagctaggaaacgctgtgcgcaagaaggtggaaaagcaaacagctcatttttactctgtagacatcacagaacaggaagctaagaaggggctagtttgtcgtgtgcattcaactgacaaaagcaaatttaagctgctttattttgagctcgaagaaaatggtggattgagccttgcactgcaggaagatagtgtaaaggccggcaaagtttcttccgcaggaatgtactttcttgggtttcctgtgtatcgttttgagcaaaataactcagcaccagctgcgaaggatcctgatagcgcattctttaaaaggctggatagtttccaaccatgtgatatt

SEQ ID NO: 5210 - DNA, 546 bp, Hordeum vulgare
  UNSURE (4),(13): n stands for any base
gggnaaagcggtnatgtgcaacgagacaagataactaatatttacaactgattacacagccaatgaaatcaaaattgacatatcacacttgaaagaatatatggaactggactacggtggcagtagatggcctgagctacaagtgctcgtctcttaaccatatatcatgatctcagggctgcagccaacctttgcaggaaataaagtaggcagcaccaaggaaagagataacaacggcgaaggagttcttccagaggcagtcaaaatgaaagtagtttgtatctcacttgtacgcataccattatgctcagcatggctttctcctgtcaactttgaaaggaatgttcagccatctcttccttgggaaccgctctttggttttcttttcactcgactcgtcatcttcacttccgcagccttccatgtgctgatccttcgctttcttttctttcctctggtttttttcttcatcaaatttgaaggaaggtgacgatttagatttattcctgctcggagtccgttttagaggtggattgttggtatagg

SEQ ID NO: 5211 - DNA, 388 bp, Hordeum vulgare
tgtggcattgcagggttcgatgccggtggcctgtgtgtgaagggcactccagagtatgtgcgtgcgtgctgcgaagcaagcctcgagcgcctggctgtcgactacattgacctatatttcctgcatcgcattgaccagtcggtgcctatagaagaaactatgggggaactgaagaagctggttgaagaagggaaagtcaagtatgttggcttgtctgaggctagtgccgataccattagacgggcacatgcagttcatccgatcaccgcagtgcagatggagtggtcactatggaccagggatatagaggaagatattaccccactatgcagggagcttggtatcggagttgttccatacagcccacttgctcgtggtttctttgctg

SEQ ID NO: 5212 - DNA, 296 bp, Hordeum vulgare
tttttttttttttttttttttttttttttttggatttggcgccacctttcattatcatgtgtagcagttgatacatcccacagaaaatcaatggcatctgctgtttcaggaacaatgtttccctattgttgagtatggatgagcttgattcattcacatttccccccttgaatgtacttattttttgtatccagcaaggtggaaacaaattcagcataaggcggtaacatggctacatttgaggtggagtgtttgcaaccctccaagaataaggctccaggattccaatgaccctg

SEQ ID NO: 5213 - DNA, 795 bp, Hordeum vulgare
  UNSURE (1),(17),(45),(46),(64)..(68),(75),(96)..(119),(132),(133),(158)..(241),(257)..(268),(308)..(344),(361),(365)..(369),(371),(380),(387),(393),(395),(396),(416),(417),(458),(467),(523),(531),(550),(563),(564),(573),(600),(615)..(618),(644),(667),(683),(685),(697),(711),(736),(751)..(753),(760),(763),(765)..(767),(770)..(772),(774),(775),(779): n stands for any base
nttgagataaccaaaancccaaatgtgcccaaaatacgtcaaaannttctcgaaaaccaaaaannnnnttttggngtttgggggggcaccaatcannnnnnnnnnnnnnnnnnnnnnnnttttttttttttnnggggggggccccccccaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnaaattttttttaaaannnnnnnnnnnnaaaaaaaaaaaaggggggggggaaaaaaaccccccccaannnnnnnnnnnnnnnnnnnnnnnnnnnnnnnnnnnnnaaaaaaaaaaaaaaggngggnnnnngnggggggggnggggggngggggngnngggggggggggggggggggnnggggggggggggggggggggggggggggggggggggggggnggggggggngggggggggggggggggggggggggggggggggggggggggggggggggggggggngggggggnggggggggggggggggggnggggggggggggnnggggggggnggggggggggggggggggggggggggnggggggggggggggnnnngggggggggggggggggggggggggnggggggggggggggggggggggngggggggggggggggngngggggggggggngggggggggggggnggggggggggggggggggggggggnggggggggggggggnnnggggggnggngnnnggnnngnngggnggggggggggggggaa

SEQ ID NO: 5214 - DNA, 431 bp, Hordeum vulgare
ttctcaaacacagtaatctgacaagtgtacagcgcaccaagtacataaagcacatcaccacaagcacacagacaacgtcggagataattcaaacatataagccacccacatagcacactttaggttgcagtcatacaggttcataaaagagggcaatgatccagcaccaacaagggagacaagaccatctttattcgtgtagtagcgagatgtgggggcgatgacagcaggtcaagaccatgctggatgcttagtcgtcgtagttgtgacggcggtggtggtggtgcttctcgtaacgttccttcttctcatcatcagactcatcgcgcttcgcgtaacggttcttcttctcatcatcagagtcgtcatcctgcttcttgcggccatagttccccccgccgtacccaccaccgtatgaaccctgggtctcc

SEQ ID NO: 5215 - DNA, 551 bp, Hordeum vulgare
gtacccccgggtctgcaggcaattcggcacgaggtgagcacgtcgtggtgcgtgaaattgctgatttgaaggaagatgaacagaagctgagcgccgaagccgagacttttaccccaatagaaacaagaagacacatctgccgtcttgccaatgctgtgcgtgtgctttcagccctgggattcactctgaccgtcgagctgataattcagaccgcggaagcgagcatatcatcaaatgttgagataaacgacatgcttggggctgaattttacgttcagacagcggagagagaggctaagcgtcgaggtgacctattgggaaagaagaggtaaatcctattggccctgcctgcctggcgtgctgtaaactgaaagtgccgacatgtacgagatatgtaaaaggaggtaatgccactcggtgcccctgtagcatacgattatgacattttggagcttgccccactctggtgtgtatgtgttttaggatggtattaagatagctattatttctgtcgatggagctttggcatataacatgttcttttgttgtgt

SEQ ID NO: 5216 - DNA, 484 bp, Hordeum vulgare
  UNSURE (27): n stands for any base
catcgacagaaataatagctatcttanataccatcctaaaacacatacacaccagagtggggcaagctccaaaatgtcataatcgtatgctacaggggcaccgagtggcattacctccttttacatatctcgtacatgtcggcactttcagtttacagcacgccaggcaggcagggccaataggatttacctcttctttcccaataggtcacctcgacgcttagcctctctctccgctgtctgaacgtaaaattcagccccaagcatgtcgtttatctcaacatttgatgatatgctcgcttccgcggtctgaattatcagctcgacggtcagagtgaatcccagggctgaaagcacacgcacagcattggcaagacggcagatgtgtcttcttgtttctattggggtaaaagtctcggcttcggcgctcagcttctgttcatcttccttcaaatcagcaatttcacgcaccacgacgtgctca

SEQ ID NO: 5217 - DNA, 517 bp, Hordeum vulgare
caagaggaaggcggcggagctggagaaggcggcggcggcggcggcggcggccgagaaggagaagcgggagagctcggtggtgacggagggccggggtggcagcacggaggtggagaaggaggagggcaaggcgaacaaaccaaatgctggcaatggtcttgatatggagaagtattcctggactcagcagttatcagaggttaatgtcaatgttcctgttcctgaaggaacaaagtcaaggtttgttgtctgtgagattaagaaggatcgtctgaaagttgggttgaagggccagcctcccatcattgatggtgagctttacaaaccagttaaagttgatgactgcttctggagcatagaggatgggaaagcactgtctatactgcttacaaagcacaatcaaatggagtggtggaaatctgtgatcaaaggtgaccctgaagttgacacccaaaaggtggaaccagagaatagcaagctttctgaactggatcctgagactaggcaaactgtggag

SEQ ID NO: 5218 - DNA, 554 bp, Hordeum vulgare
ggtaaacaggcttataaaggggatgcaggtagctagaaatcgcacaagtgaagtacaccaacatgagaactggacaactgattggttccaaccacagaaaacagagttcactaagccacaagacattgtgtccttgagaagtccatctctgggtgctgcaatggaaacctcaatcagacactaaaattcgtagcaataaccagacactaaaccacaagacactcaaactgaaaataactaggatagatgtgattcctccataaaaaactttctgcatttccttggatccagcacaccttaagccatcttcacatttgagaagtccatctctgggtgctgagacatgaacttcttgagcatgtcttgcttctgcatttcatcacttgttggcagacccatctgcttctgacgctgatcaaacatcatcttctccacagtttgcctagtctcaggatccagttcagaaagcttgctattctctggttccaccttttgggtgtcaacttcagggtcacctttgatcacagatttccaccactccatttgattgtgct

SEQ ID NO: 5219 - DNA, 553 bp, Hordeum vulgare
gtccccccgggcctgcaggcaattcggcacgaggacacgcctcatcttctcttcccggcagctccgagctgtatgtagcgagagtcgaccactgctagctgatacaacagcttgccgatcgataccatatatcgtagcctgcctgtgatcaagagatctccgggatcaacctcgaggcagaggcagaggcagaggtagagagggagggtagtcgacctgagatcagcagccaaccaaagatgtcggtgacttccaacacgccgacgagggccaactcgcgagtgaactactcgaacgagatccacgacctgtccacggtgcaggacggcgcccccagcctcgcccccagcatgtactaccaggagaagtcattcgccgacttcttccctccccacctcctcaagaaggtgatatcggagctggtggcgacgttcctgctggtgttcgtgacgtgcggggcggcgtccatctacggcgccgacgtgacgcgcgtctcgcagctgggccagtccgtcgtcgggggcctcatcgtcaccgtcatgatctacgccac

SEQ ID NO: 5220 - DNA, 501 bp, Hordeum vulgare
acctcagacgcagtacaaagcgaaagagataacacaaagtgcacatgcacgtaggcacatggagaaaatcacaaaaaatacaaacgtgttacaccagccatgtactcacgctatctacgtgcgtacccatggtatacacgtacacgaagctggctccatccagtacttcttcagttcctctagaacagagctcgctggtacatggtagacccgtacaaacatgtagatgcatggatcgtacatacttcgactggtacaaatgacttcccgcgcttgtacacgtgcgcacttacgtacgtacgcatgcaaatccaaatcaagagcatatatatagctggggtcgatcgggtgtagttgcaccagccggccgatcagacatggtcgaactcgtcgacggccatggaccgctggctctgcaggcggcggagcttgaaggaggagagcttctgtgggccgtccttgacggagggctcctcctcgaagcggatgtaggtgtagacc

SEQ ID NO: 5221 - DNA, 436 bp, Hordeum vulgare
atggttccctctccccgcgcacgaacatagctcccccccacgcagccatgggcaccaatttctcgcagaaccaccacctccagaacacccacttctcgctccccaggaagcaattcctggcctacgccctctacgccctcgtccccctcgcgctcctccattacctgctcttcaacccgctggccgcgcccacaccgccggtcctggcccagccgcaggtgcgagaggcggcgccgtccatcgtcccgccccagcgcggccgcgcgcccgtgaatgcgcttgaggagcagctgcccccgccccctcccgaccgagggggccaactgttggggaaaactcaaggcggagaagtgtcggcgcccgcgtcgccgccgtgcgactactcggacggcgagtgggtgccggacgcgcgcccgccgctctacaacgggacgag

SEQ ID NO: 5222 - DNA, 421 bp, Hordeum vulgare
tttttttttttttttttagcagcaatctctttctgaaagttacaacttacagattcgtcagaaaattaggcctcgtaggacctcgaagcaattcctactccctgcatactccaaatcttctctccagactggaaccagtgatgctctcatcacgacctatctcgtgtcctaatcgtccggtcgacgagcaaaagaatcatcgatgcacacgcacgcacgcacgcacaccaggccaaagttcacggttcctagatcagagacacaactcagcgcgcgatcagaattcagagaggtcaccaactcagctcacgatcatggccgcggtcaccccgcgatggtctgcagcaggatctcgttgaacgtgtcgatcgggccgggcatgcaccagtgcacgcagtcgttctgcacccgcgcgtcgggg

SEQ ID NO: 5223 - DNA, 525 bp, Hordeum vulgare
ggcgcaagtcagggtctagagttgttcctacaacggggacggtgactcggaagagagcaccgaggttgaggatgatgggcctgaggagtttcagtcagacaactctgatgagcttcagttagttcacaaagatgaagacctgtccaagatcaggatgcagctagttcagatagagaatcagcagacaaacctgctcgaccttctccagaaatttatggggagctcccagaatgggatacgttcgttggagacaagggtgaacggtctggaaatggcactggacgagatctcgcgtgatctggccgcctcctcaggacggatgccgagcagcgaacctgacatgaactgctgcatcccgagcccaaaattctggagaaaaaatgatggtggtagatacatttcaaggtaccccgtgtccgacctagcaaaccactctgaggaggtcagagcttctcataagtgggagaggcagaagtttggagttcagggtgggttcgtcaccaacccattagcagagtctccgaa

SEQ ID NO: 5224 - DNA, 540 bp, Hordeum vulgare
gtatccaacttgtacaggagtgcaagtgcaagatacatgcatacaccaggaccttaatattcgcatgctaaagcaagaactgcagtcagggccggaggtatgttacaaacagcgcccaccacgcagtgagggtccttcttgctttagagtctcacaggctccgttccacagaaatctgaatcgtcgaaccaactcgcaaaagaaaactccataaattcatttacaaactcagcttcgaattctggagaaaagaagaaaaaggcctcctagaatgcggtgaagtgacatgtttcagatgctccctcccgcctcagtagatgcaggtggttcaggattcagatggagcatccttgtcgcccctaacgcgtcctcgacttgtattgggctgaattctgcctcctgccttcctgagcaaccaacgtgctccttacgtatgaagtgttcggagactctgctaatgggttggtgacgaacccaccctgaactccaaacttctgcctctcccacttatgagaagctctgacctcctcagagtggttt

SEQ ID NO: 5225 - DNA, 398 bp, Hordeum vulgare
tggcagaatcccgcagattccttgaatccggggagcgcgagcaaccacgccatggccgcggcgatcctccgccgcctcagcccggcggccgcccagcgcgcgccccctcggctcctgccgctggtccgcggggtctccgactccacggagccgctcaccgtggagacctcgatccccttcacgtcccacatcgtggacccgccgtcgcgcgaggtgaccaccacgccgcgggagctggcggccgccttccgcgacatggcgctgatgcggcgggccgagatcgccgccgactcgctctacaaggcgaagctcatccggggcttctgccacctgtacgacggccaggaggcggtcgccgtgggcatggaggccgccatcacccgccgcgacgccatcat

SEQ ID NO: 5226 - DNA, 415 bp, Hordeum vulgare
ttttttttttttttttgatggaatgccttgagcagacaacaccaaaaattaagctgcatagcccaattgaggtccacaataaattgggaaatgactagcgcaatgaggtacaaagtctgaatgttcatgcgtctctctatatacagactaaatgtctctatattatacagacttatttatggatagaaacgtccacaatacagcaattaaggattccttggactctattttgtctccccagcacgtatcataccagcataacagtctgacagagcaaagcttctcgtttggcagcctatggaagaacggttctcaccaccttcctgtccaccccgaaagactccagaccgcagtcattgacatatacattcttgaacagctcggacgtatcaggcattgggctttcctttgcttt

SEQ ID NO: 5227 - DNA, 1190 bp, Hordeum vulgare
  UNSURE (1)..(6),(17)..(19),(22)..(25),(27)..(29),(31),(32),(35),(36),(39)..(41),(44),(49),(51)..(53),(60),(63)..(65),(77)..(81),(83),(84),(87)..(89),(91),(100),(101),(106)..(109),(112),(126),(127),(130),(191)..(193),(961): n stands for any base
nnnnnnttggccaaaannntgnnnncnnnanntgnnggnnncancgatncnnntgttgcnccnnntgcaacaaccannnnngnnccnnntnttttttgtnngggcnnnnccnaaaaaacccccgcnnctnaaaaaaacccctacagaggccgcctttttttccagggggggggccccccacccaacaaaannnaaacaccaccccccctctttcccccctcccccccccctacctccccctcacactcctcacctaccccccctcccccccgggggggggggggtctcacactctttttttttcttccatccccacctctcccccccccccccctcctcccccttccccacccaactatcacaccccacaccaccccaccaacccccaccttcacaacctcaactacaacccccccttccacaccaacccccatcccatccccaccaaatcaccctcccacacccaccccccccacccccccccaacccaccccccccccccccattccccaaaattataccccaaccaatataattaccacccccctctactccccccccccatatcccaccacttttcatccccatttccatttcaccatatccacaccacaaattccccctccccactcaccatctcccccattacaacactacaatccccacaccctaacctaccttcccatattccccccccctccccttttccttcacactcaacccaatactccccccattcccactatatccacatatatacccgccaccaccagcactcatacatactccctccccccatattgccttcaatatcatactatacgacacatccaccacctttttccctctcatattattctcccccctccccccccacccactgcacacactttcctaactctccacccacaacctcatatattatatctacaccaccttacttcaccccccacaaccactncactatttaattctttccccaccttatcatatatatacaccccaccaacacaataaataaatctcacaatttacgccctcctattaatatccctttcaaatatatcatttatcccaccattacactctccccctccttttatcccccacttcccccccgctaaattccccccacatctctcccactcccctccgcaccatcccattgtctctacacacccacccccatt

SEQ ID NO: 5228 - DNA, 550 bp, Hordeum vulgare
tgtggagcatcggacctagaaaagctagaatacgttattacgacgtccacttaacccactccaactcaacatcttattaaacattcacaatgcggagactgtcgctccgctctgggaggtttgttctccactctcaaaactgcaaggaacaagaagaaaatttcaaagagatgcactctacatccgctctctatatctcggcgccgagctccaacatcaaggtgtggttcgaggcgtcgcttccagggccgctgaactggatgggaccggggctgatgtatcggttcttgatggcccattcatcccgcatcgaggcaaacttcttaaatggcgcagcatcaagctcaaccatagccttcttgatcactggcttgaacttgccatgcctcctctcaacatccatcaacgcagtcagagcagttcctccaacagtccattgttccacaggagcagccaggttaccaaccgacgagataagtcctgtcttgccaaactggagaagagcaccagcaccatagcctaatgcatagcaatagctggaatcaaaatt

SEQ ID NO: 5229 - DNA, 542 bp, Hordeum vulgare
gggctgcagcaattctgcacgagggggggacaactcccgtcttagcagcccaatggcggcggccaccatgtccctttcctccccggcctttgccggcaaggcggtgaagaatgtgtcgttgtcggccctcttcggcgaggcacgcgtcaccatgcgcaagactacggcaaaggcaaagcaagttgcttcgagcagcccgtggtacggtgccgatcgcgtgctctacctcggcccactatcaggtgagccgccgagctatttgaccggtgagttccccggtgactatgggtgggacaccgctggactctcagctgaccctgagaccttcgcaaagaaccgcgagctggaggtgatccattgtcgatgggccatgcttggtgccctcggatgtgtcttccctgagttgctcgcccgcaatggcgttaagtttggcgaggctgtttggttcaaggccggctcccaaatcttcagcgagggcggcctcgactatctcggcaaccctagtctcgtccacgcgcaaagcattctggccatttgggctt

SEQ ID NO: 5230 - DNA, 500 bp, Hordeum vulgare
ggtagaatgcaaccacaacaagtagctaaaatacaggacatgagagtgaatgttggcaaatcaaacaatgattttgcactgattcttgtaatttacatgatggtagtacatagcagaccatcctgccagctctcaactcagccctagaaggtgtcttacttgccgggcacgaagttggtggcaaatgcccatgcattgttgttgacgggatcagtgatatggtcagcgaggttctctagcgggcctttgccggtgacgatggcctgcacaaagaagccaaacatggagaacatggcaaggcggccgttcttgatctccttcaccttgagctccgcgaacgcctcagggtcgtcggctaggccgagtgggtcaaagctgcctccaggataaagtgggtcaacgatctcgccgagtgggccaccggcaatgcggtacccctcgacggcgcccatgagcacaacttggcaagcccaaatggccagaatgctttgcgcgtggac

SEQ ID NO: 5231 - DNA, 554 bp, Hordeum vulgare
ggggctgcagggaattcggcacgagggctgagagcactgctgacaaggttgaatgggtaaataagataaaagctgtaattcaaagtaaaggtggttctttcaaggctgcaaattctgagggtggtccgctgaagcaaaaccagccagatagctccacagatgcaatgatacggagaccagctgatcctgaagaagaacttagatggatgtctcaagaagttcgtggttatgttgaggctgttctaaatagtctagcagcaaatgtcccgaaggctattgtgctctgccaagtggagaaagcaaaggaggatatgttgaaccagctatacagctcgataagcgggcaaagcaatgcaaaaatcgaagagcttctccaagaagatcacaatgctaaacgtagaagggaaaagtaccagaagcaatcatctctgttgtcaaagctcacacgccaacttagtatccatgacaatcgagctgctgcttcctcttattcaaatgacagtccggaagctgagagccctcggacacccggccgcccaggtgaggactggagg

SEQ ID NO: 5232 - DNA, 551 bp, Hordeum vulgare
gcacccaaaaaacacttataccaacatcaggcgtcaaaataaaagatggatcatgaaccaatagagagaattgattcaactatatatttctataaacaactctggtcgcctgcgcatgcatacacactgtcgatgaaacctctcgaccaggcgctcgctctattcatccaatctcaaatccgctccaccaatctcaccacccaattatcagaaacagagcgtgtgcctagcaagaatacataataataaatcatggatactaatcagcacgactagtatctcggtggcgctggcggcaaccgatttggcgtgcgtcggctgctggagttgggatccccattttcagagcgcccgcgactatcggcacttctcgaccttgattcgatgttcggggctgggccatttgctgcagaatcgaaggctgacctccagtcctcacctgggcggccgggtgtccgagggctctcagcttccggactgtcatttgaataagaggaagcagcagctcgattgtcatggatactaagttggcgtgtgagctttgacaacag

SEQ ID NO: 5233 - DNA, 401 bp, Hordeum vulgare
gtcaagccatctcacactaagcctctccctcaccccatcagagaacctaagggacaactcccgtcttagcagcccaatggcggcggccaccatgtccctttcctccccggcctttgccggcaaggcggtgaagaatgtgtcgttgtcggccctcttcggcgaggcacgcgtcaccatgcgcaagactacggcaaaggcaaagcaagttgcttcgagcagcccgtggtacggtgccgatcgcgtgctctacctcggcccactatcaggtgagccgccgagctatttgaccggtgagttccccggtgactatgggtgggacaccgctggactctcagctgaccctgagaccctcgcaaagaaccgcgagctggaggtgatccattgtcgatgggccatgcttg

SEQ ID NO: 5234 - DNA, 403 bp, Hordeum vulgare
ttttttttttttttttggcaaatcaaacaatgattttgcactgattcttgtaatttacatgatggtagtacatagcagaccatcctgccagctctcaactcagccctagaaggtgtcttacttgccgggcacgaagttggtggcaaatgcccatgcattgttgttgacgggatcagtgatatggtcagcgaggttctctagcgggcctttgccggtgacgatggcctgcacaaagaagccaaacatggagaacatggcaaggcggccgttcttgatctccttcaccttgagctccgcgaacgcctcagggtcgtcggctaggccgagtgggtcaaagctgcctccaggataaagtgggtcaacgatctcgccgagtgggccaccggcaatgcggtacccctcg

SEQ ID NO: 5235 - DNA, 517 bp, Hordeum vulgare
  UNSURE (18): n stands for any base
ggaaagatgatcacactngatccgcaaagtgaagttaatgttgttggtatgaatggtgccaaccaagactcagctgaaaccgaagcgatgctgattgatggtgtccccaaaggatcttcaagtgacttgcctgctgctttacgatcgaccgattcaaatcagctggcagaacaagatgggttagagaatagtgcctctatatctgcttctccgaaagaacatgagaaattaaaagaaacttctgatgaaattggtggtggcaattccagtcgtaggcggactgatgatgattctcattttatgaatttagttggttattcggaagactcagatgaggacgattctgtccaggtagctgatgttggtgatgtgggatgtaaagaaactactcctgatggcatctcagctgtcgctagagaagcagaaccaggagatggaccctgcacagagcctacttgtgaaactgctgttcatgtgaacgaatgcagtgcggaagctgctatttctgaggatggtc

SEQ ID NO: 5236 - DNA, 542 bp, Hordeum vulgare
gcatcaaacagctcctctaaaacaacgggtttcataattatgttctacatacaacatttgcataaagtctacagtacttagtttcattctctcctcttggtggcaaaatggctgatcccaaccatgctctgtctgatctaacggcagcggccaacatctgcttccatttatgcacactaactactttccatcattaggctgcgagtcgctaggagcctccaacccctcaaggttggcaggctcgccagcggcaacggacttaccctcctccggcaaaggtggcgattgcgccatacctggctcgttcggccttgcgttcttatcatcaggagcagcttcagtgttgagcacctcctctcccacgacagcaggagactcatcagctcccacgtctgaagttccatccgttttcgctcccacgtctgaagttccatccgttttcgctcccactgtgctgggaagctcttctgtgactgtcgtagcctcacatgatgaaggttgctgcaacagctgttcagcttcggcttctccaagcttagcat

SEQ ID NO: 5237 - DNA, 518 bp, Hordeum vulgare
cctaccttctccgacctgggcaagaagcgcggcgagaagaggtcggcaccgccgccgccaccgccggctgcctcatctgaggagacccgctcgggcgcacacgagtctgaggacgaagagaccatcgccatctctcgtacccctgcccccaagaacccgcctccgccgccgcagaaggggaaggagtccgaggcctctgacgaggatgaagaggaggaggaggaggagccatcccacgcggccccgaccactgcccccaagaaggaccctccggcggcgcgacagagcgaggactccgacaattccaacgacgacgaggatgggggttccggatctgacaaagatgcgccgccgccgaagccatctgtgaagcaggaggcgaagggcccggaggccaaggtgccgcgcctggctttccaccgcgtctggtccaccaacgatgaggtccgtatcctcaaggccctcgccgctcaccagaaggagcacggcgtgctgccgcagcccgacgccctggtcga

SEQ ID NO: 5238 - DNA, 528 bp, Hordeum vulgare
caaaaaaaacccggtgatccataacaattcgatttcagactcacggctccagtctgtacctctgaaatactcaaaagcgcacctaatccactcccaaagtctgaagcactcaaaagaccaagaacatcctgtacaaacaagctatgaatctttactgaactaccgcattaagctaggatctcttaacctcacactattcgatggaatcagtgatctctcttgccgcaaaaacattcttaccaccaacactccaaagtttgccgaatctaggaccctagcgttgttaatcatcgatacggtttcaggtaagctcatctgactcgcatcagtcgatcaggtccatcaccgcctttgtcacctccctggcaaggtcgctgcggtgcagctccaccttcatctgggccaccctctgcttcttgatcttctcgtccagcaagcgtgccttgtcgtcgtccatctttccaaactcccgcttgaacatgcccgggccccccagcttcctcacctcctccgcgaggtacgggtaca

SEQ ID NO: 5239 - DNA, 536 bp, Hordeum vulgare
  UNSURE (28): n stands for any base
ggcaattcggcacgagggccgcactagngcccattactctaaaaagaacagttgctgggttatattgaggatcagtcaagcccgttagatctgggcagttgggacttccatgtcctttggttaaaagacacatcccttggtgaaaggacaattaagatgtctcagtttgtaactttaaaatattaagacactccccagaaaactaatgtaccaaaatttaacatttcagttggtttattcacttaaataacatttggattttataactcgatgcttaaacatgaaaattttatatattaattcaaaataaactcactaaaacatttagtaagaccggcagcaaagtgcgggctttacagcagtatacgtctgagttttatgcctttattgacaattcggctgttcactctaggctgtgtcgatggatatctgaaatgcatggagtatgaaaggattccttcaaaaattcttgtatatcaagcttctgatgatcctctatatagtgggtacagggcagctgtcgaggcatcagcaca

SEQ ID NO: 5240 - DNA, 541 bp, Hordeum vulgare
tacatgatatttacagagtgcttaaaacagtaacttagaaatacaaggatcaacaatgttaccatagttgatagctttagtaacggcaaacaggagctccattagcggtgcacccagtaatcttctcattgcacacacacgggtttagtattatacacatgtcatcgtccaaaattattaaacaaactggaccacaaaagtgagttacaagatttccaggtggaaggaccttgcagggtcatcgtcgacgtcaactcttcagcccaacagatctgcatattttagcgagaaccccgccatcatccactctaactgtaacaggctcctccacagggtccttgaaattagccttctcactcagctcctcgaatgcgttaacaacgttctgtagccgggcaacaaactcgattaggagcgaggcaaatgttgccaaggacaaggcacttgcactttcatatgtttttgactcctcgtcttcaagcggtaagtttggatggaacgatcttcgagcaggccatgataatagcgtcttgtagccgtc

SEQ ID NO: 5241 - DNA, 414 bp, Hordeum vulgare
  UNSURE (3),(11): n stands for any base
ggnctgcaggnaattcggcacgaggcagcacagagcttggacaatcagatactgatatacagcaccaaggaaaggtttcaacttaataagaagaagaggtttgcaggccacattgtggcaggttatgcttgtcaggtgagcttctctcctgatgggaggtttgtgatgtcaggggatggtgaaggtagttgctggttctgggactggaaaagctgcaggagattcaagacattgaagtgccacaacggagtttgcattggatgtgagtggcatccattggagactagcaaggttgcaacatgtggatgggatggcgtcataaaatactgggattaaaactttggccatttagacagaaacgttcctcgagatgctgcaagcccacatgccaatgaattcacaaggattcaactt

SEQ ID NO: 5242 - DNA, 550 bp, Hordeum vulgare
  UNSURE (16): n stands for any base
ggactgctttctctanacaacacctttgtgattgtttctctgactcacagtacaacaatgaaaagctcgaatatccaatagaactactgctacctaagcagagttgggcactccacaactcatataatgtacagagattgcactttggtctatcacaagcatcctcactctcgagtgtacagactagcagaatctgcagctgattgggcgcttcaagtgggtccccaacggaggcgattccagagaaaaggacccggcataccgcggacgaccggcgggctctgcattatcaaacctacgcagacgcagacagcggcaatggcgaccaaggatagcaccgcaggcctgttcgacaagaacctgtttgggcagggccggtaggcaatgtgctggagctggacacattgtctgcatcccggtaggcttttctcgacatcaaatatggtctgatcagttgatttcggacgacctgcatctgcatgctcttcggtgataccagtggtggtcatggaaacagacacatgggctgcaggtaaccccctgttaattt

SEQ ID NO: 5243 - DNA, 508 bp, Hordeum vulgare
catcccaattcgaaatcttccctcccgatccccatcctataaacctcctccgccccccgctccattcccccacaccagaaccaccgccagtcccatctcccaattccccacgcgcaaatccttccccgcatcgaggccagcgccgccgccggagcttcgaagatgcctgccgccctttcgatggtgcccgcctgcgacgcggaggagccgctcctggcggagtcgtcggaccgcttctccatgttccccatccggttcccgcagatctgggagttctacaagaaggcggtggcctccttctggaccgccgaggaggtggacctctcctccgacgcgcgccactgggacacgactctctccaacgacgagcgccacttcatctcccatgtgctcgccttcttcgccgcctccgacggcatcgtgctcgagaacctcgcctccaggttcatgtctgacgtgcaggtcgccgaggccagggctttctacggcttccagatcgccatagaga

SEQ ID NO: 5244 - DNA, 547 bp, Hordeum vulgare
gatgtttatttattttacgaagtaatagctttgattcattacaatacatcagtacatcaccaacaagaaccagcgaaataacagaaaataaaaacattgtggagcacccgtcacatgtatcactgctactattactatgactacggagcaaccagacgcggccagcgagccattggtaatggagactgcatatcatcagagtgactgatcagaagtcctcgtcgatgctgaagacgtgctgggtcgcggcgccgccgttgaggttggacatgacggacgccttctggtactcgccgacgcgcttctcgaagaagttggtcttgccctgcagcgagatgagctccatccagtcgaacgggttggtggcgttgtacagcttgttgcagcccagcgccatgagcaggcggtctgccacgaactcgatgtactggctcatgaggtcgccgttcatgccgacgagcgcgcaggggagcgcgtcgcagacgaactccctctcaatgtccacggcctcggagacgatctcgaagacgcgggactcgtccagctt

SEQ ID NO: 5245 - DNA, 524 bp, Hordeum vulgare
ctcctgtgcgtgctccttccgatcaccggcgcggccgcgatggcggggcgggcgccgaggacgtacgtggtcggtgatgacaaaggctgggctcgcgacctcaactcgtggtggccaaacggaaagaccttctacgccggcgacgtgctcgtgttcaagtacgacaaggagctccacgacgtgacggtgctgggaggcaaggggtaccggcggtgcgaggtgccgaggcacagcagcaagagctgggtgatgcgcaccgggaacgaccaggtcacgctgcgcaggggcaacaactacttcatctgcggcctgccgggccactgcgacaagaacatgaagctcgccgtcaaggcctggtagacccatccatccggccgcatctaatgcacgtaaggcgtacatcatcatcaatcgatgcttgcagtgcatgcttcgcttggccgtcaataactgttcaagccttgctgggttctcgagttaatttatctgcgtcttgagtcgtggttctcacttgtattaggagc

SEQ ID NO: 5246 - DNA, 431 bp, Hordeum vulgare
tatgtccggtaaattgatcaagcgcttagctttcacagtaataacatctgagaaaacatcaagtttacactcaattaagaaacacacgatcggcgataaattaggctcctaatacaagtgagaaccacgactcaagacgcagataaattaactcgagaacccagcaaggcttgaacagttattgacggccaagcgaagcatgcactgcaagcatcgattgatgatgatgtacgccttacgtgcattagatgcggccggatggatgggtctaccaggccttgacggcgagcttcatgttcttgtcgcagtggcccggcaggccgcagatgaagtagttgttgcccctgcgcagcgtgacctggtcgttcccggtgcgcatcacccagctcttgctgctgtgcctcggcacctcgcaccgccggtaccccttg

SEQ ID NO: 5247 - DNA, 516 bp, Hordeum vulgare
tgcttgaggaagatgtattgactttagtgaattcaatctacgaaataatgttgctcaagtattagtttttgagcttaacggaacccaaaaatttgtactcgggaatatccatgttttgtttaatccaaagcgtggagatgtaaaaatgggacagatccgcatgctactggagagggcgaatgctcttgctggaaaatgggatggaattcctattgtgcttgctggtgattttaacagcacacctgaaagtgccatctataagttcttgtcgacaatgaagctgaacgtttctttgcatgatagaaggcagttgtctggactggatagctctgaattttgtttgtattgtagtttactgaactttgaatggagtgacgaagaagtgagaaatgcgacagggtcctcaaatgtcatggtcgctagacatccgttgaagctttctagctcttatgctatgttgaagggaaattcaagcaataggggtcatcatggtgaacctctagcaacgtcatatca

SEQ ID NO: 5248 - DNA, 525 bp, Hordeum vulgare
  UNSURE (2),(28): n stands for any base
tncggcatgtccatactgcacgttaaanattacgacagcgtgtcaatattctgcgcaaaagtggagaataaatacactttgagtactagtaaatgctaaactgccaatactaattatttttctttccttgtccttaacctacttgtttgtatagctcgtggagaacactcgttcggccacaatcttggcacttgagtctggagacatcagcttcctacacctgattctgatccgtatcagcatcctgaagcagcaggactggaatccactacaggaattacaacactacaggttctggcaacacaccttgcacattcattcaaggatatggcgtgagccttacaatggccaagataatttctgcatctgaatcatgaatggtatggtcaccgccatgaagttcgtacagcgcccctgtcctccaagtcatatatcctaaacttttcctaccaactgaataactaacttgcatcagccgaactgtcactgtctgaggagaaatatatgtgttttgctgtggttgct

SEQ ID NO: 5249 - DNA, 130 bp, Hordeum vulgare
gaccccccgggactgcagggaattcggcacgagggagagagaactagtctcgtgtttttttttttttttttttttttttttttttttttttttttttttttttttttttttttttttttttttttttttt

SEQ ID NO: 5250 - DNA, 543 bp, Hordeum vulgare
  UNSURE (14),(15),(26),(27): n stands for any base
tgcaaggtaacaanngctaaaaaccnnctgcaccgaataaggggcggtaggcgccataagtacagactcaaacataaccaatttacatcaccttctaaggttggggtaaggtatcactgccactttgccagttcaagagccacttctcaaaacttcctctgtacacggacccactaatagatcatatatggtggttcaaacttacagcggctacagaatgcgccctatcatattatttgtgggtcatcataaccgagttgattacgtgcatcattaggcggatgttgctcgcttccagtgggctggttcctggtaccgactgttggcgggccaagacaccatagacttgctcaaatattggcctcacatgcgctgagatcatctgatgggttggttggattgccatggcgaccgctgtcatccattgaagcttcaggggtgtgtcgttgcctatgtcgcatgccagttgctggaaaagggccagaaggaccccttggttcagaggaacagggttcagtctacataatccttgcaaatcaacct

SEQ ID NO: 5251 - DNA, 546 bp, Hordeum vulgare
  UNSURE (16): n stands for any base
gtcccccggctgcagnaattcgcacgaggtttgggtaaccttggcctacctcactcagtctattgggttagttacagctgatgctggccgtgcatctttcatatccgccctcacagtgatcattgtccctttcttggatggtattcttggagcagaaatacctgcatatacgtggcttggagcatttttatcagttcttggggttggtattctggaattaagtggttctccaccatgtgttggtgatcttctgaccctccttagtgccttttgttttggaattcacatgctcagaaccgagcatatttccaggaaaatgaagaaagaaaatttcctagcccttgttggatgtcaggtggttgttgtagctgttgtgtcggcagtctcgttcattgttaaatgcttcctccagactgtggtaccctggaatttaaaaccacatacaccaacagagttattcagtatgatgtcatcttttccttggctagcaatactctacacaggcataattgcaacaaccttttgtttatgggcagagattgttgc

SEQ ID NO: 5252 - DNA, 548 bp, Hordeum vulgare
gttgcatgaaaataacgtactaaaacaaaggtcaatacagaatcagcatgaggtaacctattacatactacatcatgtggactgatttacatcgagagaaaacgggatttagaatgtaattggtactaaatcaggctaccctaggcgtttagtcgagtgatacgcatccccactttctgtagctgtgttctccacgtgacgacgcaccacagtttgttttcatcagttgcccaggccactagtgagccacccctattgttgtcagcctagtgaactttcctttccttgtgcaactggccataattgtagttagatcttgttgcagtgtcatgctagctacttggcatattacatcgcagtagtgatcatatgttatcatatgaaatcctcgtatttttgcgatttatgtatcagctgttcatctggtaactgtcctctgatacatcaatatcaagaaatgaccccagtacctgaaccatcaagctaccggctatgatgaagatagctccaataagtccagtaatgccccatctctcaccatgaattgc

SEQ ID NO: 5253 - DNA, 418 bp, Hordeum vulgare
aattctacagatgcaagcattgttgaggccggaagtacttagctacctttgatttacttgtctgagcagcaaatctgttcatcactttgggtacaagctcaaacttgcaacctccgctagcgactgatgtatgggtaatgccttcccatggcagatgcaagcttagatagcaactgagagcttgagacctgcgatcttggtcagagagcaatcacatggaaaacgacgggcagtacgatcacaccattgatgtgctgagtgccgggagtggatcagggaatcatttgagtgaaggcaacaaggatgagttaggcatgggtgctaacaacatcaggcaagatttattagccagtagcagtggatccagcgctcctgagtttgagctcctgtggagattgcggaagtatttagtaatgct

SEQ ID NO: 5254 - DNA, 315 bp, Hordeum vulgare
ttttttttttttttaaacgaaaataatctgcattgcatgcctgtagttccattacagtgccgactatatgaacacctaacagatatgcagttgatcgctcaagtccaaattttaattatgctaggataatgtccaagaatataaaaaagtgctagctttcaagttaatctggattttttgaaggaaaagaaggctgattacaaggcaccaattattttgcaggtaatacacgaaacagattcttgactcgtcccgtggaaatggggccttcacacccttggtccagctaccggcgagtttgttctggaagcattt

SEQ ID NO: 5255 - DNA, 475 bp, Hordeum vulgare
tacgcccacgaagtcaccgccatcgccgctgcccacgctgggcgcttccgacgacctacggcggccctaggtacacaagtttggtcaattgatgcagagaaatttatatgttgtggggatgaaggagcaggatctgttgtacaattagagtctgcagtttgctttccaggagtaggagatggatctctgttcctgtgttttggggaaaagacaattctgaatttggcaacaaaagtatggagttctctggatcatcaggatcattgatatacacacctgaaactcaaagcgagatagcgacagttatttagggggttttgcttggtctttttctacttcccttgctgtacacaaactaaatctcttttggatgtacagcaagcaatcagtgaatttgcaactggatagcatgaggaagttaatggacctagattttgagtggtatttacccggtgagcatcccttcaaagtattg

SEQ ID NO: 5256 - DNA, 540 bp, Hordeum vulgare
gcatgtttaaacacgcatattcagaaatctgagaagtttgagtgaagcctcattttccaagagagcaaatatctagaacgctctctaattacttatacaatacagtgcatatcatgtaactgcacctgcataagtatataggcacccaatcatgccccctggccaataaaattacaacgttaatatggcacctagcgcttaatcctcttttataaccctgaacctctattatattctcacgtgatgaaatttgtttcaaaattaccagattatgcagtagtagagaagccatccctgacaacatggatgaaaggaggtcttgattacattctacttagaagtatagacactgatggaattcggatcatttcaagtgttcttggtcaaagtatcgctcttgatcattacatacagcaggtattgtgattaagcaaagtcatcaaactatttccatgtggttgcaaggtttaaagtttttaaggatgctcatgtacacgacacgagccagtatgtttgtcaagagcccgggtgtgggaaagg

SEQ ID NO: 5257 - DNA, 379 bp, Hordeum vulgare
agggtgagtgggcgagtatgatgctgtggtgaccccagggtccaggggaccgtataggaaggcaagcgtgcattgtaatcgacagctatcgagaggggggcgttgtggaggcagagctccttgcaggccgtaatctgtgtcgagcgtttcagcatctgcatgcgtgccgtgagccttttcagctactctatatacgatctctatttaagtgaaatacaccggtgccatactatcgtgttcgataaagctctgagaattcgttgcaaaaacaaaaaaaatactatcgtgttcgccatttgtacgtgggcctacgtttagccggtctatcgcgtgaacatgatgttcttcgtggttggatttgaatttggcccactgcacg

SEQ ID NO: 5258 - DNA, 533 bp, Hordeum vulgare
tggtttttattgggctggaaatatgaagaaaagaaaaacgcacatagcccagcccaatagtcaaacagacaaaggacagacaaaaaaatcaacgcacatggggctgccctgtacgagaacagccttgcatcctgtcacgcgaaagaaatgtttcgcacgaatcttaaaacacatatctaatggttacaacggtgaatgagactataagtaaaactcagctagctgagttgtagcaaatccgaatgttccttccgtctgctcaactgcttcgtcttccagatggtacccatccccgcgcacttgctcagaagaaatcaagtcgtcttggacaccagcagttctactcgtctcatcatcaatcaactgctcgctggcaactccatctcttaatgcaaaccctgcatccgattcctcgtagaagaactccatggcatccatcacgaaagccctctactccggcatgctacagctggggtcgacgggccgaacacacgtaccctgtgcactgcctaacctcgtaatggtcaccatag

SEQ ID NO: 5259 - DNA, 481 bp, Hordeum vulgare
  UNSURE (2): n stands for any base
tncagcctgccatggtaccgctgcctagaagagaacacctcactttgccaaaattgtgactggaatgggcatagtgctggatcctccgctgctggacacaaaagacagaatataaactgctattcggggtgcccatcatctgcagagctttcaagaatgtggtcattcattttggatattcctaatgtagctcctgagctgaattgtgagcaagtaataagcatgatgagcatcagtgacagtgctgtcagtaatggagacaatgctcaaggggacaacagtttggtagatatggcttgtgcaacacttgatgaagaagacaagcaaaagtctgtgatcggctcatcttccgaagctggtctgaaccttcttccacctactaatgatcagacagctgtatctgtggattcgacgacacctaagtatacgccagacaagcatatgttcagcaaggatagcatatatgaagatttctctatgg

SEQ ID NO: 5260 - DNA, 555 bp, Hordeum vulgare
  UNSURE (36),(37): n stands for any base
ttacaactacagcctcttttgtctaagagagcacannatctggaagcatacccgccgaaaacaccacagcaagggtaggtggatgccacatagtcagtacaagcaagaaagagagaaacgctggaagtccatctagttgtcttgtcttcattcaccaaaactggagagcgactcgtgtcgctcccccaaaagcaacagaagacgcgtcgctcccccaaaagcaacagaagacgcgtattccatccgctgtacagaagaaacaggaggaacagcgtcgaaaacttgcacaactttcaaatcttttggtctcgctggttgctttccattctttcctttccagaggtgggtatgccatgattgcttcagcatctgatttatcgatttaccccagctgcaataggcactggtttaggattgctaatctaagcacagtggttttctgcattcagtagctccttgtgtcgagcggatcatagtcatacgcttcgccggccttaacaaaccggcccttaactctcttcctcacatccgccctagccttgcgagattcatatc

SEQ ID NO: 5261 - DNA, 391 bp, Hordeum vulgare
ggaattcggcacgaggtctccctcttatccctccgccgttccaaatcgttcttcgtccggcccctcctttttttcttttttctcttttcctgagagaaagaagaaaaaaaaaagttcctacgcgggcttgggcctgccggagcgagcttcgggccgctgccaaccgccgcctgggggtgtcccggcgccggctggatctgacgagctgcggtttgcttccttccttcaaggtttcttgcaaatttgggtcatcttgaaagctcgtgaagaaggggttgttggtcaagtaaaagatattggagctggcttaaagcgttgtccattaaaacaatcatgggtgctctctgcgattactggggggagcataggtccatggtttactgccgatccg

SEQ ID NO: 5262 - DNA, 464 bp, Hordeum vulgare
aactttacaacaccggcttatttccgatctggtatttacacatgcatattgcaaacaaaactccggattgcagtagaattcacataaaaatataacacagcagggtacttcacaactacagccatcttttgtctaagagagcacaatctggaagcataccgccgaaaacaccacagcaagggtaggtggatgccacatagtcagtacaagcaagaaagagagaaacgctggaagtccatctagttgtcttgtcttcattcaccaaaactggagagcgactcgagtcgctcccccaaaagcaacagaagacgcgtattccatccgctgtacagaagaaacaggaggaacagcgtcgaaaacttgcacaactttcaaatcttttcgtctcgctggttgctttccattctttcctttccagaggtgggtatgccatgattgcttcagcatctgatttatcgatttac

SEQ ID NO: 5263 - DNA, 542 bp, Hordeum vulgare
gggactgcaggcaattcggcacgaggcgctcgcccttatccccgtccctttccccttcctcctcccaccagcagccgacgaaactttcccccaagcccctctccctccccctcggcggatcggaccgccgccgcgctcaatccatgtcggaggaatctggtcgccctttgcccaagtttggcgaatgggacgtcaacgacccagcttctgctgatggattcacagttatattcaacaaagccagggatgagaaaaaggctgggaatggacaagatactgaatccccttgcaaagacgccaggactgagagggtggaatcttatgccaccaaggcaaattcaaagaagtggttttgctgcgtgacgccaagtcctacacaatcttgaggaggacaagctgccaccccagaagaagaatggttgggaaagtatggtcgtttaattttgctatatacatactatccataagaccttgtaagaggtacccaggctccctgtgccatcgccatgggtatctcgtaaaactctgaagtgtttgtatgt

SEQ ID NO: 5264 - DNA, 540 bp, Hordeum vulgare
tgtgatacactaatgggcctacccaggtgggcattggaattttggatgtttgcagttcaggcaatacgcgagactcaaatcatatatcaacttcaccaccactacgactacacaaaaggagacccacaaggaagaccagaattacaatcagaagttcacttatccaaacgagtgtctggcaaccctcacaccatacatacaaacacttcagagttttacgagatacccatggcgatggcacagggagcctgggtacctcttacaaggtcttatggatagtatgtatatagcaaaattaaacgaccatactttcccaaccattcttcttctggggtggcagcttgtcctcctcaagattgtgtaggacttggcgtcacgcagcaaaaccacttctttgaatttgccttggtggcataagattccaccctctcagtcctggcgtctttgcaaggggattcagtatcttgtccattcccagcctttttctcatccctggctttgttgaatataactgtgaatccatcagcagaagctgggtcg

SEQ ID NO: 5265 - DNA, 316 bp, Hordeum vulgare
  UNSURE (225): n stands for any base
ggcgccttctcgagctttcgcaccgcctaattcccaaacccggcgccgccgtgtcaccccttccccggcgccgccggtcgcgcccccaggcctaaagcgcgccacgtcgaattcttctcccccttccgcccccctctgcccgattggcctggcgtggagatccacccccgcggattttctcttcttggcccgagacatgtctcactatcaggaggacaatgttgnggacatggaggatgattacgacatggacgacccggtggatgacatggatggtgaagatttcctagggcccgaggctagggacgactctgat

SEQ ID NO: 5266 - DNA, 434 bp, Hordeum vulgare
  UNSURE (351),(366),(387),(421): n stands for any base
ggtcaatgcagcaggagatgttacgatacacatctcagataaaagtttacatccaaattcatggagaaagctagccctagagacacaacttacaactctacatttttttgtacacataaaacaggatacatgaattattaaagaatgaccaatctataacataaatctgattatggggtacctaacagttggcgccaacgaaaatcggcagaactgacacacaagaggcccaaccaacacttgtttgcttcgaccttagaacagtgagtcaaggtatgagtagttatagagacggccatactgaagcaggctgccgtaggtcctatcccagacaccgacgaagagtgtgtncggtgtcggggctgnaagacatgccagatatctcgncaaagaaatccagctcttgcctcttgttgcaatnactcttgacatca

SEQ ID NO: 5267 - DNA, 422 bp, Hordeum vulgare
tgttgctgatatgagactataattaactgaattctgccgtcaagtgattcaggaacaggatgtctcagggtccaaatgctagacttattatacctagcaaggtccaaatgctagacttattatacctgataagagatgtttgcatgtactgttggcatgccgttcgattcaacacaagaagcataacaaagtactcaatatgctggaataaatctggtttgcatgaagttattttaggaacaactgggaggaaacaaggcacatcttcaaaggcaacatccttcccctccaccgagtcattgctctgcaagtaagagagttccctttctcattcctagcattctgaattcctgatgtaagcctggcaaaatatctgcgttttgatggcaggataagattggcagtggccttcatatcacttg

SEQ ID NO: 5268 - DNA, 551 bp, Hordeum vulgare
gccaattccttctacttttcttttctaacacacaattaaaataataagagttacagagttaccgatccatataaacacctcatggtgccaaacatcatagggctttataggtttgttacaggctatcactgttcaaaacttcagtattgtgcagaagcacacatgctacaaataagctgaaagagctgatacacaaaactgctaaaattgtggtgaaaccaagaaacttcaagaaccagcctctacgacacaacatagaacctcaagatctagtcatcaccgtggaactgtaaacgaatcaacggatcctggcttagcacgccatctgccaaaaaatggggcctttctaagaagctcaagcatctgctagtactcacaagccatatcctgcgacagagatgagacatctcaaaccttcacttattgtattcacaatcattgctcacaaggaatcggaaatcatttaatgtaatctagctctgtgccttcaactcattatccatctgagtaattaaaaaccatacagtataggataaaatcccttaattgca

SEQ ID NO: 5269 - DNA, 552 bp, Hordeum vulgare
gtcccccgggctgcaggcgacactcctggcgatcgagttcctggccatcgccttcgcggagcagcagcgcaccatggagaaggacccggagaagaagaagtaccccggcggcgccttcgacccgctcggcttctccaaggaccccgccaagttcgaggagctcaagctcaaggagatcaagaacgggcggctggcgatgctggcgttcgtggggttctgcgtgcagcagtcggcgtaccccggcaccggcccgctggagaacctggccacgcacctcgcggacccgtggcacaacaacatcggcgacatcgtcatccccagaaatatctacggcccttgagcggagccgaccgggctgagaggagatcgaggagccggagcgcatggttttcattcatgtttctgagtcgatccattggttgatcaccttgccacgctggctctgcgcgcgcaccgtccgtgcgtgctggaactgtacaacaacgtcggctctccggccggcaacctttgtaatgtgtaaagcttaagtagcggccgctgttgcgaatgcat

SEQ ID NO: 5270 - DNA, 553 bp, Hordeum vulgare
ttcatttattattgcctttagggctaattccacaagatttacttcgtgttacacacgcaaatggggatggataatacttgttggacgtgtggcatgaagtagttgtgtccacacatgtggtcagttctattattctcccacacacaattcgtgtgggctaccttctgtgtacgccatacacggtgtgtgtggatgtctaatatatcacactatgatgaatatcaggaccccaagctaatagatgaaaatctctatgttactattcattatagagatgataacttatactagtaacatattcatgttactactttatatgttatcctttattatgatagtctgactgttcgtggacatttgatgacttctgtttggtgggccgcgttggggatgtcctaagctcaatgaaatgttaaggtgatcacgtgataactatccgtacacatcatcatgcaaagaatttatacagatcacatggatgcattcgcaacagcggccgctacttaagctttacacattacaaaggttgccggccggagagccgacgttgttg

SEQ ID NO: 5271 - DNA, 554 bp, Hordeum vulgare
gggcctgcaggcaattcggcacgaggggttggctctctataaatgatagagccgttgtggtatacagtcaacacatggtgcaatcaatctagtttctagccccaacttgtgaagctaacaatcaccactcgtgaacagctatgaaggcagggagcggcgttcgcatggctaacggcaacggggagaacagctacgccgcaaactccaggctccaagagaaggccattttggagacaaggccggtgcttcgcaaggccatagaaaaggtgtacacgtcgctctccgcccgacggagcaccatggtcgtcgccgacctcggctgctcgtcgggcccgaacactctgcgtgtcgtctccgaggtgatcggagcgatccaggccggcactcggaagtcggaagaagaacggcgcgccatggaggtgcagttcttcctgaacgacctgccggggaacgatttcaacctcgtcttccggtcattggagcaacttgaagatctcggcggcaaagagacgccgctctactatgtggccggcctgccgggatcctactacagg

SEQ ID NO: 5272 - DNA, 541 bp, Hordeum vulgare
agagattttttataaatttattatagaacacagaagagaaacctttgtcttagaaaaacagggtaccacatatataataattagccatagtaggcgtcaaatatataatgttcaacatatatccccaattatactatgtgatattttccatttgtcatgaaatatgtgtccacttcagtgcatggacttctccaaggatgccacgatgatggggtactttgcctttgctttctccagatgcttttcaacgacggaggcatacaccacgaataattcttcaataatggcctctccaaagtggtctacaatcagcggttccaaaaccgcccttatgcatttggccacatttgccccgctgctagcacaatcaattaccacatcactgtctgagtcatcctgaggatcccagttggattcaaagagcctgatatgctcaatgtcgaagagcttactctcattgatcaactccttcacctctttcaccgatggggcatagtatggtaggttgaatgagtcgaacttctccttctccacacggccc

SEQ ID NO: 5273 - DNA, 518 bp, Hordeum vulgare
gcgaggtccagtcttagctcagctcactctcgccgctgcttgctcccctcccccaaccctcgccagcggcggcgagctcccctccggcgacgaggctcgaggagtctacggtcaagccccgtccgtctcaatcctgcgcgctccggtgcggccgcccgtcgtccccgctcgcgccggccgcgtgatctggttgttctgaaatggccggcggcattacctgtggatccttgctgcagaaattacagcttgtgtgggatgaagttggtgagagcgacgaggaccgcgacaaggtcctgtatcagctggaccaggagtgcctggatgtctacaagaggaaagttgatcaggccaccaactctagggatctccttatccaggcgctcgatgactcgaagatcgagcttgccaggcttctttctgctcttggggaaaaagctgtagcgagaacccctgagaagacatcagggacaatcaagcaacagctagctgctatcgctccaacacttgagcagttgaat

SEQ ID NO: 5274 - DNA, 553 bp, Hordeum vulgare
  UNSURE (63): n stands for any base
cggcagggcacacaaaaagggttatttaacgactaataacacagaccagcaaagtctatactnacgtccgatcacaggtagcagaaaatagtgtacgcctcgctgaaactaatcaaaagtggaacaccactttacaccaggagcaaacaaaccctggccaggtagccgaactacagaggggtcgatggacgtcacttatactccctctcctcgctacaaacacagcacattatattagcacaaaacaatggaaaaacaaaccatcagcaaatatcctttcttatcttctaatagtacaccatattaggtcaaagatcacggcgtggtcggagccaggtcggtgccggagatgtgggaggacgcgtcttccttggcagcagctccgttccctggggacgacaccgccttcgtcgcgctgtctctcttgctgtccttccccccagaccttccattctgctgaccgctgattgacagtcttctgctcggaggagtgccgttcatggacgtgccgttggattttgggccgggtaacttcttcgcggtagccggtctg

SEQ ID NO: 5275 - DNA, 517 bp, Hordeum vulgare
aatggagtgattcaccccgcatattagatttttctaaagtcaaactctataaactttaacaggttcgttgagaagtatattaacatatgcgccaccaaatcaataccattggattcatcattgaatatattttcacatcatatatatttgttattattgtaaatgttcatattgttttctacaaacttggtcaaactttataaagtttgacttcagtcaaatttaatatggtagtaaataaaaacggagggagtacaatgtttatgcctctactagtagaaatctgggccctcatgtttatcatggagaagaacttgtttggtcagttgatttatggtacctccagatggcaacaatgcattggtggatgaaattgtgttggcttaattttgcacagaattaggatcctgaagacttaattctgaagtaacctagaacatttaatgcatgtctcatgttattctcatcgttccttcaaatatagttcaaccatggtctcagctctcccctaaaggtt

SEQ ID NO: 5276 - DNA, 550 bp, Hordeum vulgare
tgtcaaaataaaatgtatactataatgtgaatgaactcgctaatatacttacaattacaatttatacacctacctgattccgaaacgtaatacaattaatttcgctaaccaggttcaaaattggggagctgaattatacaacggggactacagggaataaatatatcattatcattgcttcgtactatgctctcttcgcaacctttcgtcttttttcgacaacccattgatctgatgctcaagctgattatttctcagctttaatctctgcacttcctcagcgagttctgtgacactgcaaattttcacaaattcagtcaagtgtccttgaatacggaggaccactcagagaacggtagtataccttcgctgtagttggacgacatatgactccaatcccttttctctagcaagcgatccagatgactgaacatatataagcactttgttaaaacaatcacaaaacagtaattgaccttcaaagttcacatgtcttgaggtaaaatgtcaaaaaacatatggaagacactccatcggacacacctgagat

SEQ ID NO: 5277 - DNA, 517 bp, Hordeum vulgare
agcccgagaaccccgctccaaagccctaaccctaggccatcccctctccctcccctcaaccctcgtcgactccgcgcgcgcctgcgttccaggagcttccgctgccggcggcgccatggcctcagagaccgagaccttcgccttccaggcggagatcaaccagctgctctcgctcatcatcaacaccttctactccaacaaggagatcttcctccgcgagctcatctccaacgcctccgatgcgttggataagatcaggtttgagagcctcactgacaagagcaagctggatgctcagccagagctgttcatccacattatccctgacaaggccaccaacacactcacccttatcgacagtggcattggtatgaccaagtcagacctcgtgaacaaccttggtaccattgcaaggtctggcaccaaggatttcatggaggcattggctgctggtgccgatgtgtccatgattggtcagtttggtgttggtttctactctgcttaccttgttgctgag

SEQ ID NO: 5278 - DNA, 553 bp, Hordeum vulgare
agcaaatagcttaataacattaagctggtagatactaagatgatatatataagcaacgattacgatacgcagttccgggcactccatagaccagcatcccctagccccattagtgcaggctaggcacagtaaaccacaaagacaaaccgaccacgcgacagtaaccaaaagatgagctagcaggctaataaatgcacacgcctagtcgacctcctccatcttgctctcgccggcatcctcctccagcggcggcatgtccgtgtcagcctcagcaggctcgtcatcctcgtcgatgctcaggcccagcttgagcatgcggtggatcctggtgccgaaggtgttggggtcgtcgaggctgaagccagaggtgagcagcgaggtctcgaacagcagcatcaccaggtccttgaccgacttgtcgttcttgtccgcgtcggcgcgcttgcgcagctcctccatgatggcgttctcagggttgatctccatcgtcttcttgctcgacatgtagccgcccatgctcgtgtccctcagggcctgggccttcatgatcctc

SEQ ID NO: 5279 - DNA, 998 bp, Hordeum vulgare
  UNSURE (1): n stands for any base
nttgcaagactgagcctgtgcccccgatctggagggaatctcgaacgaggtggacattggtatccgcaaagcagtttctgagggttggcttgactcttcgtatgaaccatcaggtgccaatggcaatgtccaagatgatgaccatgagaagctgaggaagtacaagagggaggctgtgtctatgatacatgagtacttcctttctgatgatatagcagagcttattcgcacacttgaagagcttggtttaccagagtacaacccggtctttatcaagaaattgataacaattgccatggaccgcaagaacagggagaaagagatggcatcagttctcctatcctcattaagcatggagctattctctagtgaagacattgtcaaggggttcataatgcttctcgaatctgcagaagatactgcactggacatattggatgcctcagatgagcttggactgttcctagcgagggcagtgatcgatgatgtgcttgcgcctctgaacttagatgagattggcagtatccttccagcaaactgcagtggggctgaaacattgaacatgggacgctcccttgcctctgcccgtcatgcaggaaaaaggctactgaggtgctgggggcggtgggacaggatgggccgtggaggaccccagggacaggataccaaagctcctggaagagtcccagagcgggaggttaagtaggggaagcctccaagtgcattccgggaaatgggcctgccttttttcaaacctgtaggtgggaaagaaggcccttgctatggaatggggaaaaaaaaagagggccgccttgttttggtgaacaattgctttggcaaagggtccttacccttcaaccgaatgcccaggggtttttaaggggcaaggacgggccttacaattttggcctttgacatacccggttgccagggacagttccttttctactcggtaaaagggaaaaataaaagtgggcttctaccctttttttgggtgt

SEQ ID NO: 5280 - DNA, 654 bp, Hordeum vulgare
cggggctccgcccctggttaccccgcaaaaagaaaagaaaaaacattcagtgtgtggttgcagtcttcacaccatcactaaccaacgactagcaaatcactaaccaacgactagcaattgcacatctaccggtcagttccggatttcctccagtctcccaacccattccaaatatcgagcaaactcttccaccggagctcctgccccgcgtgacgtctcgcttcggcctgcgctgccgtttcagcctccatatcttcacggccacccccgttggcgccttgggaacgttcctgctgctcctgcctctcgagtttcctggcaaagttcctggccgccgcgaacacgtccttgggcctctcccacccgccgccgaacaccccgtgcccttccttgggctgcggacgcgtcatgaactccagcaccgggagttcttggctcccgacccagtggatgcagttcacagggcaggactccacagccacctggatctgctggtccgcgtcaccgaactggacttggacgcgcgcgcttccaagaacatcgtccatggcaaacgtctcgccagcatggtggacacactccctacatcctatgcatttgttctcatccacaaagagagcttggcttctcataggcccattccaagaactgcat

SEQ ID NO: 5281 - DNA, 534 bp, Hordeum vulgare
ggaattcggcacgagggccgccccgagccagcataggagaggcgcgcgcgtcggcttagcggccaagaggcagcagtgctgcgccgtcgcttgcgggcggtttctgcttcgccccaacgctcgcgtatacacggcggcatcggcatccgcgtcggcggtgatggctagcggagctggggactccggggtgaggaggaagaggctcgcggtgttcgtgtccggcgggggctccaacttccggtcgatccacggggccgccctgggtgggaaggtgaacggggatgtggttgcgctcgtcaccgataagccaggctgcggtggcgccgagtatgcaaggtgcaatggcattcccgtggtcgtgtttcccaagtcgaaatccgcaccagagggggtctccacagatgaacttctgaatgctctgagggatctgaaggtagacttcattctacttgctggttacttgaagctcatacctggtgagctagttcaggcatttcccagatccatgctgaatatacacccttcactgctccc

SEQ ID NO: 5282 - DNA, 546 bp, Hordeum vulgare
ggcattatgcttctgggacacgattacagacatgttatttcaggcacagattatcatcaaagctaagccatacaatgagttaaacacagtgcaaggtacacattattttgggacgaagattatcagacatgttatttcactcaatcagacaaacggtgtgtgtaagtgttaactccatgccatggtgaaaactggcacttggtggggacactaggagcttcattaattttcaggagatctcaggacagagatcacgaattaggtatacgcattggggtttgcttgacttctgacaagtgggacaccatcgtctcgccacacaattcgatcctcgcacaaggcagcaactgcctcaacgtaaacttggtgctcctcatgaagaacccttgcagccaattgctctggagtatcattggctaacacaggaacaactctttgggctaaggttttccctgtgtcgaactgctcatccacaaagtgcacagttggtcctgagtatctggctccagatgcaatgactgctttatgcacttttaaaccataata

SEQ ID NO: 5283 - DNA, 508 bp, Hordeum vulgare
  UNSURE (44): n stands for any base
ttaggtgacaccatggatatcaaatcatctggatgcgactacgntatgtgaagattcatcatcacgatcagaatatattgcttccaatgaacttccatacagcttcgaggggccagcttcagatcacaggacagagcaaccagcattgtgctaccatgaggaatcagaactgcctgtttctgaacctctccttccctccaaccttgacaatatcaactctggtttccctcttagtttcactgaaatgttgaaaaatttgtcaactgagactgaacatgatgcagaggacctgcatcaactggctggaactgaccatcctcaaggagtaatgtatggtggatcagatggggaggacctgcatcaactgactggaactgaccatcctcaagaggtaaagtatggcggatcaggtgcggaggacctgcatcaactgactggaactgatcatcctcaagaggtgttcacacaagatgcttgtcatgacgctggcagtaatggaaatactgct

SEQ ID NO: 5284 - DNA, 433 bp, Hordeum vulgare
gcagaacacaacacataatgatgcacaatatataagccccaataagttcccatccctgcgtacgtcacaactttgctaggattagaagcaacaattcaggaaccgccgagtgaactacaactacattctgtgtttcaatttccattggcagagaaaacagaggcttcgagcggctatgaggaggttttcctatgtgtctaggggtagacggacaagtccacacccagttcatcaatgattctctcgagcttgaacagcatatcatggaatgactcatcagccagatatttctttatccttgccataatatcacttgttgatttactagtatcaatttcttttgttgacttgctagtaccagtttctttatcagcagtatttccattactgccaactgcaattgaaggaaatacatcatgacaagcatcttgtg

SEQ ID NO: 5285 - DNA, 518 bp, Hordeum vulgare
aaaccaaggacgtttggaattggcaatatgaactaaagaatcatacaacgtccatgcattcatctacagtcgtaaccattctgatggttattcttgggcacacctatatggtgttcttgacactgtcttctgtgctccagtgctatgcaaactctaagattgctgctgttacttgcgtcctataagtttggaccatggcgcatgcaccacgtaacagggggtttccaactgatcccaaggaatataagttatatgaggaagttggagaaggagttagtgccacagtttacagggctctttgtgtcccgctcaatacttttgttgccatcaaagttcttgaccttgagaaatgcagtagtgacatggatggaataagacgggaagtacaaaccatgagtttgattaaccatccgaatcttcttcgcgcatgctgttcatttgcaaatgaccatcatctttgggttgtcatgcctttcatggctgctggatctgccctgcacattataaaaactaatttc

SEQ ID NO: 5286 - DNA, 554 bp, Hordeum vulgare
gaaggggacaaaacaagttacaaagggggttgctatcgagacactagtagtagtcaagtgagggaaactaatcctcaccgataacacaaagcatgctgtacaaatcaaaaatgtatactataatgtgaatgaactcgctaatatacttacaattacaattgatacacctacctgattccgaaacgtaatacaattaatttcgctaaccaggttcaaaattggggagctgaattatacaacggggactacagggaataaatatatcattatcattgcttcgtactatgctctcttcgcaacctttcgtcttttttcgacaacccattgatctgatgctcaagctgattatttctcagctttaatctctgcacttcctcagcgagttctgtgacacttcgctgtagttggacgacatatgactccaatcccttctctctagcaagcgatccagatgactgagatgaaccaactgtacttgcatcggaagcatcagatgtttcctcaattgaagaaatcaatctacttagcacttccttctgcatactattttgctg

SEQ ID NO: 5287 - DNA, 147 bp, Hordeum vulgare
tataacgagaggcttgagatgcagacaccttacatttcaaagtggcctcaagcgctgagcattcaccacccaaccagcaaatgtctcgacaagcttaaagcagagagcagtccttgtggatgagatttggcttgctgctggagatga

SEQ ID NO: 5288 - DNA, 548 bp, Hordeum vulgare
agttgagtataaagttttaaattccggacgtgtccatgcaaagccgcgagtgtcttgctctgtttgcagcaactcaggtcacacatggactagagtatgtagagctcacactttttttttctccaacctgtagcagaattacgcaatgatgactaatcaacagctcaaatgacctctgaccaccgactaaataacttctcggctacgcggacaagtctaccctaagagggtttgtttataaggaggtatatattactatatacaatgtcatagaatcttaacgtgacataagaaagtggtagagggaatgtcgagaatgcagcctgcaaaggcaagttcatgcggttcttcatttctggaaaactttgttcaggacgccatttatggagccaccgatccctgctcccacggtttcagcaagatacgcggcctccttataagatttccccaaatcaagagcacctttgatgccgcgattcacaaatgtccatgtgtcgtgaaactctggagaattatctgttaacatgtacacttctgaagctgagtag

SEQ ID NO: 5289 - DNA, 518 bp, Hordeum vulgare
cacattgaagacatgctgtcctgataaccaccccattccacccagcctatgttactgcagagaggatcaagaaggcaaagaacctcgagctgcttctcacagctgggattggctcggaccatattgatttgccagctgctgctgctgcaggcttgactgtggcagaggtcactggaagtaacaccgtctctgtggcagaagatgagctcatgcgcatcttgattctgctcaggaacttcttgcctggctatcaacaggtcgttaaaggtgaatggaatgttgcaggcattgcccatagggcttatgatcttgagggaaagaccgtcggaactgtcggggcaggtcgtattggcaggctcttacttcagcgcctgaagcccttcaactgcaacctgctctaccatgacagacttcagatcaacccagagcttgagaaagaaattggggcgaaatttgaagaggacctggatgctatgcttccaaagtgtgatgtcgttgtgatcaacacacctcttact

SEQ ID NO: 5290 - DNA, 550 bp, Hordeum vulgare
ctcgtccagagctttttattcgctgcctggttgcacccccaggcagacatccattatttccgttctcagagaacgctcatacaacaacacaatggtttcttctctcacgcctcgcttcagagttcaaatatgttaccatgcagcgtcggaggggttgggttactacttgtactggctggcgagctcgccttccttgacgatgtagttctccacggggaactcctcgcccttgaagtacctatccaacatgtccttcactccagccgcgtacctcagctgtgcatcaattgtagtcccagagatgtgaggggtcattgcgtgattaggcatgtagcgccatgggtgatccttgggtgcgggttgggggaaccagacatcacctccgtatccagcaatgtgaccgctggagcaagcatcagcaacagcctgggtatccatgattgcgccccgagcgttattcacaatgattacacctttcttcatcttcgcaatcttttctttgttgaacatgcctctagttttctcagtaagaggtgtgttgatcacaacg

SEQ ID NO: 5291 - DNA, 515 bp, Hordeum vulgare
cactcgtgtccgacattcttgcagtcccgggggcctcacatcggcctagcgcgtcccgtcgatccccatctccctccctaagatctcgatgtgccgccgccccacgccaccattgacgaccacggcatggccacgatgccctgcagcgaccacatacgcagcctcccatccccctcccttcctcccctcccgctcgcaactctcctggatgcggatcctaactgatgcgctcctatcctctccatgggtgacatgcagggctcgcgagggaacatcgcacggaggaggcctcttgaggagaagtgggaggagcccgagcgtccccgcgtgcagcacgaccagcgctatgatcgaggaagaacgagaagatgcggcggtgcgaggccatcaagcagcagcacaaccagctccggcgcggcgacggggcggagcagggcacctccgacaaggtcacgaacgccaagcggggtgagaaggactggcaccggagctccggcggcacgcagccggctggg

SEQ ID NO: 5292 - DNA, 535 bp, Hordeum vulgare
ctaatctgaatgataggcaaatagccattcagtcttacatagtactcacagaaacatatattctgactactactgattacaatataactagatatagattacaatcagaacaagaggctgattgatagataaacaccatgcttcatcgtcttccaatttccaaaaaacaaataacctggcattcaaaggatcatgcatcagaagcatataatacataaaactaagaaatgaatggcatgtagtgtgaaaatcacgatagcactagtatgttttaacttatcttacaaccatctatatagtttccttataagaaaactgatacttatgcgagcgtagattactagaaaaattgcacactttgcactcatttgatacttgcaacagttttaatgtaagccaatagttaaacctgagaagatatgaagctgaaacctaaccaatgtatttcttactactaaggtgcatatagatgtagtcgataatgggggcacatgggagtttgaaatgtttcaaaattgaaatgagaatagacaac

SEQ ID NO: 5293 - DNA, 486 bp, Hordeum vulgare
tgtccatgattggtcagtttggtgttggtttctactctgcttaccttgttgctgagagagtcgttgtgaccagcaagcacaacgatgacgagcagtatgtgtgggagtcccaggctggtggctccttcactgtgacacgtgatactactggagagccccttggaaggggtactaagatcaccctctacctcaaggacgatcagttggagtaccttgaggagcgtcgccttaaggatctggtgaagaagcactccgagttcatcagctatcccatctccctctggacggagaagaccactgaaaaggaaatttctgacgatgaagatgaggatgagaagaaggatactgaggagggcaaggttgaggaaattgatgaagagaaggaagaaaaggagaagaaaaagaagaagatcaaggaggtttctcacgagtggaacctgatcaacaagcagaagcctatctggatgaggaagcctgaggagatca

SEQ ID NO: 5294 - DNA, 541 bp, Hordeum vulgare
gatctacgatgatatatataagcaacgattacgatacgcagttccgggcactccatagaccagcatcccctagccccatcagtccaggctaggcacagtaaaccacaaagacaaaccgaccacgcgacagtaaccaaaagatgagctagctctacgacttggatagcagcaaatgcacacgcctagtcgacctcctccatcttgctctcgccggcgtcctcctccagcggcggcatgtccgtgtcagcctcagcaggctcgtcatcctcgtcgatgctcaggcccagcttgagcatgcggtggatcctggtgccgaaggtgttggggtcgtcgaggctgaagccagaggtgagcagcgaggtctcgaacagcagcatcaccaggtccttgaccgacttgtcgttcttgtccgcgtcggcgcgcttgcgcagctcctccatgatggcgttctcagggttgatctccatcgtcttcttgctcgacatgtagccgcccatgctcgtgtccctcagggcctgggccttcatgatcctctccatgt

SEQ ID NO: 5295 - DNA, 379 bp, Hordeum vulgare
gatctctgctctgctctgctccgaggcgccggcaatggaggtgctctgcatcgggacggccgacaccaagctggaggagctgctcctcctcgccgctcgcctccgctccagcctcgccgcctccggcccaaaggttaaagtaagcatagtggatgtgtccacaactaaaacagtgccaacacaagattccaaagacattgcagttattgcaagagatacagttctctcatgctatccggattccagccaacaagatcttccagatgacagaggtgaagcgattgcgcttatgtcaaaggcccttcagagcttcctgaaaaacagatatgaggctggtaccctggttgctgctgttggcctagggggaagtggaggaacc

SEQ ID NO: 5296 - DNA, 329 bp, Hordeum vulgare
tttttttttttttttttttaagatagaaaagttgtttaattaattaacagaaacacgaacaaaatccgtttcaacacgctcagctcccaacacgacaccaacaacccacaccaatccaataccgctgacaccctacaaccaaacccaaagccgccgctctggcatccacgcaggccccaaggccgcgcgccaggtgagccacatgccctgctgtccaagcaaccgaagctgacaccctacatctatctccgaagtcgtcacttcgacgtacagacagtgaccacacacatctcctgccctgctgtctaagcaaccgaagctgacaccct

SEQ ID NO: 5297 - DNA, 390 bp, Hordeum vulgare
gtggagctggcaaggttaaaggagatgctttcacagaaagaggcaactgaagacgacgctgtcgtcgaagaaagagaggaagctgcaaatgatatgaatgctccttctgacccgcagccgataaaagcggagtcctaagggtgccgactatttttttttctgcggctgcgtttatgcctctgatgtaatgtgacgctttgatggctgcaacagttttccacattgctgagaatttcatctgtatgcttgatggaacgctggtatatcacgggttctaagttattgccgtttatgcaaatagtgggacctcgactttccaactccagcttgtattcccagcaaagctccaagaaatatatgcggtctcatagtatgagctttgagcaaaaa

SEQ ID NO: 5298 - DNA, 373 bp, Hordeum vulgare
tactatgagaccgcatatatttcttggagctttgctgggaatacaagctggagttggaaagtcgaggtcccactatttgcataaacggcaataacttagaacccgtgatataccagcgttccatcaagcatacagatgaaattctcagcaatgtggaaaactgttgcagccatcaaagcgtcacattacatcagaggcataaacgcagccgcagaaaaaaaaatagtcggcacccttaggactccgcttttatcggctgcgggtcagaaggagcattcatatcatttgcagcttcctctctttcttcgacgacagcgtcgtcttcagttgcctctttctgtgaaagcatctcctttaaccttgccagctccac

SEQ ID NO: 5299 - DNA, 371 bp, Hordeum vulgare
gttttgtttcttctcttgcgctgtccggccgggggaatcggtcgtgggtcgtggccgtgtcttgtgtctgggggtgggtgatcttccatggcgtccacggcgtacgcgcgcgggtcaaagccgccggccggccccggcgagcggaggcagccgcggctggccaaggagctgagcaggatcgagcctaagaagctcgggattgggctcgtcgccggctgctgcctcgccctcctcacctacatctccttcgcccgcctcttcgccatctactccccggtcttcgagagcacgtccatggtgatgaagaacgccccgcccgcgtccacggcggtgcccagcacggagcaggccgtgccggtgcagaagaaggt

SEQ ID NO: 5300 - DNA, 407 bp, Hordeum vulgare
ttttttttttttttttatacaccagaaatgaaatcaattaagtaactttgatttgaacttacaaaatgagaactcatcagctataccccaacaaaccaagtaaccaaataacccaagacaaacgctctaatcaatcctgcagctggtccagcgccttgaggagaaacggcttgaatctggtgacattgaccatgacaccctgcttcatgacgatctctgcgagcgccggccatccctgcgcgtggatctgcatggggttcttgaacacgtagtggtctcgggagtacttgtccttgagagtcgtctcctcctcggacacgtagtactcgacgtaccggagctgcatgtcgcgcgccggctgcccgtagaagttggtggccatccagtccatcttgccccacggcacg

SEQ ID NO: 5301 - DNA, 247 bp, Hordeum vulgare
cgcgaatcagctagtgagatacaactgatccatatctgacccaatcgttgacccaaaagtcctcccgatcccagctggtgagctaagcttcgggtcaggcgcgcagctgaaaaattctattggaaattggtcgagatggttgacggataacttgggcattgatgctgatgaccctgaggatgaaggtttcgacataagaaatgggaatgatgaaagaattggtgcagctgaagcaaagtcttttaag

SEQ ID NO: 5302 - DNA, 558 bp, Hordeum vulgare
  UNSURE (20): n stands for any base
ccaaatggggcacctagcangctgtccatttatgcccctatacactactacagaaaagaaaaaagaaacagtatatatgtagagatgtacaaagatatcatacaagggaccctagttctgctgcaaaagcaacttcttttggggttttcacctctccagggtttcccaaccctttcttttatgtaaaaagagtagtaactatagaggtggtgatcttcacaagctcactggatcgctgccgcgccgctccgaccacacctctctcaggagctcgaacctcgcgttctccaaggaagctcctctctgctgagcagtgaaaggcgtgacgccgtttgatggcgaaggtggagcgctcttgtcgaacagggacgccaggggcgagtccaggtcatctagatcgtcgtcgctggtgtaccctctcctctgtaccattgaggccctcctgtccagcttcgcgctgcctccggctaccgacactttctcctccacatccagttgggaaggggagcggtacgcgataggagcagcgatgcacgggaatgcgctgatcgcacgttt

SEQ ID NO: 5303 - DNA, 518 bp, Hordeum vulgare
ctccacaatggcgacggctcaccttagcccggcgctcgcggtctcatcgtcgcgccacctaacctgcaaacacggcaagccgcccgtcttcgcgcagccaggcggcacagtggtgctgcggtcttgctcacttcctttgtcctcgagactcgccgcgtcgggtcgaggtgggtggcggctcgcggcggcagtggagcccatgaccgcgcagcaggaaaaggccgaggcctcctcgaggcttgtcctcgtcgtgggcggaactggcggcgtaggtcagttggtggtagcatctttgctgagcagggaaattaagacaagactgctcctaagaaatcctggaaaggcagcgtccttatttggcaagcaggatgagagtgttttgcaggtttatgaaggggacacgagaaatgctgacgatttgaatccagaaatgtttgagggagttacccatgtgatttgtactactgggactacagcatttccatcaaaacgctgggatggggataacactcctgaac

SEQ ID NO: 5304 - DNA, 518 bp, Hordeum vulgare
gcgccatgagcaggcagaacgaggactaccgctcgccggcgatccctgccctcaccaagaccctcctggaggacgtgaagaagatcttcaagaccaccaccggcacccccttcctcttccccaccaccggcaccggcgcctgggagagcgcgctcaccaacacgctctccccgggggaccggatcgtgtccttctcgctggggcagttcagcctgctggtggacggggtgtcgtccatctgcgcactggacttccgcatggacgagtggggcgtggacgtggcgctgacggggtcgcagaaggcgctgtcgctgccgacggggctgggaatcgtgtgcgccagccccaaggcgctggaggcggccaagacggccaagtcggtgcgcgtcttcttcgactggaaggactacctcaagttctacaagatgggcacctactggccctacacgccgtccatccagctcctctacggcctacgcgccggcctcgacctcctcttcgaggagggcctcgacaac

SEQ ID NO: 5305 - DNA, 481 bp, Hordeum vulgare
ccccaactcgcaccggctgagcccggaacccgtgtcggtggagctctccatgggcggggactactaccacgcctgctgcggcgaccccgaccccgaccccaagcccgagggaccccaggtgccgtacatcggtaacaaggaacctctctccgccttagcagcagagttccagtctggcagccccattttacaggagaaaataaagttgcttggtgaacaatatgatgctttaagacggacacgaggagatggaaactgcttttatcgaagctttatgttctcctacctggaacatatccttgagacacaagacagagctgaggttgagcgcatcctaaaaaacattgaacaatgcaagaagacactttcaggtcttggatacattgagttcacttttgaggacttcttctctatgttcattgaggagctgcaaaatgttctgcagggacacggaacttctattgggcctgaagaacttcta

SEQ ID NO: 5306 - DNA, 546 bp, Hordeum vulgare
  UNSURE (5),(16): n stands for any base
tcagnagggtcttctnaacaagtcaacccaatgttaagtcgttgtgctagagtacacttacaacaaggaaaacttcgaatttgagggcggtgacaagtaaaagcatgctctgattactccccaaggacacacaacgttccctcttgtaaggccgcctttggcagcatgcaggagcaacacaactacacagttctagacaacgctttctcaacccgaattcatgggaaaaatcaaccttggtgttccatcagccagagatcacttcgggtagagaatgtcatagtgaccaggccggtagagcagagtaatgtaaggtttctcatcagcaggatttaatcccattgcagcatcaccttcagaggaattggctgcagggatgaaatcatggtggttcacacttagattgcctgtgtcacaagagcttcggtctaggtacatcacgcggattggcacccctaacgcatctgacagagcaataatgtgcacatggtcactttcctcgcccattggctccacagaagacttgcaaaactgaaccacggtcga

SEQ ID NO: 5307 - DNA, 517 bp, Hordeum vulgare
cctcgtgccgaattcggcacgaggatggcatatcaccctatgttggagcagttcctcctcttagcgttgtaggagaaactgttccaaattatcatggcatatcaccctatgttggagcgccgttgacttatccgacaagcccagtgtttcaggggcaacctttctctggaatttccccctctggccgaaatgatcctgcaaggtttcagccagcctcgagaaatatgactgctgtttctgggtttcaagggcagcgagaaagggagaaatttgatagcccgaaggcatgcactttcctggaagaacttaagtccaacagagcacgtagggttgagctatctgatatcacaggtcgtatagtagatttcagcgctgaccaacatggtagccgtttcatccagcagaagttggaaaactgcactgccgaagagaaggcggccgtgtttgcagaagttcttcctcatgcttcatctttaatgactgatgtgtttgggaattatgtgatccaaaagttttt

SEQ ID NO: 5308 - DNA, 535 bp, Hordeum vulgare
ttacccaagcagtaatccttttcgaaaaacatatatgtatcacacacacaagccaaaccactactactatacatattttgcacacggctaccaactacagtagtacagtgtggacaagcacaccctaacatagatacactgatgcgcacagaagaaaccttgtgcctagcacctcctacactgcctacagtcacatatgtacaatcttccttgctggagttccaagttttgttagcactttgaagcaccacggttccaagttatgatttcttcgttgcctatgaattgggcgggcgttgatttcttccttgacgatgaatcgggcgagcgttgaggcacctcccgtcccctaggagtcgcactcggcatctccttcaccgcaaagctgctcgacccggctcgcgatatgtttgccataggtgtacttcctcagtgcttgcaagtgaccctttacacggctgaccagaagttcccgctgctcatcgttgcatgtttcaagtatcttctgaacaacataattagcgtactgatcctt

SEQ ID NO: 5309 - DNA, 10 bp, Hordeum vulgare
  UNSURE (1)..(10): n stands for any base
nnnnnnnnnn

SEQ ID NO: 5310 - DNA, 983 bp, Hordeum vulgare
  UNSURE (1),(616),(746),(983): n stands for any base
ntgcaaaagaaatagctattgtgcaatttttctgggaatggagtgagtacagtacaaagtaagccacgtttgctgacaacaccaaaacaaaccacaagaaaaaggcttgaaggacccatcagtctaaatacggatgagaatcagatatgttttcatgcattacaccgctaagtatgcacacaaaatatgttcaccatccatcgccttctgcacggtgagttcacaattgttcaagcagaagcatgcacccaaaattctctacctcaaatgttgttacaagtatatttcaaaaaattatgtccacgtcttgtcttttccctaatgtgacaccactacacaagtgtggagtctcaccgaaaagttgcccacctcgtcctaacatccaaaggtttcctaagccagtacataattcctccagcactgtttaccggtagtacgaagccgtgatgcacagcagaacagaggcagctgctgtaacaatcaattcctggtagtaataaacaatccggggagtctgctgccaagataactcaaccacgttaagagctattgtataacccagggacgcagcgaatacacatccaaatatcaaacccaaagcgcggaatacacgttntgccattcgtacccctctttcctcaacctcaccatactcattatatattggagttattggtggctcagtaaccctcaacttttgaagtattctggtgaagaaagcaaaacacaagaactgcaaaggcttncagttccgcattaccgaagatagcaatgcaaacaaaaggtgctgctgatattggcatatttatgcgcacatccctttattgttgatttggagggtctgggtccccaaggaaactattggttgattgtcaacatacttgaaatccttggaacctgaaccgatcctaattaactccctttttcctatactgaagtggtgcataattaaagggtatagcccttttccaaattggccaaan

SEQ ID NO: 5311 - DNA, 546 bp, Hordeum vulgare
  UNSURE (86),(98): n stands for any base
gtcccccggctgcaggattcggcacggggcgcaacgatgcttcggggtcttctgcaccacctacgatctcgagggcggatgaaagnaccaagtcctgngaagaaattagtgaacgtttctgtgtcaggtgcggctgggatgatatcgaaccatctgctgttcaaacttgcctccggtgaggtttttggacaggaccaaccaatagcacttaagttattgggctcagaaagatcactacaagcactagaaggtgtagctatggaactggaggattcattgtatccattgctaagggaagtcagcatcggggtagatccttatgtgatcttcgaagatgcagattgggcccttctaattggggccaaacccagaggaccgggagtggagcgagctgccttactagatatcaatggtcaaatcttcgctgaacagtgctttgatctgcttgaaaaatgcgcccagcttaccagcaaagaactttcatgcattgacaaggttggatgaaaatagagccaagtgtcagctagcattaaaagctggtgtgtt

SEQ ID NO: 5312 - DNA, 551 bp, Hordeum vulgare
ttttgctttatatattattagtgcaaacaaatgtctgcgtgcttattaaatacacacaagataaatagctgctgcagcctgcaagcagtcgcatctctcaactatccttcttcctgttggtgttgggaacactgtgatccttctaataataacatgacatcttggtagcaattggcagattgctagtatcgtccatagcagtagcactacatctctccaggaagcattgtatccccaggaagatcacaaaatgcattaccctcccctgtaagatgggcaacacatcttttctcagcgatcagttcagcttcactctttttgatccggccccagagaaaatcgtccattgccacatctttaactagttcatagtcgccatcgccctttgatctgcacggcatactgaatacgatatcatctactatgccataaggatttccggtcgtataaacccctgtagagaaccagtctccttccggcgtaggagttacgagggacctcattgcatcgacgatggaaacagcggttgatgcagctgaagatctgcccca

SEQ ID NO: 5313 - DNA, 517 bp, Hordeum vulgare
aagaccttagaggggctcgggagggccttcttccccgcctttggccgccccggcttgtttccggcttcggctaaattagcccatgtggaggcacccccgcagcttagatttggccagcgagctcctcgatcaccagcccttctaacccgcgcgcgaattcggtgagtgcaggcctctccatcgagatcccactgcacccgaaacaccgcccgctggagtttggagttgtcgttgacgtggtacccgctggcatgtgactccacctccatcatctgcagaacctcctggtgactgcacccgcatgctctttcccctctgtttcgctacaggacgccgtcggcgacatcgcgagcctctgccactcgcgagatatggatgaaggagacctcatggatgaagagtacggtagagagtctggcgcctagaggtgtatgagtcagtcgtgcgatcatggagtccgtcattgtattatttcactgtcgtgcgatcatggagtccgtcattgtattatttcact

SEQ ID NO: 5314 - DNA, 550 bp, Hordeum vulgare
  UNSURE (526): n stands for any base
cagaaatgagtagtacttaatattaaacagggtagagcggaggtcgccctacagtttattacaacactcccacactatcataaggacagatatattacagtggtcatgggataactctactcctcgcataaggtgggcatggcacattagagtgacgtgacatgccataagtactactacacgccaagcgcgagagtgaggcttgatgatttatttgtggtggcggaagcagtgaaataatacaatgacggactccatgatcgcacgacagtgaaataatacaatgacggactccatgatcgcacgactgactcatacacctctaggcgccagactctctaccgtactcttcatccatgaggtctccttcatccatatctcgcgagtggcagaggctcgcgatgtcgccgacggcgtcctgtagcgaaacagaggggaaagagcatgcgggtgcagtcaccaggaggttctgcagatgatggaggtggagtcacatgccagcgggtaccacgtcaacgacaactcncaaactccagcgggcggtgtttcg

SEQ ID NO: 5315 - DNA, 518 bp, Hordeum vulgare
aaacgcttaagggtcagggccctgtggtaggccaacatctaaggcttgtagggaaaaagtgagaagagacaagctgaatgacaggttccttgaattgggtactacattggatcctggtaagccagtaaaagctgacaaagctgctatcctaagtgatgcgactcgcatggttactcagcttcgtgctgaagcgaagcagctaaaggataccaatggaagtctagaagacaagattaaagagttgaaggcagagaaggatgaacttcgtgacgagaagcagaagctgaaattagagaaagagacattagagcaccagatgaaactattgactgcaactccagcctatatgcctcatcctaccatgatgcactccccatttgctcaggcgccaatggctcccttccatgcacaggggcacgcttcagcacagaaactgatgatgccctttgttggttacccgggatatccgatgtggcagttgatgccgccctccgaagtcgacacctcaaaggacagcg

SEQ ID NO: 5316 - DNA, 554 bp, Hordeum vulgare
ggaacgagcattttctttcttttctcagaaaaaatgtattatacagtggacgaagggtagtagctctatagagcgcacaaaggccagcattctcctcatcaacaaaaactaccgcatgacaacaatagttaatctgaatcagagagactatgcgcaaccaatggatcaaacaactacgctgtttaaggttaccatgagttcatgtgatttaaacggtccaagcatcacgcaacaggcgggcaagcttcgctgtcctttgaggtgtcgacttcggagggcggcatcaactgccacatcggatatcccgggtaaccaacaaagggcatcatcagtttctgtgctgaagcgtgcccctgtgcatggaagggagccattggcgcctgagcaaatggggagtgcatcatggtaggatgaggcatataggctggagttgcagtcaatagtttcatctggtgctctaatgtctctttctctaatttcagcttctgcttctcgtcacgaagttcatccttctctgccttcaactctttaatcttgtcttctagacttccatt

SEQ ID NO: 5317 - DNA, 551 bp, Hordeum vulgare
gtacccccgggtctgcagggaattcggcacgaggcacactactccacgcccgttgacatgtggtctgtgggctgcatatttgctgaattgatcactaccacggcacttttccctggagactctgaggtgcagcagctcctgcacattttccagttgttgggcactccaaatgaggaggtctggccaggagtaggcaagctccccaactggcatgagtaccctcagtggaacgtctcaaagctgtcttctgtaattcccagtctcgatgccgttggtattgatctgcttgagaaaatgctgcagtatgagccggcaaagcggatctctgcaaagaaggccatggagcacccatacttcgatgatgtggacaaggcgctgtactgaagctgtcttggtggctaacaagaagcggatttcttgtgatttgtgcttgtcctgaagcatatcttttgcttccaggacaggcatttttacctctgttattccagctgccatttagtttgcaccactgactgatggttgtgatggatagtggctatggaactatgcat

SEQ ID NO: 5318 - DNA, 535 bp, Hordeum vulgare
ttttatattttataagttttccatcagaaacagaaatgaatggcatacagtataaagcctgattttgaagcagaagcagaagcagtgcttcacaagaccagtgtttgacacctgacaagaggggtttaattatgcatagttccatagccactatccatcacaaccatcagtcagtggtgcaaactaaatggcagctggaataacagaggtaaaaatgcctgtcctggaagcaaaagatatgcttcaggacaagcacaaatcacaagaaatccgcttcttgttagccaccaagacagcttcagtacagcgccttgtccacatcatcgaagtatgggtgctccatggccttctttgcagagatccgctttgccggctcatactgcagcattttctcaagcagatcaataccaacggcatcgagactgggaattacagaagacagctttgagacgttccactgagggtactcatgccagttggggagcttgcctactcctggccagacctcctcatttggagtgcccaacaactggaa

SEQ ID NO: 5319 - DNA, 519 bp, Hordeum vulgare
tgagcttggcgggagcgtcatcactggcatccacgccaacccgctaggcgtgctcgcccgccagctcgggattcctctccacaaggtgcgtgaccgctgcccactgtaccacactgacggccggaccgtgggcaccagactagatagaagtatcgatttggtgttcaatacgcttcttgaccacgccactaggctgcgggagtctctcaaggaagccgcagaggggatctcgctaggggaagcgatcgaaaggctgagaaggttgtacaatgcggccaaaagcgaggaagagagggaggttctggactggcatctggcaaaccttgagttctccaatgctggttgcttatcggagctctctctggcgtactgggaccaggacgaccagtttgagatgggtggagatcattgcttcttggctggagggaattcgaggctcgtacacgcgttatgtgatggtgtaccagtgttgtatgagaagacggtgaagcgtattgaacatggagtagatggcgtgag

SEQ ID NO: 5320 - DNA, 548 bp, Hordeum vulgare
gtgcaatggacgtctggaattttagcccattgacaagaaagaaaacattactatctgcagtgcatacccctcaaagaaaaaaaatctacagtgcactggatccactgatcatgccatttgcatcccaggtctaatctactgaacccaaacccagatgttgcaatttacaactaggagcgcagcacggtgggatcttggatggccccaatgtctgaatttgtacaacactaaattacaaaacaatcctacctaagaattgttttcttctacaatcgatgtcagaatttgaagtccttggggcgctgctgcctcttcctggctttctgagcgctctggatgcttaaaatcagagagttgcctgtatcgcacgtattgtcgtagcccatcagctttacactaagatccttacatagcaactctaacctacctcgatcatcgtcgcctgccagttgcagctgactggcctgctctcgagagacggcggcatataagtggaaggctttctggtgagcctccttctctgctgcagactcctgattcttttggtc

SEQ ID NO: 5321 - DNA, 516 bp, Hordeum vulgare
cttccctttccctcctcgccgtcgtcccagatggcagattgctctgctcagctcagttcagctcagggtctcctcctctcccaagaggccaggaccatccgcgccactatccccgcctggttcttgctccgccgcgccgtcgcgcgcagctgagggacaagaagcgagcaaaaggagaagtggatcgattggtcattatgcggcggtggttttgctgcgcacatgttgacacaccgtatgaggaaaatggggatgagtttccacacagtcctgaaagggcaaatggtaatggttttactcaaattggtgatcagggaaaagcacctccctccattcaagtacctgaattgtcatttgatgaactgaaagaaaaaacagatgattttgggtcaaaagctttggttggtgagggttcatacggaagagtgtattacgctgttctagagaacgggacacatgtggctgtgaaaaagcttgatacttcagcagaccctgagcctgacaatgaatttatcg

SEQ ID NO: 5322 - DNA, 549 bp, Hordeum vulgare
aggtataaaggcattattaaccctgagatcgaagtatgagaaaccaattacaaggtgaaaggaagcatcaagtactgcccgaagaacacataacacagaacaaaaaaaacgaagtatatgagtgaaaaagacacaaaataacaaattaactgcagtagtcctcgatgaccacaagaaatacgggcaagcagtacctgccagggtaaccaagtaaaattgctatcactttacatgaacctcgcattgcacatgttgtcatgtatctgaaggtgtgtctggagctcccggttgctgttgtggtttatttataagaaggggagacaatgctttgactacaatgctcatgctaggtctaaactcagactcgtattgcacacagagagctgccactgccgcgagcttggcaactccttttggagggtactctccatttaatcttggatcaacacattgttttaccttgtcctcaccaagccttggtgttgcccaggtaacaagactctgctgtccccttggcatcgtgtgatctactggtttccttccagttag

SEQ ID NO: 5323 - DNA, 96 bp, Hordeum vulgare
ctgatccggtccggaattcctcattctgttggcctactgaccgtgctccgtcagatgattctgaccgaccgggaataacttttctcctatagagga

SEQ ID NO: 5324 - DNA, 260 bp, Hordeum vulgare
tttttttttttttttttttttttttttttgccatctataccaccgctttctccacctttttctgtgtacttgaaaaacaaaaggcaaagataatgaaaaatcgcacttaatgggccacacattttcctttgagaaaaaagtgagacacacttcttgccacaaccaaaaaaaaaacttcgcttccaaaaggcccggcccaacgaaacctccttagtgccaccacgaaatgtacacagcccatgtcaccccttcctcccgtt

SEQ ID NO: 5325 - DNA, 1035 bp, Hordeum vulgare
  UNSURE (1)..(4),(12),(20),(23),(24),(26),(29),(30),(32)..(35),(37),(41),(44),(47),(49),(51)..(53),(62),(69)..(76),(82),(86),(106),(1035): n stands for any base
nnnnggtaaagnacctagantcnnantgnngnnnncnatgnccntgntngnnntttgcgacncccaaannnnnnnnttgttnggtngggggccccaaaacaccctntttttttttttttttcctccgtctctttttcttctcctggcgggcttctcccccttctctcctcttctccctttccttttccttcttctttctcttttctcttcttctctccttcctccccccttctttcccctcccccctgcgggtctcctcccccctcttttttctgttttctccccccccctttttcttctttccttcgccgcgttctctcgccccttctcgccttcttctcccttccctccttccgctccttcttcccctttctctttttctctctttttttgttctccttcgccgctttctttcactttatatccatcgccgtcctcttttttcgccgtatctttctgtatctgtccctccccccctctcccatccttcctttcctttctttcttcttctctgttttccctcttcccgcaattattcgtcccctagtccagctcctattccctccacgccgtttattcttctccccaccccttacgtctcctccgctcccctatctatccctccctccttttctccctacccccacttttttaacgttcctcctttccacgcacctccaacactcctcccactccgtcaattaccttcgtctgtctccttcctttttcttttcttctcttttttcccccttcctttttttaccctttgtcgacattttcccccctttccatccttgctccctccctttcttgtccctcctctctctccattcccccatttgccttcatctttccttttcatccccttccccctcccaccccccttctttcctactccccttccattccttttccaaacacccgccccctcactctcttattttccgccgagcctctattcctcgtcttgttctattccccttttttctctcttctcctttatctttcttctctcctcccttcccttcccctatn

SEQ ID NO: 5326 - DNA, 562 bp, Hordeum vulgare
tgtatatttacttttacgtagcatatacatcaaatacaatacatcatccagcgactccatgcattaaggttcaacgcgtaacaagggcacatcaaaatagttttacatgtgcacaacagaatacttgtgcaagtgcaactgtacataaaaatgacccaacaaatgcaaaatcgcatataaagagagtttcacaaagattggatgagaaccacaagtttcttcacatcctcttcctctgcagaatatgctcttgccattgccgccaggggctgcttccaataggtcttgcaggacttgagatttctcaccaacatggggcattaccatcaacacttggcaagagaaacaaacagcaaagcacatgtgagataaaattttccttcagcccttgcagcaccatcttctcgttctcattgtcctaccaacaaacaaaattgtgtccatttcagtccaaactgtagctgaaacaaagaaccaagtaccatattcagcaaacaaaaattgtgtccatttctgcaaaaaattatccccaacaatatcaggcttgtctgttgcttctttg

SEQ ID NO: 5327 - DNA, 520 bp, Hordeum vulgare
gcccaaccagctagcctgtatccgtgtccacggctacgatggccgtggtggccggcgagacgccgcagtcacgcggctgtatatgccgctcgttcgctggtactcggcccagccactacctgctaggcgtcctcgttgccttacccttccaaaggagctcctccatcgcctccactctccgcagcccagcctccacctaccgcagcagcaagtgctctcgtcgcgcggcggcggcggcggggaggatgtcatcggcgccggcgccggtgttcgagaggatggccgggatccgacccctcgccgagtccggccgcttcaaggcatggttcctggaccagttcggtgttcttcatgacgggaagaaaccctaccctggcgccattttggcattggagaagctcgctgggaatggcgccaagatggtgataatcagcaattcctcgaggcggtcgtctgtaaccatggagaagctgcagagccttgggtttgacacgtcttgtttcctcggggcgatcaccag

SEQ ID NO: 5328 - DNA, 312 bp, Hordeum vulgare
attgttttatttccggaaaacacataacactaacaatttagcgcggtcttgatgctctctttgacaattcaaaagagtatggttacgctggaccgctatcactatcctgattaaacggtgtaccgtgtttctaccatgcaaatgaaggcaaaacgtaagatgggtatgagctatgcttgtaacacaacgcactgatggcgtcatcaccagcagtttctctgaattcaactagtccaagttcagccgcatggatccctccagtgatgaacgcagatgccattcctgccccatttgcgcctttgatgtcgtggt

SEQ ID NO: 5329 - DNA, 517 bp, Hordeum vulgare
ggctcatgaaagtagaagtgtggtagaacctgcaactactgcatcaaaagattcaacagctgctagatctattgagaaagaggcagatgtttccacatctgcttcacaagctctccagaatgctcaaccagtgccaatcactgacgagcactataagaggagtaatgatgcacttgctgctgctagagaacgagcactggctcgtaagagagcgaaggagcagcaaatatgaagtaagatgcagatataatcgtaacatgccaaagctcagggctgtgtaatacacttgacctttgttttcaccctgcagcattttcagttgatgatgcacgtatctctcacgcataaatatagtcctctggttgctgtgtgatgattgagcttctatggtcaaaatatctgtatatcgacattcagcttctatgaccattctgctatgtataatcaggagatggaggttaatggagcccattgtatttactgaatatttgtgctcccaaaaaagagaaataccttg

SEQ ID NO: 5330 - DNA, 467 bp, Hordeum vulgare
tctgatacatcttttttttttggaaggctgcatagtttaaagtctctgattcaacacccaccagtaaatacagtaactactagctcgagtcgtcattacataaatgatgttataacctccactagctacagattacaatggaacacaccaaggggtacaggttgccatcaaggtatttctcttttttgggagcacaaatattcagtaaatacaatgggctccattaacctccatctcctgattatacatagcagaatggtcatagaagctgaatgtcgatatacagatattttgaccatagaagctcaatcatcacacagcaaccagaggactatatttatgcgtgagagatacgtgcatcatcaactgaaaatgctgcagggtgaaaacaaaggtcaagtgtattacacagccctgagctttggcatgttacgattatatctgcatcttacttcatatttgctgct

SEQ ID NO: 5331 - DNA, 367 bp, Hordeum vulgare
cagcagacccagtcttcctcctcatgactcactgtggaaagtctgaaactaacactatctacctagcagattcctgggcttcatggccgggtcggttttcatcaaatccagccggctgcaccaccaaggaagaatcacgaggaaaacaatcatacatacacgcagcgtgggttaatttgtggatgtggattgatgcttgcatgatacaaacccactgtacgtagagtataatagagtagaattggccagggatagtctttccgaaacagagacaagaaaatggggatagatatgttcaacaatcatgatgcaaaccttcaagatcgctgatgtgaagatgttattcaaaaaaaaaaaaaaaaaaaaa

SEQ ID NO: 5332 - DNA, 349 bp, Hordeum vulgare
catcagcgatcttgaaggtttgcatcatgattgttgaacatatctatccccattttcttgtctctgtttcggaaagactatccctggccaattctactctattatactctacgtacagtgggtttgtatcatgcaagcatcaatccacatccacaaattaacccacgctgcgtgtatgtatgattgttttcctcgtgattcttccttggtggtgcagccggctggatttgatgaaaaccgacccggccatgaagcccaggaatctgctaggtagatagtgttagtttcagactttccacagtgagtcatgaggaggaagactgggtctgctgctgaacccaggaatggt

SEQ ID NO: 5333 - DNA, 612 bp, Hordeum vulgare
  UNSURE (24),(25): n stands for any base
gtcccccgggctgcaggcgcaaannctctgtttgtttcagtaagagtgtaccacgccttggtctggagggaatcaaagaatatggtatggacaagctcattcaggtcgcagcaacccagctgagcgaccagcttcctgaatcaagggaggctgcgcgcaacctgtcattggagctacaagcattatatgagaagactcaagcctctggttcaggcgaagatgacagtgcatctgctatttcactggaagccgaaacctgggaggctttctgcctatctaagctttctgcattaaacgcacaagcaatcctccgtgtcactgtgggtgtccccgttgctcccaaagaaggtggcatcgctgctgccctgaaagaaggtggtgtccctgctgccctgaaagaaggtggcatctctgttgttgttgctcccaaagaaggtggcgtcccagttgctacaaaagaaggtgctgcggccatgggctgctagcgttgggagttggccgacacatgcgatgttgcgatttttccacatccgatttcacgtttttgctgtacatggtttatgggttgctcagtcggtaaatcgaatctcctttggcttgcagttcttcagg

SEQ ID NO: 5334 - DNA, 713 bp, Hordeum vulgare
  UNSURE (18): n stands for any base
gaagggctgtagtactcngcaaatgttgaacggtggaagagattctacattccctgactgaccaatcaatgccaaactgataagtagtgatggaaccaaaggattatacagtcaactataagggactatatctcgcaccaatattaacacccaccccaggcctcaagcctgaagaactgcagccaaaggagattcgatttaccgactgagcaacccataaaccatgtacagcaaaaacgtgaatcggatgtggaaaaatcgcaacatcgcatgtgtcggccaactcccaacgctagcagcccatggccgcagcaccttcttttgtagcaactgggacgccaccttctttgggagcaacaacaacagagatgccaccttctttcagggcagcagggacaccaccttctttcagggcagcagcgatgccaccttctttgggagcaacggggacacccacagtgacacggaggattgcttgtgcgtttaatgcagaaagcttagataggcagaaagcctcccaggtttcggctttccagtgaaatagcagatgcactgtcatcttcgcctgaaccagaggcttgagtcttctcatataatgcttgtagctccaatggacaggttgcgcgcagcctcccttgattcaggaagctggtcgctagcctgggttgctgcgacctgaatgagcttgtccataccatattctttgattccct

SEQ ID NO: 5335 - DNA, 418 bp, Hordeum vulgare
atcccaatcgccagcaattattattcccctcacgaacccctctcccccacttaccaaactccggctcccaacacccaaagcctccgcatccagagctccaaaccctaagcgaggcgaggcgcggcgcgcagagggagaggcaatggatcccgattcggtgtcgaaggcgttcgttcagcactactaccagacgttcgactccaaccgcgccgcgctggtggggctgtaccaggacggctccatgctcaccttcgagggcgagaagttcggcggccccgccgccatcgctggcaagctcggatctctccccttccagcagtgccagcacaagatcgataccgtcgactgccagccctcggggccccagggcggcgtcctcgtcttcgtctccggcaccatcaccaccgggcccggcgag

SEQ ID NO: 5336 - DNA, 284 bp, Hordeum vulgare
tttttttttttttttttttttttttttttttgccacgcataactaataccaggacggtttccatcaacattccaaagaaagtgccacccaagcaacgacaatacatggaaaacacaaaacaaaagatgatctggtggatgcctatcaagtctggccattttttgcgataaattgcacaagttggcaaacaaacaaagtctgcagcatcatcattcgatattcattgtttcaacataaatccctgatcaagttctttgctgccagagtggccgcccttccttaac

SEQ ID NO: 5337 - DNA, 518 bp, Hordeum vulgare
ccgttccacacttccgcgtcccaatcgccggctcgtccctctctcgaaccacccatcgcccagccgttctaatctctcctctcaagcgtagcaccgagtcgactccccacctcatcccaatttaccaaaccctaaccctagcagctcgtcccccatctcacccagcgcgcgcgcggccgccgcggtgggcgaccgaggatgccgtctgggtctacgcagttccggtacacacagacgccgtccaaggtgctgcacctacggaacatgccgtgggagagtactgaggaggagctcgtcgagctctgcaagccattcggcagggttgtgaacaccatgtgcaacgtcggagccaaccgcaaccaggccttcgtggagttcgcagatcaaaaccaggcaatttcaatggtttcatattatgcttcatcttcagaacctgcccaagttcgtgggaaaactgtatatattcagtattcaaataggcaagaaataacaaacaataaaggcactggtgattcttc

SEQ ID NO: 5338 - DNA, 557 bp, Hordeum vulgare
  UNSURE (57),(72),(73): n stands for any base
gagtattttccttttgttgtgcagtttacaggcaccaaaagccaccatacagccagnacatggtactatttnngcctcagggatctcacaaataacaagaacagatcagtgttacaatgcagttccaaaacttgaagaccacaagtgctgcacaaagcataggacactgctctatcagatgaatagctcattttgggaagtacattggttcgcctgcatgaggcagagcagcaggggctgtgccatattgtgccatctgttgtgaagcttggtacaacatcgggggagctccagagcttgatccgatcactggaaagtgcgggcctgggtttgccatcaataattgtgtaggatacgaggttgatgcacttgcaaatgcccctcgctgcatgttaggattccaggttggcacttgtccgacagaggtcgctcctgctgagcttccataaaaaccagcaggtgtggtgctttgccatactactccaggtggagcttgtacccgagcactagggtccaagacggtgtagtccctgctcctctcgtcatgtgccttcaca

SEQ ID NO: 5339 - DNA, 518 bp, Hordeum vulgare
cctcgtgccgaattcggcacgaggttcacgttctctgcgaggggaaggaggaggaggagaacggccaacccctgcgcgagacgagcctctacaagggcttctgaggtggctaatttcgagaggtacaacgtacaagaggaggagccatgaacggtggtagcaagcaaacgctgatatacagcttcgtggccaagggctccgtggtgctggccgagcacaccgccttctccggcaacttcagcaccatcgctgtgcagtgcctccagaagctgccctccaacagcaccaggtccacctactcctgcgatggccacacattcaacttcctcgtcgaccgtggttttgtgttccttgtggtggccgaagaggcactcggaaggagcgtgccgtttgtgttcctagagagggttagggaagacttcatgcagcgatatgggtccagtatcgatgaggagggacaacacccacttgctgatgacgcggatgaggatgatttcctgtttgaagaccggtttagc

SEQ ID NO: 5340 - DNA, 556 bp, Hordeum vulgare
  UNSURE (26): n stands for any base
tgtttcagcactaggtgcaacatggnatactcatcaagaggatccgaacaaaacaaggtccaggcaataaggttgcatttcagaatgtacagataatcaagtggcgtccccttctttccacaaagcttacacaagtactccagatccctatggtcttatatggaacataaggatggtctatgaggaattagggtctcacaccacataactgtgttcagaacatagggaaagcataatttggtggtcattgtatgcatgcacatgacacagtaaacagaacatcaaatgacaaggaaaaaagggcgaatgaagactctgaactctagcacttgaagcccctgcaaaccattagccagaggatgaggatcaaaaacgagatgccaccaccgaccatcagcttaaacctcaggttctgaagccacatcttgcgcctgagctctctgccatgcctatggaagctgtcagcctgcgactgtaaggtttcggtcttgcccaccaaaagttcaatcttctcgccacgatctaatatcttctcgatgttgtccatcatgatccc

SEQ ID NO: 5341 - DNA, 522 bp, Hordeum vulgare
gttgaacacttatgctcccactgcaaggcataaacatattttctatgtgattagtgtggcttttttcctctccttccgtggcaacgcacaggcgctaagataattccgatgagttatccctatgaagatctcgagcccgccatggtaggacaactttgaccatggagcggagcccagcgagcggggtccggcacgtgcggcaagtgattttttgttcttattgacgacttgttcctgcacatacatccggagaaagcagatgtatatgatgctgactttgagaggctgaactgaacaacgtagaaaaagaggctgaactgaatttggttgatatgaaaggattaacagcggatccacgggccaccatggtggtggtggtccgtgatatttcaagatcaaacggtgaggtaatatcgtgtagttgtgctcaatacttttggtttgtctgctgaaggatttatatgattacaacatctaccttatagacacacttgtttttttcttctaggcgaattcagtttg

SEQ ID NO: 5342 - DNA, 550 bp, Hordeum vulgare
gaagatgagtttattattaggactttaatgtttgcataacctgatcaatctacaatgttatagtttgaacccaccaaaataaccatacggaaatttccctcttatagggaaccattgctccagcagctggactacgcgcccgccaccatatcctctctcgaagaggcgcagaggtgcaccgcaccgtgcccgtcgtcttccattttgttcagcaacttcccttcttgaaagcacattctgaaggcagtgcgtggtgactcatgtgtgcgtgcaggtagtaaaggcggtgggtggagcggtcaggtgcatccatggatgactttctataggtgttcttcaggaactcgacaaagaatgatcattgtgagtaagcatcaatttttgaaataattagtgtgtcttatgttcagagctaccgaacaagaggcgatcacactgcttctgaatctttttctgagcacatcttggaaaggttgtttgtatctaacaggatacatgcaagcagaaatttacttatgtccaggctcggaaatgctcattggggaggact

SEQ ID NO: 5343 - DNA, 534 bp, Hordeum vulgare
ggaattcggcacgagggctttcttcccccaaatccccggaaccctagtgaagagaaggctcgagttcgacatggcgacgacgagcgagtccacagccaactccaccgtaacgagcgcgacagccgacggagatacagagcgtgagcaagagcacggcaatggtgcgactgccgcccctgcagtggtgcagcaggaggaggagggggaagaactgatcggtcctggccccgcgccggcgcggcagcggcagaagcgccctctccagttcgagcaggctttcctcgacgccctcccctccgcagccatgtacgagaagagttatatgcatagggacgtcgtcacgcacgtcgccgtttctcccgctgacttcttcattaccgggagcgccgatggacatctgaaattctggaagaagaaacccagtggaatcgaatttgctaaacattttcggtctcatctcagtcccatcgaaggcttagctgttagcgttgatggcttactttgctgcacgatctctaacgaccagtctgtcaa

SEQ ID NO: 5344 - DNA, 551 bp, Hordeum vulgare
aagggaagggaatttattacttccctccaatcgatatacaaagttgtaccaactcaacgacagttaatatggatacaaggagttgtatcaaacattttgcactaaccattctcatcaagttgcaagcttaacccgtgaacaaattgtaaacatctgttagctttcccctactaactttgagaaataattctgtccacagccaaagatgtgttttcccttctattgctttcctactacacacattaccccagaaacaacacctcttcttggagaattgaggaggccgcatttatcttaaaacagctcagcaaatcatcatacagcccgtaatgtagcaacccaattgattaaacgggagcttatgtcctgggaactgtaacattcaagatcttcacatcctgatacggcttgtcatttttgtcggtcttgaccttctcaatttgctgaacaacatccatgcctttcacaactctaccaaacactgtatgtttgttatctagccatggagttgccacagtggtgataaagaattgagagccattagtatttgg

SEQ ID NO: 5345 - DNA, 368 bp, Hordeum vulgare
cagctagcgcaaccttctcctccttgcctttcccaagcccaaaggagagcaactccttcatgtcccgccttgctccgatggccggcgaccagccaaacagcaacatccccgagcatggttgaccccatctccacctcggccatgtcgtccctctcctccatgcccgtaacaccttcccctgtttccttctctctcataggatctctcatctctctggttctctgttgttcgcatggaattggagcagccatggcgctgtgcgcccacgctggtgcccgaggcaagccaagtcgcacgagcttgcctcctcacgccaaagcctcctacctcatcggagcaccgcaggtccagcaccatgccccctctct

SEQ ID NO: 5346 - DNA, 508 bp, Hordeum vulgare
ctatagactgcttgtggaggataacagcagtgacaatataacatcaacatggcaaaatggatctaggaaagaattgaagttcagatcgaggggggaagattctcatggcggggaaacaatagggcgccaacgttcgggactacagcgcggtgacaggagtccacacggtcggggtcggagacgggcgtgaggactggattcgagggtgaccgtcccgttcccaatggcatcggggtggttgacggtgtgctccgggctgcaatggcgacgctgcatcaggagagaggtagggaggttagggaagagggagagataagagagagggggcatggtgctggacctgcggtgctccgatgaggtaggaggctttggcgtgaggaggcaagctcgtgcgacttggcttgcctcgggcaccagcgtgggcgcacagcgccatggctgctccaattccatgcgaacaacagatgaccagagagatgagagatcctatgagagagaaggaaacagg

SEQ ID NO: 5347 - DNA, 530 bp, Hordeum vulgare
  UNSURE (4),(25),(34),(36): n stands for any base
aggncgagattaaacaatacacatnaaaccctananaggagctgaagggcttgcaggagagagagactcatgctaaggctgacgctgaacatatttcaaatcagatggaagagctgaaagctgaggctgaagactggaagttgaagtcagatgaatgtgagacagcaattgaggaactaaagaaacagaatgatagtgttgctgctgcattggcaaagctagatcgtcaagtgaagttaaaggagggacaaatagttcaacttagatcacgccaacgggagattcatgagaagtgcgaactggagcagataaagcttcctacagttaatgatgcaatggacactagatcatcctcacaagaacttgtctttgattacaaccagcttagtgcaatctacctgcaagagaagtgtctgtctgaccgtgacaaacttgaggcagagttcaaacaaaaaataggtacactaatggctgagattgaacgcaccgctccaaacttaaaagcactggaccaatatgaagcacttcag

SEQ ID NO: 5348 - DNA, 516 bp, Hordeum vulgare
tgctgtagtcttgtgccgtttctacattaactacattccactaatcatatacacaagttgaaatacaggatcagttgatgacagttgttactatagattataacacgtaggaagactccaaccagagtggatttcatgcttctttatacttggtaaggtcgaaggtgagggttctggagcagcttctttctgaatcccgataaacaccaaccagtgcttcagctttgtcgtagaagctatccttcagcgatatgacaatactctgaaacccacaacctctgtcgtcatcttgctcttcgccagcacgttcgcatgactttgatcgaataaacccagcaaccttggcaacatttaaattatctagagctgcatcgacttcatccagtatgaagaatggtgatggcctgaaactgtgaatggcaaaaagcaatgccagtgcagcaactgtcttctccccaccggataactgttccatatccctaaagcgcttcgtaggtggcatagctgtgtacttga

SEQ ID NO: 5349 - DNA, 357 bp, Hordeum vulgare
ttccaattcgaaccagcgacaaaagccaagcgcaaggggaaagaagaagaagaagaagaagaagcctccaaaccgcgggcgatccctcccaagctcctcgcgcccttcgtccccgacctcgctcccctcccctcgctcgcctatatacatacgtacggaccagccactggttccgcggagcactttactttgagagcggaggtccccggcaaagaagaggaagaagcgctgcggtgtgaggaggctgcatcagcagagatggagtggctcaacgagtacgagaagctggtgatcgggatggacacccccaaggtggtcattgacaatgccgtctgccccacggccacggtcgtccag

SEQ ID NO: 5350 - DNA, 318 bp, Hordeum vulgare
tttttttttttttttgaagcaaagccaaccgtccccaaagaatttctagctaaagatggaggaacaacagcgaggaacagagaacaaatcatcatgaattgcacacactaaacaccggcagtccggcactagtactactgctaattagcaacatctaatcgtaatcggatccccttatgtgcatgtctactgctaggttccatcatcctgcttcttccagatcctgcccgaccctgatccttgcgcagcgcttgctttcctggatcttcctcagtcactgtacaagagatgattctggaatcgacgttgaaccaagcc

SEQ ID NO: 5351 - DNA, 550 bp, Hordeum vulgare
  UNSURE (12),(20): n stands for any base
gtcttcccgggnctgcaggnaattcggcacgagggatgaaggcatttttgctccttggtagaagaggagtttttgatggcacaatcgaaaatatgcacttgcactggaaatacagggaactggtgaaaatactggtgaaagcaaagtcttttgcagatgtcaagaggacagcgctatcacttgaagttgagagtgggggcgttttagtttctgtggacaaggtctccaaaggctatgccattgttgtgtttcgtgggaaggactataaacgtccttctatgctgagaccaaggaatcttttgtcaaagagaaaggctttagctcgatccattgagctacagagaatggaggccctgggtcgtcacattgaaaagttaaacagaagggttaatcagctcagatccgaactggtccaaatggaagacgtaaaggaccaaggagacgaggagctgtatgctaaactagattctgcttattcgagcgaggatgaagatgtagaggacgaggacgatgatgcttatatcaggagctttgacaacccaattgccag

SEQ ID NO: 5352 - DNA, 549 bp, Hordeum vulgare
gaccgtgaaatactcgttatttactactgtactgattgtctagctacatggctacatgtctagctacatgatccctttatggtgatgaatttctaatgttgtctactgcgtagaccgctacatctttagtctgattcagccccttcttctagccggtccctttatggtgacgagtttctaatgttatctactgcgtagatcgctacatctttcgtctgattcagccccttcttctaggggtcggtcaccatcagaaaaatccgaatacatgataggctgaaaattaccagcagaaattacagcgggctcgcagtcttcatcctcgtcgtagtctgaatattccacgtcattaacttcatcctcttcgtcgcagtcgccattatcttcagcggaatcataatcattgctataactagactcactgtcctcaatggcggtttcattttcatcatcagcagttgccctggcaattgggttgtcaaagctcctgatataagcatcatcgtcctcgtcctctacatcttcatcctcgctcgaataagcagaatc

SEQ ID NO: 5353 - DNA, 519 bp, Hordeum vulgare
ccgcttcgcctcgcgcccgcaccccagaaggtaagttaagaggctgtcctgagaagctcaaatggctcccaaagctgctgttgccaagaagggcgatgccaaggcccacgctgccaaggttgccaaggctgtgaagtctgggtcaatcaagaagaccgcaaagaagatccgcacgtctgtgacatttcaccgccccaagaccctgtccaaggccagggaccccaagtaccccaggatcagtaccccgggaaggaacaagcttgaccaataccagatcctcaagtaccctttgaccaccgagtctgcaatgaagaagatcgaggacaacaacacccttgtcttcatcgttgacctcaaggcagacaagaagaagatcaaggctgcggtaaaaaagatgtacgatatccaggccaagaaggttaacaccctgatcaggccggacggcaagaagaaggcctatgtgaagctgacaccagactatgatgctcttgacgtggccaacaagatcggcatcatata

SEQ ID NO: 5354 - DNA, 549 bp, Hordeum vulgare
  UNSURE (12): n stands for any base
ggctaacacgangtaccttcgattgcataaattatgaaagtgtgcagcgatatggtaggcaatagagcccactgaggccctttgacaagtacaactactcaaaactccaatacataagaaaccacgacacacgcgcctactgcaggaggctctctctgacttatatgatgccgatcttgttggccacgtcaagagcatcatagtctggtgtcagcttcacataggccttcttcttgccgtccggcctgatcagggtgttaaccttcttggcctggatatcgtacatcttttttaccgcagccttgatcttcttcttgtctgccttgaggtcaacgatgaagacaagggtgttgttgtcctcgatcttcttcattgcagactcggtggtcaaagggtacttgaggatctggtattggtcaagcttgttccttcccggggtactgatcctggggtacttggggtccctggccttggacagggtcttggggcggtgaaatgtcacagacgtgcggatcttctttgcggtcttcttgattgacccagacttca

SEQ ID NO: 5355 - DNA, 473 bp, Hordeum vulgare
ataaagcagtgaaggattttaacactgacccagaggttagagttatgattatgtcattgaaagcgggtaatcttggtctgaatatggttgctgcttgccatgtgatactccttgatctttggtggaatccttatgctgaggatcaggcaattgatagagcacacaggattgggcagactcgtcctgtcactgtctctcgtctaaccattacagatacggtggaagaccgtattttatctctgcaggaggaaaagagagccatggtcaactctgcttttggtgaagacaaatccagtgcccacgctacccggctcactgtagatgatctgaggtatctgtttaggatatgattggcaggagggatgataccttgttgcgttcctagctttggaaagtgttagagtggtgacaggcttgtcatccatgtctctctctgccctgccgtggattcagttttgtcatgttccgatcgg

SEQ ID NO: 5356 - DNA, 552 bp, Hordeum vulgare
  UNSURE (17),(19),(20),(26),(27),(38),(54): n stands for any base
acaaaatatacaatatngnntggagnnctctcctcttncctgtcgtcacagggnaacagagtacacaagaattctcctacaggggtatggcagttacactagaacataagtaagttacactagacatgctatagctagctggtcctctgatgtcacatgtaggaccgatcggaacatgacaaaactgaatccacggcagggcagagagagacatggatgacaagcctgtcaccactctaacactttccaaagctaggaacgcaacaaggtatcatccctcctgccaatcatatcctaaacagatacctcagatcatctacagtgagccgggtagcgtgggcactggatttgtcttcaccaaaagcagagttgaccatggctctcttttcctcctgcagagataaaatacggtcttccaccgtatctgtaatggttagacgagagacagtgacaggacgagtctgcccaatcctgtgtgctctatcaattgcctgatcctcagcataaggattccaccaaagatcaaggagtatcacatggcaagcagcaacc

SEQ ID NO: 5357 - DNA, 456 bp, Hordeum vulgare
gccccacaagaccgccgccgccgcccccgcccccgccccaggaggaggagaagcagcaggcgcgagaaggagatctcgcgaggggtcgaccgaccatgagggccaagtggaagaagaagcgcatgaggaggctgaaaaggaagcgccgaaagatgaggcagcgatctaagtaagctgattgaggtggtggtgatggtgtgctgtagctagctatgtttgtctttggctgcggctgactgcggatatactttcttggcacgatggcaccattcatcccatctgtcaactcgcttattccagaaacctgcactttagtaggcctgttatcgttgcttttagttgtatcaggagttttgctatcatgaccaatctatggaaccgtatgaacactgttttggagctttatttgctgctaatatttggccatcgagtatttcttgcgttggtttaaaaaaa

SEQ ID NO: 5358 - DNA, 445 bp, Hordeum vulgare
  UNSURE (21),(28): n stands for any base
aacgcaagaaatactcgatgngccaatnttagcagcataataaagctccaaaacagtgttcatacggttccatagattggtcatgatagcaaaactcctgatacaactaaaagcaacgataacaggcctactaaagtgcaggtttctggaataagcgagttgacagatgggatgaatggtgccatcgtgccaagaaagtatatccgcagtcagccgcagccaaagacaaacatagctagctacagcacaccatcaccaccacctcaatcagcttacttagatcgctgcctcatctttcggcgcttccttttcagcctcctcatgcgcttcttcttccacttggccctcatggtcggtcgacccctcgcgagatctccttctcgcgcctgctgcttctcctcctcctggggcgggggcgggggcggcggcggcggtcttgtggtgg

SEQ ID NO: 5359 - DNA, 510 bp, Hordeum vulgare
tctcaaaaccctcgtctcgtccgtcccccctccgccgccgccgccgccgccggtgcctagcaagatgagtcggcaccctgaagtcagatgggctcaaaggattgacaaggtttatatcacagtacaattgcctgacgcaaaggatgccaaggtcaacctggaacctgatggtgtattctctttctttgccactgctggaactgatgggaactcatatgaatcgaaactggatttgaatgacaaagtgaacgtcgaggcaagcaaagtaagtgttggtgtcaggtctatattctgtattttggaaaaagccgaggccaaatggtggaataagcttgttcgagatgatcagaaggcaccacacttcgtgaaagttgattgggacaaatgggttgatgaagatgatgatggtgctgatgttaatgttgatgggatggacttttcgaatatgggtggcatgggtggtatgcctggaatggaaggtttgggcggcatgggcggtatgcccggcat

SEQ ID NO: 5360 - DNA, 551 bp, Hordeum vulgare
tgcacaacactgagtccagaacattcagcatacaatgcaaacaatctcacaactcataatatgccaacagacggtacgatgcatagttggaaacaagtattaagtcaacaacttacacgagacaccaaccccaaccagcgagcagaatgtgtcttcagttcagcacgttcattaaaaaaatgctaggatacaatcgagtagggattattgagtggaatgctttcagttgctctgagctggtgggccagctttgccttccacctcctgggagatttgggcggcatcagccttccctgcgtcttgaggttttgacacttccccttcgtcgtcactctcatcctcaaactcatccatccccatagcacccaaaccttccataccaggcggcatgcccataccgcccattccgcccatcataccagccaaaccacccatgccacccaaaccttccatgccgggcataccgcccatgccgcccaaaccttccattccaggcataccacccatgccacccatattcgaaaagtccatcccatcaacattaacatcag

SEQ ID NO: 5361 - DNA, 518 bp, Hordeum vulgare
ggatccgcaagcagaagtaccttgaagccctcgacaggcatgatcgggccaaggcagtggagatactcgtcaaggatttgaaggtgtttgcctccttcaacgaggagctgttcaaggagataacgcagctgctgactctggataatttcaggcaaaatgagcagctgtccaaatatggggatacaaagtcagctcggaatatcatgctcatggagcttaagaagcttatcgaggcaaaccctctgttccgagacaagcttaatttccctccatttaaagcctcaagactgcgcacgttgatcaatcaaagtcttaactggcaacatcagctctgcaagaatcctagaccaaaccctgacataaagacactcttcacggatcattcctgtgctgctcctaccaatggagcaagagctcccccccctgcaaatggtcctcttgttggaccaatccccaagacagctggattccctccaatgggtgctcatgctccgtttcaacctgtggtttcaccatct

SEQ ID NO: 5362 - DNA, 553 bp, Hordeum vulgare
cactaggctgggagcaggaaaagctttcaaaggaagatggcaccaggtgaggagattaagattttgggggcaaaaaacaaccaagaaccaaaaactaatctagacatgccatcatcaatcaccacctgtggcaaggagatggtgtggacttgatacatatcacctcgtcttttctcatgaatctaaactgtttctttctccctatctcctagaagtcctaccattgtttagttgagcgctgagtcatctcatcggctgatcagacgcctggttgttagatgctgctggagctgatgacatgggcgggtgggctccgttatcctggggaggcgcaactccccactttgggtccgcgtccagtggctcaaccacatgaactgccccgtcgctcatgccaactgcaatctggttaggctccaagggatgcgcggctacaaccatggggtacacacttgccccgctagatattgaaggaggcacataggcagaaagtgcaatcctgcaacgcagcctaagggactcagcttcaaatactccaatagcaccatcacag

SEQ ID NO: 5363 - DNA, 406 bp, Hordeum vulgare
ccgggctgaggaattcggacgagggattttcttcctttgatgcctgcattttgacatgagaatgtctgattaccgcctgccttttcatcggcgagcttaatgctgataatcttgtgtggagcaaagcaagttgtccttttctctttacgcgtgcattcccatgatcagaacatgtttattcatgacttccttcttgattcagtgtttcaaaagctaagctcagtgagtattcagaaaagattgaagcactagctgccacgcttgcttctctagtgccagaaaatgaaaatctggttgatgagagtagagaacaagacagctcttatgaaagagaaaaggttgggagtccaatatccttatcatcaggattgcggaggagatcgatggctcaggtggaggttggacc

SEQ ID NO: 5364 - DNA, 555 bp, Hordeum vulgare
ggggaaacatctacatgcctttttagacacgaatttccagatacgaaaatgtgcatgaacaagaacatttggtatttcaaaataacagtgagccgatgcgttctccaacgggacatctttcttcagcaaaccgcctaacgatggtgagcaacagtgctcctccggaactcaagtttatcttcatataaggcctgttgacaagaccgcagaactatcttaacggctcctggtgacgcggttttcagtagccacggcgacatcaggtgatccgtatgagcagaaccaccatgacaaacatgcaggtcatcagaaagatgagcagccactggaagcaggttgtcttggaggccaccgagtagacctccgaggctcgcgccgttgcacgcccggtgctcgccaggctatgctccacagctctctcggtggaatcgaggatcttctctgtatcttgcacggactggttcattaaaaggctactctccttcagctggcgtgctaggtcaaccatttcgtcagttaaatcttcttgcagcttcctatgcttctcaatgtgag

SEQ ID NO: 5365 - DNA, 519 bp, Hordeum vulgare
ggccccacgcttcatcacacttcacgcatcacactcgtacgcttgtctacttcgtccccctcaccggcgacccacccatccactgatggcggcgacggcggccgctaggggcgccgcttctcgctcccctctcctcctccaccaccaccaccgactccctcaggttccatccggtgggggaggttcgctgagggtgggcgcgctcggggccggacgggataggagacgacgggtccggggaggggttagggttttcgcgcgctactcctcccaggcacaagacttctctagtcgactccaagatagagctggcgaattgccgaaattagttgaggatcttctccagacgtcgattagcacagggcctcgaggtgtctttaggatggggcaagggatccaagttctccttggggttggtggggagtggctaaacgacttctcgaagacagctaacacatcagaaggaattccagctcagatgcggctcggtttgctttctcctctttacctcagaaggct

SEQ ID NO: 5366 - DNA, 523 bp, Hordeum vulgare
cagttctagctggttactaagcttgtacaatgtcacttgtccatgtcttgcaacaattcctcaaatgatggacactagaaccaattcattctctggtctgcttgctggaagtgatgttaatcctctcatctctcagcatgttcatgctgggagccagcagtctcgtgtaccgatcaaaataaagaagctgcttcatgagaagagcgaattccctaggaaatttcagcccgtatgactcgctaacccttaccagatcaagaaacagtgcattcatctgcctctcgtctacaacaacattagcggatacagctgtagcatcagaacttcttgcagctgccactataatttcagtatccaactcctgtagcgatgagaatatcttttgcaagtcctttgcaaaggagtcaacatctatatcattccctgtagcacccatttcggaaagggccgatgccatagcattgtaatcctcagttgcgaaagaagccaagaagatctccatagcagcccatgtccttgagga

SEQ ID NO: 5367 - DNA, 517 bp, Hordeum vulgare
gaagtttatggcatcctggatctgctggctttgatatgcacgggaacctagcttttatggtctgtgatccgatgaagcttgcaccttctacacctacagggtatgcttctgcatcatcaattgcactccttgcatcaaagatggatgtgccaacacaatttgggatccccatccctgcagtatgtgaatggttaaaacagcactggagtggtagcttggaagatgttagcaagccaatgatgccccccgcacgattaatatctgctggacaacgaagtgaaccttcttctcagagtcatcttcattatattaagaccactgagcgagagggtggtgcattgtcatcatcgcagatgccagcaagaccgacacagcggcatgggtcatgcagttcagcatctgccaagatttcatatggtgaaaatgattctgttaattcacactcttttcaaggccaacgagacccggcttcacagatgcccagacctaaggagcaacctggttcagtcatggacat

SEQ ID NO: 5368 - DNA, 477 bp, Hordeum vulgare
gctaatgttaagctcaaagaatcgtcagcgcgtagataacagctagtgtacatttacaggatgcggctacaatgaaatagagatgccgagtggaactgactaaaccgaaatatgtgatgtctttgtatgatctggagagaagaaagcggggatcctatcaggtaatccacttggaggtgacttgagcactttgacgaggtttcatgggaatctgagacaggttcctctttttcatgttggaggagaccgtagggctgaaataaacctggcttttctgtgaaattgatgctgcttgcaagtgtggttttctcaaagggatgaatgcatgcgaccttgagggtggccctttcgaagattcaacacttttaggcgaatcccatttgctatggtttgcaaaactctgtgaccggccaactatctggggcctcttgtcctttggactcggaatgtttctgctttccatagtttccgcagagt

SEQ ID NO: 5369 - DNA, 518 bp, Hordeum vulgare
acaggttcaggcatagaccacactgatacaaacagcatagctacattggaagagtactccaaaccactaattgattacctcagtaaactccctgagaacgagaaggttgttttggtcggtcatagttgtggaggtgcaagtgtgtcatatgccttagaacactgcccaaaaaagatctcaaaggctgtatttcttactgccacaatggtaaaggatagccagaggcccttcgatgtgttctctgaagagcttgcgtcggcagatgttttcttgcaagaatcacagtatttactttatggaaatgggaaggacaagcctccaaccgggctcaggtttgacaagcagcagatcaaggggttatatttcaaccaaagtccttccaaggatatcgcgctggccaccgtgtccatgaggcccatccctttagccccgatcatggagaagctgtctctcacggcggagaactacggcagcatccgccgctacttcatccagacgctggacgaccggatgctgtc

SEQ ID NO: 5370 - DNA, 549 bp, Hordeum vulgare
  UNSURE (1): n stands for any base
natttaaattaaccatttgtgtagaacatttctctcacaggcccatacactatacctgtcccaaacttctgatgacggctcaagatttaattcacattggtaaaacatctctcacaggcccatacactatacctcatcattcatcacaaaagaaaaaaagatgtcccgcttcttcaactaactacattattttgatctctggctgactgactgactgaccgactccaattaatccctccctgtattcttctcctttagcaaaccgcaacctatgtgctactcgtttcatgtacacgcatggcattcggacggttacgatgacttctcggcgctctcctcctcttcttcttctagggtctttgctttgcccgggagcagcgcccccggagcttggatctgcacgatctccagcaggatcttgtggagggactgcggcttcgagaagaaggggcagtggtcgccgccctttatcttgaagatgccgtcgggcgggctctcccggaccagcttctcctggacgtcgggcgacagcatccggtcgtccagcgt

SEQ ID NO: 5371 - DNA, 519 bp, Hordeum vulgare
  UNSURE (5): n stands for any base
tgaanattttaataaatagtttgatttcttatctaaagagtgcatcgtttagtaggcgattcatttctattatgttatttcatatacatttttcatttttagtatgataaggatatatgttaaactcaatgataagacaagatgaaactttccaaatagaaagcgggaccgttcaatttcattactccatggaattaaaagttgaatttcatattttataacataggttatcaaactagcccgcgcgaatgcacgggttgacgactagtatatttaattttgtaaattgaataatggtgatggtgttgttagtcttgacgcttatcttctgttttgctctaaaccaggtgtagaacgatcagagactcctgcactaggagctgatatggttattgtgacaataagtgcagttgatgggtggactgaagatgacactaaacttatcaaacgtgtcatgattgataaggtaccatcagtttcattttctcaacaattttgttgatgatgtccggttgcctg

SEQ ID NO: 5372 - DNA, 526 bp, Hordeum vulgare
ataaaattcatagcatccatacattcaaaattccatagcatccatatatacatatagttccatagcatccatacatacatagctccatagcaaatataatacacaacgatacaacccaaatctaaagggcagtgacaacagtaatcccagcctatagatctttgaccccatccagaaaatgggttcaatttcattgcttgttctttggttaccctaccaggcttgttgagatcgttctatgccactgcatatgctgctcaaaggtcaaaagtgtcgaaaatgaccgaggaccagcatgattcgaaagacatcattttccaatgcagaatttgttgaatatgttgctcaaacagaaggcatgcaaaccatcaaccaggcaaccggacatcatcaacaaaattgttgagaaaatgaaactgatggtaccttatcaatcatgacacgtttgataagtttagtgtcatcttcagtccacccatcaactgcacttattgtcacaataaccatatcagctcctagtgcagga

SEQ ID NO: 5373 - DNA, 518 bp, Hordeum vulgare
ccaggatctacgcctgccttgccgagctcggcatcgagctcacacacgagccaggattccaccagatcgaccttcatagggatatatctggacttctaagagcacatccactttctcctctagtgtcacttcaccaccttgataatgtatatcctctttaccctggtatggatcgtgcaaaggcggttgaacatttcttcagtgcagctaatgctgacccagcgaggatcgttcaacaaacagtgtgctatgaccattcaagatcacttactgcttcagtagcatggggctattctgttcaggttttcaaaggcaatgtactgcttcctgacatccttgctgtgcaaaaaacctttgtgccgtggaaaagaggtcgcaatgttacggatgttttcatgtttaccaccaagccttatccaacagacgagtgcaaacgggctgctcttttcttcctaaaaagtatttcttccggtaaaggcaagactgaaagcaattacagtaggcagctgccccaaaaa

SEQ ID NO: 5374 - DNA, 549 bp, Hordeum vulgare
gggcgcatcggtttatattgataggatggggcttatccatatagctgcatacagtggggtttcagttgtaactgaggagaagatttacaggaggagatagaggagaattacaacagagaataaacctctaactactccctaacaactacagtactactcgtatatcatatgtgttcagttggagatcttctagatgcccttgacgtgcagccttcatacttcaacggatgctagataaaacacaagctagaaaacatgtcaaatataaaaacacatataaaaatggacacattgtattattttgggtattgacgcatcacagtatgttgctttagctctacagagacctaccgacacagacccaaaaagaagtgggacagtgtggtccgtatatatattatctataacaaaagaaaattaggtgtgttcgagaacatgctgtaaattatctactccagatgagtatccaatattattcaataatcactacgaatgcatcgcgatcaattcatcatccctgcatttcctgatgtcaatatccatggtgat

SEQ ID NO: 5375 - DNA, 539 bp, Hordeum vulgare
ggtctgcaggaaattcggttacgaggcgaccccaatgacaggacttcttccgaacacttatgtggtggatattgccatgccttgctgtgaagattacccgagagatgttccgcttttcccacatgttccacgagtcaatttggagatcatgcatcgtgctatttgcttccataatgtcatggatgtatttgaccacaattgtgttgtcttcctgcatgcttttcaacttggtttgcaatctacaagttatacactttgatgattacggcaaagttctagagcaagacgcggatcctctagtctatttgaaagagcacctgcagctccgccataatctctccaaaatcagtcacaggttccgcatgttccttttgctgctcttcttttctgttacagcaagccagttcgccattctctacaagacaacagcatacaacgggccaatcaatttcaccaatggtggtgatatagctgtatcttcagttgttcaagttgtaggccttgtcctttgtttacatggagctgctaaaatttctcac

SEQ ID NO: 5376 - DNA, 540 bp, Hordeum vulgare
acataactgggaaaaatgaatttgtgccttgtagatatcaagtggtaatacaagagcacatgtacatatgcacagccaagatcacttcgcatggcaagggagaaggatgctggcttcggtccaaaaactgtacacaacacaaccgagcccaacatcctacatacagtctagtgatcaaagggaacctatgtctaacaatagcatgctttgcgttagcaggaatcttgacattgctccaaagatcaagctccaaacaggaaatcatcaagaaataccaacctcgctgttctcagatccgggttcgttttagtcttcaagaaggatcaactttgccgatgtcggcaccggtcttcgcccgtgtggtgtacaacccctactatgtgtctgggtgtcacgtgtacaaaccctactatgtgtctgggtgtcacgctcttcaaaccaaaaccggaatgttaaagcttgcgccaaactccattcatgggaaactcatgtagctgttgactaacgttttcgctgggatcacaatggtcttgctgagca

SEQ ID NO: 5377 - DNA, 519 bp, Hordeum vulgare
  UNSURE (489): n stands for any base
tacccagcgcatcaccatggcggccacgctctcctccgtgtctgccttttccatcactgctccgtcgtcagggctcaggactcgccacttccttccatcctctcaacatcatcagccaagaagactgccttccatggggtagccttggtggacagtaggtggttgcacaaaggcggcgtgcggcgaaggctggtgcaggtgaatgccaaaaccgccggcgcggccaagaacatcgaggtggaggtagacaagccgctcggcctcacccttggccagaagtctggcggcggcgtcgtcatcaccggtgtggagtccggagggaatgcagcaagagcagggctcaagtcgggtgaccaagtgctctacacaagcagcttcttcggtgatgagttgtggccggcagacaagctgggattcaccaagacagccatccaagcaaagccagactctgtatactttgtagtaagcaggggtggtggtgatattgtngtgaagcgcctgcccaagaggccggcgccc

SEQ ID NO: 5378 - DNA, 552 bp, Hordeum vulgare
cccatcattattgaaattttctgttagatagagtcatgagaaatcggttgagcttgtcgatgcatggccagaacaaaatttctcaagagatgaaaaagcctattgaaggccatatacaagcaaagcccctatgccagcgatgccgataaccaaactgactatcacagtaagaggtggcagtgcgccgccaatgggcttcccagactctacgttgtatcttgcgaatcgcttctttggtgcattgcactggggacagccgtactcaccaggctgttcttcaaagggcttgggtagaaagtatatgtatccacaatcaaggcagatgtgtgttgctctagccttctgtgaatcagacaacttccggccaaaccgagggggcgccggcctcttgggcaggcgcttcacatcaatatcaccaccacccctgcttactacaaagtatacagagtctggctttgcttggatggctgtcttggtgaatcccagcttgtctgccggccacaactcatcaccgaagaagctgcttgtgtagagcacttggtcacccgactt

SEQ ID NO: 5379 - DNA, 515 bp, Hordeum vulgare
cgcccgcctggacccctccgagcgccccgccgtcgtgttcgacaacggcacagggtatagcaaacttgggtttgctggtaactccgagccgtctttcaccatccctactgtagtagctgtgaatgaatctttcttggaccaatcagagcagtgcagtagtgcaaattggttagcacagtataatgcaggtgtcatggctgatcttgatttttttatcggggacgaggctctgtcacatttcaaatctagtggcctgtacagtttaagaagcccaattcgccatggtcaggtgaatgactgggatacaatggagagattttggcagcaatccattttcaattatctacgctgcaatcctgaggaacactacttcctacttacagatagtcctgtcagtacgcctgaaagtcgtgaatgtatgggagaaattatgtttgagacctttaatgtccctggtctatatatttctgtgcaatctgtgctcagcctttctgctggatttgcatatctgaaaa

SEQ ID NO: 5380 - DNA, 548 bp, Hordeum vulgare
ggatccgtagcaaaaaaatagtaaggggaaacaagatagcgttagacagagcctgatacataacaaaactctttagcaactctctatctattctagtctagtcgaaaaaacaagaaaacaaggggggaaacatctttctgcttaacaacacaactggctacaaacaaacatgcacctggaacaggaagagaattgctgactatacacaacatgtcgtacagaacagagagagctacatattcagctacaaatctatcggcccagtgatggttgagacgagccgaaaggagaatcaattttgactctattctatttgaagaaacctagtaaagctcctacaaaaaaacgttggatacgtcaaaacttcagtacattcctttgaaaacggtgcttgttcggcagatgcttgctccatgctcctcgtaatcttcctttgtgtggcaacactcgaagaattcatggctggatgcagctacagaacccccgaaccaaactgcgtagctctgtataggatgggtgactacattgacctcaacaggattaacctc

SEQ ID NO: 5381 - DNA, 518 bp, Hordeum vulgare
gcgggcaccacgggcacaacgcacgcacgtgcacagcgcgccccgtgaagctcttcggcgtgcgcatcggcgacaagccaatcaggaagagcgtcagcatgggcaacctcgcgcagctcgccgagggcagcggcggtgccagggccgaggggtacggctccgagggcgacgacgacaaaccccacaggaagcgaggtgagtcatggtcagaagaggagcacaaaaattttctacttggattgaataaattaggaaaaggtgattggcgtggcatatcccgtaattatgttgtctcgaggacgcctactcaagttgctagccatgctcagaagtatttcattcgccaaacaaatgttaataggagaaagagaagatcaagcctcttcgatatggttattgaggatcctggtgaccagtcactctcccgttcatcgtcacaagagatgccgctctcccgttcatcttcacaagatgtagaagagttggtagatgatctacggcctgttactgctcctgtg

SEQ ID NO: 5382 - DNA, 545 bp, Hordeum vulgare
atgataacagataagctcatcccttacctcatcacaacaaactgtgcatcttatacttcagaaggtgcaaaaaatgagagaatcaacgtgaatttgggcaaaacacaaatgcaaccttcatgacagactaacagtaaatttactatcggaacatgaccaagaaagctatatcatgattttactatcatagctaagggttacatacacattaaagaaggtcgagccacagaatcattttgtcggtattggtccgtttgatgagccgttcccaggcccttttccatggaaagcagattgcctctctggtctcccattcggatttggaggcaacggcaagttaggcgcaacaccattgctacttgagtcacccttcaggttcagttgggacatgttgtataggtcttcgacatttaccgggggaactgagtggacggcaacaggcctgacaggctcatgtgatacttgtactgtacctgatgatgatgcttgcatagagactggcggcccatagaacactggagcatagctatagtatggaaacggaa

SEQ ID NO: 5383 - DNA, 553 bp, Hordeum vulgare
gtctccccggggctgcagggcgtcaacatgtgcaagatccccacgcagagcttcttcaccgacgagttcggccttcccctcaccatgaatccaaactttgaagacatgagctgcgaaatgatatatggtcaggtgccccccccactggaagaagatccagtgtcaaaacaaccctgctatcccagcctctgttccatatcgacgccctccgcagcaatatgccccaaaattcagaactagagaaagcaacgaaaacattcctgaattcagatcttggtcgctttcagtttcttctgcaagcgctcacaagggttttgatacataaataattgtgcatggtatccgataggccagaatttcaacagggacaatagatagtgcatcggtaaattttatacactcaatgtatataatgtagcccatatcttacaggaaatgcaagggtacatcatccgaacaactactactaattttgtaattgctgcatcttttcgccgcatgactagagttttcggctgtctatctttttgtaataaagagtaaaatatgtcta

SEQ ID NO: 5384 - DNA, 553 bp, Hordeum vulgare
gtagaacatattttacttctttattacaaaaaggatagacagccgaaaactctagtcatgcggcgaaaagatgcagcaattacaaaattagtagtagttgttcggatgatgtacccttgcatttcctgtaagatatgggctacattatatacattgagtgtataaaatttaccgatgcactatctattgtccctgttgaaattctggcctatcggataccatgcacaattatttatgtatcaaaacccttgtgagcgcttgcagaagaaactgaaagcgaccaagatctgaattcaggaatgttttcgttgctttctctagttctgaattttggggcatattgctgcggagggcgtcgatatggaacagaggctgggatagcagggttgttttgacactggatcttcttccagtggggggggcacctgaccatatatcatttcgcagctcatgtcttcaaagtttggattcatggtgaggggaaggccgaactcgtcggtgaagaagctctgcgtggggatcttgcacatgttgacgcctgcagcccggggga

SEQ ID NO: 5385 - DNA, 518 bp, Hordeum vulgare
gtggagagggcagttgctgcccctgtgaatcgcaggcgtgctccgaatggtgtggcagagcaagaaccaaggagtggtggcatcagagctgaggcgaagccaaggatcatagatgtgccgaatggagtggtggcggagcacgtggcggctggctggccgaggtggctcacggaggtggcaacagaggcggtccgtgggtggcagcctcgcaaggcagagtccttcgagaagttggacaagatagggcaaggtacctacagcagcgtgtacaaagcacgtgatcttgagaatggaaaaattgtggcacttaagaaagttcgatttgccaatatggatcctgagagtgttcgatttatggcaagggaaattcacatcttaagaagacttgataatccaaatgttattaagcttgaaggtttggtgacatcacgcatgtctagtagcttgtatctcgtgttcgaatacatggagcatgatctcgcgggacttgctgctacacctggcataaaattcacaga

SEQ ID NO: 5386 - DNA, 425 bp, Hordeum vulgare
gttaatttgatttatttctcttggccctaccaaaccaggtgtaagaatcaatcatcaatcctcaaaagagggtgggtactcatctctgagatatacaattggtgactgtgtgtgggcaacaaattttccagcgaatatctttcttgctaaacttggcgaaaatctctacaggagcaggccttcttcagttcttcttctgctgctgccaggaaccaccaatccacggcgcaagcaatggtgtgggagctgccggcacaactaacctctccgctcgagggggcgaaaaaaataaggggatcatacactactttccattgccgaagccatcaagaacaccgagccgagcttcgcggcgctatgacctgccattatgggcagcgtacagcagcgactccgactggtctctctcggcgtgcttgcccttt

SEQ ID NO: 5387 - DNA, 510 bp, Hordeum vulgare
ccgccatcaacgcctacaccggggctatagctctctgccaaaatgttgcagtataccggaccaaccgagcactgtgctataagaagcggaatgagtgggctaaggttgaggaagattgtagaatggctatccattatgacagccactccgttaaggcacattacatgcttgggcttgcacttctcaacaggcaagaactggctggaggaataaaagcactagaaaagtctttggagcttggaaggggtgcacatcctgcaagctatatggttgaagagatatggcaagagctttctaaagcaaaatacattgaatgggaaggcctatcaaaaatgcgattctctcaattgaataaactgaacacaacatgtaaaaaagctctgaagagttataacagccttgatagtccaactgcagacgtttctgaagagcaaataaatgagctagatgaagttttcaggaaagctgcaaaggctgatactccaacagaagttcctgaccatctgtgct

SEQ ID NO: 5388 - DNA, 550 bp, Hordeum vulgare
ttgctaaaccacatgcctacttccttaccatgtacccatgacaaattctatgcatgatccaatccaatttaacaacactcacagtatgtacaacttccttgatgtcaacaagaaaacaacagaaccatgtactgccaatcttacttccaaacaaggtgtaccctaccaattcaattgtacaaatcaatcacctgatcttgtaagcccaaccatgttcattcaaaaatacatctacagcctccttgacggcgaggtttgatattagttggtgtggttccagtgcttcacgggtcacagggtcaaatttccccaccctatttaaatggtcaagaatcacagccctctcataagtaattccgcttggagtgatcactggatccctgaagatatcaagtgtaattttgcagcacagatggtcaggaacttctgttggagtatcagcctttgcagctttcctgaaaacttcatctagctcatttatttgctcttcagaaacgtctgcagttggactatcaaggctgttataactcttcagagcttttttacatgt

SEQ ID NO: 5389 - DNA, 964 bp, Hordeum vulgare
  UNSURE (14),(21): n stands for any base
gtgtctgactgaancaaaganccacaggtctgcaggccattacggcacgtgggttttttttcctcaaaaatttttttttttttttttttttgggtttttttttttttaaaaatatcctttttttttttttttttttttttttttttttttttttttttttttttttttttttttcccccccaacaaaaaaaaaacaccccaaaaaaaaaaaaaaaccccaccaaaaaaaaaaaaaaaaaaaaaaaaaaaaaaaaaacccacccacaaaaaaaaaaaccgcccccccccccaaaaaaaaaaaaaaaacaaaaaaaaaaaaaaaaaacttaaaaaccaaaaacaaaaacaaaaaaaaaaaaaaaaaagaggggggcgcccccccccccaaaaaaaaaacccccccccccaaaaaaaaaaaaaaccccaccaaaaaaaaaaccccgcccccccccctccgggggggaacacacccaaccacccaaaaccgccaggggggggaggggaaaaaccccccccccggggcaatcactttcggaagccagggaccccccccccccgccccccccggggtggggaaaaaaaacaaaaacaaagggggcctccacccccaaaaaaaaaaaaaccccccctcccgtacaagcaaaaaccaagaccccgacccccggcccggcggcccccacttcttcacgctccccccccacccgcccgcgcgacccggggcccaaccaaaccaccatcccccgccctaaaaccctacgccccccccctgcccccccgcccgttccgtcgcttgcatccccccccctacccgcaccccaccaagaccaacacacccccccccccccccgcgcggggtcacaaaatacaacagcaccccctccccttgcccccccccccccgctctaacccgccccgggtgacactaaaaccaaccgaaccgtcatcacgcccaacccaccaaccg

SEQ ID NO: 5390 - DNA, 548 bp, Hordeum vulgare
caaagaaaatgactttgtaaaattataagtttgacttacaacacagctcaaacttaaaataattcagaaccaaacatgtacattttagaacagctgggcactgtacaaatttacaaatggcaaacacagcaagaaaatcatagatcttttcatacacaattgccaaaatgcatttcttaaacagttgggagttcactactgtcaagaagaaagacaccaaacccaaaataagaacagttcaaactacaaataaacattgccacgttcccctttcgggtgactaactccatatacacccatattagccagtgttaatggaacaatctgctcaacagggacgtatatatgtcaaagagtgtctatgccaagtgccaccagtctcactgcggaagttaaccagaagcaagagtaggtgatctttgctgagaaaggaaacagtttcccctttgcgaaacacagaaataaaggatcaagcttcacatgggagatgctagaactttcttaagggctctcagacttgggttgcagcaggaatgaaggtaagaaag

SEQ ID NO: 5391 - DNA, 517 bp, Hordeum vulgare
cgagcacgcccgacggtgtcgaggatgctccttggaggaatgactgtcataggtatctacatatggtcttctgaaggctcgttcaaagctactccttctgctgttttatcacaggttattagagtggtttctcagtcagttccctggtacggcagtgactttgatgagaggctgctccttcatctctcttacagcccaagaaggtgggcctgtcgcatatgtgagatggcatcaggaagcctaaggccgtgtgacctcaaatatagcaaattattagcttcacttcaaactttcagatgcacatacaattttgagataagattaacagtacaagctgctgagccttttaagaaggttctttcaaaggcaatcagtcatctcacaaaggaagtgcagaatgccaaagccttaattgatggagatctgttttcggatgatatggccatcacttcagaaggcccacacgcagtcgatttgcttgtacctttcaagaacaatttgcctgccggagaatgca

SEQ ID NO: 5392 - DNA, 540 bp, Hordeum vulgare
  UNSURE (4),(11),(12): n stands for any base
tgtncaccatnncgtcgaaaaggatggatcatgttcatgtatgtgcagcacctacaaactgttcattgtgaaagaaactctacacttttcacctccagagttaagaggtttggacaaaatgtaagatacacaaaacatagcaagaattactctcaggttttcgagttggcagggaacgcgaacataaatccaagtagaagagccaccaggagcacaaacaaggcagctaggatgctgaaaccgttgccctgtgctctccctgaacacatcacctgtttagggcgcccatcttccagactgggccccgcccacacacgtgaggaagctccaggcaccacatcccaaaatgattctagtgtcgcactagatgctgcggtttctggttcaacaatggaggagttctccacttctgtttccagtgatatcacttccttgcagcgctccattgcgtccttcgttgtctctgattgttgcaagtagtcacaaatataggagccagctaaccaaggaatcaggattcttctagggaatgagaaacta

SEQ ID NO: 5393 - DNA, 519 bp, Hordeum vulgare
cctcgtgccgaattcggcacgaggagaagacccagcgccagcggcgattgatggcatctcgcttccgtgcccccctggccgtggccctgtcccctctccctctccctctccctctctagaccaaatcatcaacaagagagggagagagttcctcccagtggagagaggacggaggagtataagggctggttgcggctgcggctgcgactgcgactggtggatttcatttctgcccttcttgtttcggtgtggtggtggcggcggcggcggcggcgggcggcgcggccatggccaagcagctgcgggtctaccaagtctggagaggcaacaacataatctggtgtggtggaagactgatctttggacccgatgccaaggctactctgctatctttctcgctgatcacggcccctgttgttgtcttctgcatctttgtgggcaaaaatctcatacacatctttcctgcatataatgctgggtatgcaattctggttgttaccgtggtcctgacaattcatg

SEQ ID NO: 5394 - DNA, 558 bp, Hordeum vulgare
catgacaatattgttcctgaagaagcatttagacaggagaaataattatacagttcaatggtctacagctatggaaattatgtacaattaacaaacccacagtctgactatcttcagatactcttcctggaatcttgcaaacaaaagaaaattcctacaatctcttaaaaccttcataaaatgcataactgatatgtttacagaaagagacctatcaccaatcaatcaacattccccaaatcctacaaaaggaaggcagcagagagcatatgccaaattcgtccagagtttcaacatcccgcgagtttcaacatcccgccgccctcactgacaagcaacttgttggtttgcgccctgaaaactatttctcactgcaacgacacgctcatatacaatcaacggagttcattggggcgctgcttctgctcaggagacgagagatgtgcagcgttggtcactgaaaagaagtccagatccctagtttgatcggagctctcagtaatggttctggtaataaccgggatatcagtgtctgaatcacttctgcgatatcttgca

SEQ ID NO: 5395 - DNA, 531 bp, Hordeum vulgare
  UNSURE (16): n stands for any base
gtcccccggctgcagnattcggcaccggggccgacggcaacgagtgcacctacggcgccggctacctcaagcgccaggccgtcttctcctgcctcacctgcgtgcccgacggcgtcgccggggtctgcaccgcctgctgcctcgcctgccacgacggtcatgaggttgttgaactttggacgaagcgaaattttcgttgtgactgtggcaactcaaagtttggaggtcacctctgcaaacttagccctgagaaagatcctgaaaatccagcaaattcttataatcagaacttcaagggttcctactgcacatgcagtaggccctatcctgatccagaagccaaggagcaagttgaaatgattcagtgctgtatttgtgaggactggtttcatgaagatcatattgggcttgactctttggagaagataccaaaagatgaggaaggggagccactgtatgaagaattcatatgccatcaatgttcgcctgtttgttatttcttgaaactctatcctgatatgatctgggctt

SEQ ID NO: 5396 - DNA, 552 bp, Hordeum vulgare
tggagacacatttttgggcataggaatcacacaaagttctgatccaaatgaacattgcagttcactccaccggtcgctcggatcactaccacgagctgactttgaaacatctagcacaactacgatgagcattacagtactagataaacacgccgtggtggccacagcataagttaacagtacccacacaagacggtggccagataacagttggaaagtttagcttagcagcagcggggcattaggctcaactcaacccgctcaagcaaaagacctggagcaattgatgctcaggataacctctgcttcttcctagcaagattcttgaaaatagattgtacgtcatcagatgtgactgtttttgatggatcaaaggattccatgaaggattgaaactcatttttcatgtcattgatgccactcagaatctctatcttctggacatggtcaagtgaattgatgaaattagcttcagctccttcctgctgttccaacttcttctcccttttctgcttagctatcttctcgtattcctcaatagagtcctcctta

SEQ ID NO: 5397 - DNA, 551 bp, Hordeum vulgare
gtcctcccgggtctgcagggaattcggcacgaggccgcaggactgttctcctcgtctcatctgaagtccgttccgccgccttcgcctccacctccggctgctgctcgccggcgaatttccagaatcgtatcctcgtgcgcgcaaaccataggtaccgttgcccgcagagcaggccttccctaccctctaaggctgcattacctctacgaaatgccatggccttcctagcatcctagctagggtttgctctgcctcccgctcttgccgtcgccgatgttcgaggagatggcctccgattccagcatgggcacggggacgggcttccaccagggtgcctcctccttgcaccacctccatcaccaccaccataacatgctctccttccaatccaatcccgactccgcccccgctcctcccgtcttcctcccctcccccaacgctcccgtgctccagggggcgccgcccaactacaagttcgtcaccggctcaccctccgactggaccccctacgagctctccatattccaggagggcctcgccaggtatgctcg

SEQ ID NO: 5398 - DNA, 388 bp, Hordeum vulgare
  UNSURE (19): n stands for any base
ttcgtgcatcatcatcagnacagtaaaacgtctcatgcggcgaccacacccgatatttacagccatctgaatcaagtcagcccccaatacaacacaaaaggatgataaaccacaccctcacctcgtcccattttacattcccttcactttcccaagaatcaaggatcgacagccagcggccaaagcaattagctcgcaccaaaaaaggaaacaacacattcctcgaaggcaccatttcttatttcatgccgccttggtcagtataacatctaattctacattgtaggtcttcttcgtggcatttgtacagatcaggcaaaagctcatgtcatcttttttcgctacaggatggttacctctcatcactcccaatttatcttacattaac

SEQ ID NO: 5399 - DNA, 522 bp, Hordeum vulgare
  UNSURE (6),(7),(16),(17),(32): n stands for any base
ggtganncggtgatcnngctcgtcgccagggnaagaagcaggaggccctcgagaggcttggcgctgacgcgttcgtcgtcagcaaggacgccgacgagatgaaggctgcggtgagcaccatggatggcatcataaacacggtgtctgcaaacatccccatggcccctctcctcgggctactcaagcccaacggcaagatgatcatggtcggcctcccagagcagcctatcgaggtccctccctttgctctggttgccaggaacaagaccctggccgggagctgcatcggcggcatgagggacacccaggagatgctggacctcgcggcgaagcacggcgtgacggcagacatcgaggtgataagcgcggagtacgtgaacacagcgatggagcgccttgccaaggctgacgtcaggtatcgattcgtcatcgacatcgccaacaccctcgacaaggccgccgctgcagccacaaccgagtgaccgccgacgtaactctaagcgctgctcgcggtctacgttg

SEQ ID NO: 5400 - DNA, 540 bp, Hordeum vulgare
  UNSURE (8): n stands for any base
cttaaagnacttatatttaggaacggagggagtacatcactgacaataattttcgactgttcaatgttactagtactactgataaagtatgtgataacagcagagaaccagagaccaacgtagaccgcgagcagcgcttagagttacgtcggcggtcactcggttgtggctgcagcggcggccttgtcgagggtgttggcgatgtcgatgacgaatcgatacctgacgtcagccttggcaaggcgctccatcgctgtgttcacgtactccgcgcttatcacctcgatgtctgccgtcacgccgtgcttcgccgcgaggtccagcatctcctgggtgtccctcatgccgccgatgcagctcccggccagggtcttgttcctggcaaccagagcaaagggagggacctcgataggctgctctgggaggccgaccatgatcatcttgccgttgggcttgagtagcccgaggagaggggccatggggatgtttgcagacaccgtgtttatgatgccatccatggtgctcaccgcagccttcatc

SEQ ID NO: 5401 - DNA, 544 bp, Hordeum vulgare
  UNSURE (4),(11): n stands for any base
gggnctgcagngaattcggtcacgagggcccaatgacacatacagtgaggatatctattggctccaactgcgctcccagcagctgacaacgatgagcggcaattcaccttgcgtcccgtagtggacatacacttaaggttgacggacctctagatggtgtacaccaatgacccggtctcggttgagaactgcatcaacgctatggagcagtcgtatgttgaggacaaacacaaaatggttggcttcaacctccaatacaccagcggtcatgccaagtatgatcaaaaggctgtcattgcccagttgtgcgtgtgccataacatccttgtctaccactactgtctggccacaagggcttgcggtttcgccaggtttctcaacagcaccgactacaggttcgttgtgatggacaccaccaacgatgtaaagatgctcaagactttgagcatggcctgctagaaacttctcgacatcaggaacagtacagagtctggggagaaataaggagaaggactccctatttgacctcgccgttgccatcatt

SEQ ID NO: 5402 - DNA, 529 bp, Hordeum vulgare
taaacatccaattacataagctgactacacataacatttgcacacctcaataaacaattatatgtacactaaactaggagaaatgatcatcaagtcacctaattcttatgacagttgcctccaatgctctacttgtgcctcaatccatcgctgtttgtaggacagaggcacttctccatgtcaatgatccgcgtgtacatcttgtagcatgtgtacccatccttggacgcatacttgacgtgaccttcatatggtctttgcatataggccctgtcctaggcaaccttgttcttgttgcaatcatccctcatgttctatagtaggggtcaatgatggcaacggcgaggtcaaatagggagtccttctccttatttctccccagactctgtactgttcctgatgtcgagaagtttctagcaggccatgctcaaagtcttgagcatctttacatcgttggtggtgtccatcacaacgaacctgtagtcggtgctgttgagaaacctggcgaaaccgcaagcccttgtggcca

SEQ ID NO: 5403 - DNA, 518 bp, Hordeum vulgare
ggtgaagctctgattgtcatagcagagtttctggcagatatgtctttccgcagcatagtccgcgatgttagagagagcttcggaagcttatcaaggcggggctttgaggtgaggatttcaggcctccctggtctttccggccatcatcaccgggggaagtctttcgggccaccgggtgagctgcacggcggagctgtggtggctgaccagaatggctgggttggtcttcctcctgaattacttcgtgatgtgatgaaaaggctggaggaaggcgagagcacttggccctcccgcaaagatgttgtggcttgtgcggctgtctgcagtgcgtggagagagatctgtaaagatatagttcagagcccggagttctgtgggaaactcacttttccggtgtcgcttaaacagccaggacctcgagatggattaatccagtgctttattagaagggacaaatcaacactaacctattatctctacctgtgccttagccctgctgtgcttagtgagaacgggaa

SEQ ID NO: 5404 - DNA, 553 bp, Hordeum vulgare
  UNSURE (25),(26): n stands for any base
catcatttcaaagcatgtttatatnncttttgctgttacaatgtacagagaggttcagaggcataaaaaacgtagcaacgaccaaacctttagactttttgccattcttgacactcaaggaataaataagtaaatcaacaacagaaacataaaaaaatagatgttgatatgacacataaatacttgtgctactggtctattcattcacacgccagcttggtgtcaaagctggtcaagcagatggcgaacgcctggaacgccgagagcgggtaccgatagtccatggtgaacatgtccttggtaaccttaccgaactgcaggatcaccttctcgtgatcggacgtcgaagacgatgaggaactcgaaggctggagctgctgttgctggggcggctgcgaaggttccgacggcagcacagcagcggccgtcacctgtggcatggctgctgtcagctggaagttcttcacggaggccaccgtcacccggcctcggaagttgaggcaccagcactgcagctgttcgtgccatctcggcaccttgttgcggaggacca

SEQ ID NO: 5405 - DNA, 300 bp, Hordeum vulgare
aaaacgaagctcgagaagcactcaggatggttcggctgtggagacaaggagcaaggggcattgaagatggatagctgaacatcaggtgctctcatttggacataatttgttggagacaacagcagttgttaatctggcttaggcgcatggggactgtcagttagccttgtgatatacatatacaattggtggtgtatatacgaaaaacatgcatagatagaattgacccgagagagggaaagacagaggagataccagcggttaataaatgtacatcccacatggagctaacaaggggaa

SEQ ID NO: 5406 - DNA, 547 bp, Hordeum vulgare
  UNSURE (26): n stands for any base
cctttatggcttatgccttatggganccacaaagtagcagcacatgatctgttccgaatagagccttctcacaaatatacaaagcccacactgtacccaaagattgaatcattacaggagaactcatcgatcttctctcaactacactcctaacaataccaaatcattactaatatatgacccaaatcacagtgcccggctgagctgagaacgaagacaagagcaaaaagaccaaacaccacttgctctacaaaccctacaatctattaccaacactaacgtgatctgatgggtgataatgatgtttgacagaacagatggccaccttttcttcctttctatatctcctcttttatgtggcagggtgacctggatgaacaggctcgcctcctttccccttgttagctccatgtgggatgtacatttattaaccgctggtatctcctctgtctttccctctctcgggtcaattctatctatgcatgtttttcgtatatacaccaccaattgtatatgtatatcacaaggctaactgacagtccccatg

SEQ ID NO: 5407 - DNA, 448 bp, Hordeum vulgare
taatcccgagtttcccaacaacaccccaccgagctctcctgccacgctcccccgtgcccgttcccgttcccgcagagctgccaccgcccgccatggccgccgccggcctccgcccgctcgccgtcgccctcctcctcctcatcgtgttcgtcgcctccgccgtcgacgccagggtgggcgacgagtgctccgccggcgcgggctgcggctcggggctgcactgcgccgcctgcggcgacggcggggccggcgtctgcgcgcgcgccacccccgtcgaccccctcacgcacggcaccggcctccccttcaacaactactcctggctcaccacgcacaactccttcgccctcgccggcgccgtctccgccaccggcgccgccatcatcacccccaccaaccaggaggactccgtcaccgcgcagctcgagaatggtatcaggggcttgat

SEQ ID NO: 5408 - DNA, 429 bp, Hordeum vulgare
ttttttttttttttttttgatttcttaaaaaaaagcatatatgaactggccatgtggaaatatatcagaactccaaggaaagagacccttttttttagaaaagggggctgagccccggccaaggaaggaaaccctagataacaaaaagatgaaacatttgatttacaactcattgatcagtggaaccagaccgtccagttccagatcctctctgtaagctaagggatgatttacagctggagcaatctcgcgatcaaccaatgaaactcaagtagaaatttctgctcaggatggcagaagcagcacaatggccacacctaactgaagcgcagcgcccttacgagaggaagagcagagccagggacatcagtcccaggaggcagctccactggaaggccggaaggcgagccaccgccgcattgggatcgc

SEQ ID NO: 5409 - DNA, 986 bp, Hordeum vulgare
  UNSURE (8),(11),(14),(18),(24),(25),(30),(38),(50),(51),(60),(62),(65),(76),(87),(89),(92),(94),(101),(106),(113),(118),(120),(121),(126),(128),(131),(138),(147),(151),(154),(156),(158),(161),(163),(165),(175),(179),(184),(186)..(188),(193),(196),(199),(202),(205),(209),(211),(216),(218),(219),(221),(226),(230),(233),(241),(244),(248),(250),(251),(254),(263),(272),(276),(278),(293),(300),(302),(305),(309),(315),(328),(331),(334),(337),(338),(342),(344)..(346),(359),(362),(365),(368),(372),(378),(381),(383),(386),(390),(391),(394),(396),(402),(405),(407),(416),(419),(425),(430),(433),(442),(451),(453),(454),(458),(463),(476),(480),(484),(489),(497),(512),(515),(520),(532),(540),(547),(566),(577),(593),(601),(607),(618),(635),(646),(656),(658),(670),(673),(678),(693),(698),(699),(701),(704),(709),(716),(717),(732),(734),(737),(747),(749),(764),(767),(774),(780)..(782),(786),(787),(792),(797),(800),(816),(825),(832),(853),(864),(875),(876),(887),(889),(890),(900),(909),(913),(917),(918),(919),(921),(923),(925),(928),(932),(941)..(943),(951),(953)..(955),(963),(969),(970),(983): n stands for any base
caaaacanaanccngtgnccccgnntctgnggttcttntttttttttggnnaattttttntnaanacctttttatngatggtttttncnggntngaactcnaattngatcgcnttccntnnttaanangcnggggttngttaaggantccnttngnangcngntnggataatttnattnccttngnnngcaanatnacnccnttngttncnagctngnncncaagntttnaangccactcnatnagcngnngcnccaggggcnttcccccanggangncctaaagttcctccnccaaatngnaanacanaatcgnccccaaagatttnggncanagnnggcntnnnccaaacatgaatnccnccngangctnccggtntancnccnggcnnggntncccagnccngngggaaaaanatnccgggngcacnatntttttaaanaaaatcatngnncaanaaatnaacaaaacctaangtcntttngggtncccctttnaacttacctactacnggnccggnggggatatgatntcccccanacatacncaatgctttagctaatacncggaaatgcanaccatgatttttctgnctataaanaactgnatgcattggcncggggaatgggaaaaantaagccattgncggggaaatngngagcccaaagtngtntttgnggggaatcccccggntaagnngnccntgccnttacaannggaaccccttaattntntcncaaaaacagntnttttaaaaaattttnttnaaagggnccccgnnngccnnatttnaaganaanggccccttggttttcnccgggtttngggcccngggatttaaaaaaaaagcttngggcccaaaanaaaaaaaaggnnttttcccaggncnnaaaagggggngggggggtnaccntttnnnanantnttngggnaaaaaaaannncccccccngnnnaacccttnaaaaanngccttttccaatnatt

SEQ ID NO: 5410 - DNA, 445 bp, Hordeum vulgare
  UNSURE (13),(18),(19): n stands for any base
gccccttcatatnacatnncctactaaatatatttcttggattattttcatcaaagaaggaccccccaaaaaaaaagagccgtcaaaatgacacaaaaaccccattatactatgcgtatttacccgagcagagcagagttaggttcagggccagcccagcagaaccagaagggctctggatttcgcggaacggttcagacgtcgacaacgcacggcgcggcgcgctggaagttgaagtagccgttcccgccgccgccggcgatggagccgtagctgccctgccctccgttgacggtgagcagagcggggcacctgacccggaggtggtagtgccccgtgatgaacgccccggccttccacctgatccagccgtccacccgcaccgtgagcagcacgtagccggccgtctcgtcctgcgccagcgccaccgccaggtacggggcca

SEQ ID NO: 5411 - DNA, 468 bp, Hordeum vulgare
ggacgaggctccgccccatctctcgctgctccagggctccatttccctcaaggccaaggcagcagcaaaggaccagggcgaaaagaagcccgaagctaccaaaaagaaggcatacagtcttgtttgcactgcctgtgaagggaatggcgcaatcgcatgcacccaatgcaagggaggtggggagaatttggaagaccatttcggtggccgattcaaagctggaggcttatgctggctttgcagaggaaagcgtgaaattctatgtgggagctgcaatggcgctggcttcttgggtggatttatgagcactgccgacgacacttccgaatgaaatgcttatgttgttatttttttgcttatgttgtatttgacaaattttgagagatctgtaacatttttacttgtatctgctccaaggaattagtcccttagaagtgggacatttatcgcatttaataaatgtataat

SEQ ID NO: 5412 - DNA, 450 bp, Hordeum vulgare
tttattaaatgcgataaatgtcccacttctaagggactaattccttggagcagatacaagtaaaaatgttacagatctctcaaaatttgtcaaatacaacataagcaaaaaaataacaacataagcatttcattcggaagtgtcgtcggcagtgctcataaatccacccaagaagccagcgccattgcagctcccacatagaatttcacgctttcctctgcaaagccagcataagcctccagctttgaatcggccaccgaaatggtcttccaaattctccccacctcccttgcattgggtgcatgcgattgcgccattcccttcacaggcagtgcaaacaagactgtatgccttctttttggtagcttcgggcttcttttcgccctggtcctttgctgctgccttggccttgagggaatggagcctggagcagcgagagatggggcggag

SEQ ID NO: 5413 - DNA, 518 bp, Hordeum vulgare
ccatctcgatctaaaaccgaggtttcgtccagctccgtcgccgcgagccgagccaagccaacccagagccgacccaccccagccatgccgaagaacaagggtaagggaggcaagaaccgcaagaggggcaagaacgaggcggacgacgacaagcgcgagctcgtcttcaaggaggacggccaggagtacgcgcaggtgacgcggatgctcggcaacggccgctgcgaggccatctgcgtcgacggcaccaagcgcctctgccacatccggggcaagatgcacaagaaggtctggatcgccgccggggacatcgtcctcgtcggcctccgcgactaccaggacgacaaggccgacgtcatcctcaagtacatgaacgacgaggccaggctgctcaaggcctacggggagctccccgacacgctgcgcctcaacgagggagtcgacgtcgacggcccagaggagggcgagggcgacagcgactacatccaattcgaggacgaggacatcgacaagatcta

SEQ ID NO: 5414 - DNA, 550 bp, Hordeum vulgare
gataataataccaccatggcttgttgcaagcaataataactgataatcaacaattatttaggcaccccaaatacaacgatttctcgttccaaatccataatcacaacagcccaccgaccgatacagacagacaaggacggacgcgcgcacgctattagaacagaatagaacagaaagtatagaggcgaggcgaggcgaggagaagaaaaagcttagatcttgtcgatgtcctcgtcctcgaattggatgtagtcgctgtcgccctcgccctcctctgggccgtcgacgtcgactccctcgttgaggcgcagcgtgtcggggagctccccgtaggccttgagcagcctggcctcgtcgttcatgtacttgaggatgacgtcggccttgtcgtcctggtagtcgcggaggccgacgaggacgatgtccccggcggcgatccagaccttcttgtgcatcttgccccggatgtggcagaggcgcttggtgccgtcgacgcagatggcctcgcagcggccgttgccgagcatccgcgtcacctgcgcgtactcct

SEQ ID NO: 5415 - DNA, 412 bp, Hordeum vulgare
attcctcatcgctcacaccaaaatcaaccaccaccaccagcagcagctcggctccggagaggcagaggcagagatgggctccaccgcagcggacatggccgcctcctccgacgaggaggcgtgcatgtacgccctccagctcgtctcgtcgtcgatcctcccgatgacgctcaagaacgccatcgagctgggcctcctcgacaccctggtggccgccggcggcaagctgctgacccccgccgaggtggccgccaagctcccgtccacggcgaaccccgccgcggcggacatggtggaccgcatgctccggctgctggcctcgtacaacgtggtgtcgtgcaccatggaggagggcaaggacgggcggctgtcccggcggtacggcgccgcgcccgtgtgcaagttcctcacc

SEQ ID NO: 5416 - DNA, 382 bp, Hordeum vulgare
ttttttttttttttttttttgcatcacatgcagcctttaagagaagcactattaatgcagtacatttcggatagttcgacgacacagccagtagaattcagaatgattcatgacaaaatcagggaaacagaggaaaaccaagccaaagtacatatgcaggttgacgcagcagcgccagcgagcaagagcaagatggtctcagatcggtgggcggttgccatggatctacttggtgaactcgatggcaaatgcgttggcgtagatgtaggtggtcttcatggctgcgaagccggcgcccttggccagggcctcgaactccctctcgtacctctccctgccgccggggttgtgcgcgagcatgatcatgtcgacgtggaacacc

SEQ ID NO: 5417 - DNA, 1967 bp, Hordeum vulgare
  UNSURE (1)..(27),(41),(45),(46),(48),(49),(51),(52),(55),(57),(62),(65)..(67),(69),(70),(77),(82),(92),(224),(388),(437),(637),(796),(880),(938),(962),(995),(1344),(1408),(1478),(1566),(1768),(1802),(1804),(1844),(1914): n stands for any base
nnnnnnnnnnnnnnnnnnnnnnnnnnnaaaaaaataatggnattnnanncnnaananaaccnaannnannatagganatganagatatttcngacacagggggcacgcgtatcggcgtctcacaccaaggtatatattacagcatcaacgttaatgcaccagtatacccacgcagtaggtcactataaagcacggcacgaacgaaacgcactaacacacaccanaacaggcacagcacactagacgcaatcaatgaataccaattagagtagcgagttaattgatagataacattatttaccgtgcgggccgtcacaatgtgcgttcctgtgaccagctctgcgccgggctgccgtgagagatatgcgaaggcaggcgcagactgagnagagaattgacggtggctaggcgtatagcgcccagacacatatagactntcacaaacgaacgatagaagacgaatcagaggagaagagaggggcacacgaagacaagaagacgagagcaagacatatagcgtcccagtgttgtgacagtgaatgtatatagagttggtgtcggaggcatggtggctcaacgctgttggcgcgtccggggttgtcgtatctctgacatgcgttgttattagagtacctancatactagaagttgacgtaatagctgtcagtacggggagagcacgatcacagagcgccgctcagtcgcatattacatagtatcgcttgtacgtctttctcccgcagccacgtcacagccacggcgcgcgacgaccacgagtaccggccgtatccgacgnccgccaattctgcctatcgtgacgcacagctgaagaagatctccacatccacaagcgtcgcgatgataacaatacgcgctcagnactgcaacgtctgcttgtgttagcggtgtggagagcagggcgtcttagacagcatggnatacttgttagcaccgcagcggantcgatcgaggttaggtcgacaccgaacagaggncgtgtcacagcaatggtgtaacgcaatcaggtacatagttgtcatgcatctagcaatgcacatgatgatagtatgcatagctgcagtgaaagtactcgttatcagcggcgcggcgggcggtatcgccgacacactgggcgcgcgaggccgcgagcggtcgtgttgatgagcgaccgcggcgcttgacgaggcttgtgcgttagagttacagatacagcacgccacagcgccggtgcgcgcgatagccagcgctgtcacgagcgcacgccattaagtcgtactaagcgttacttgcacgactctcacaccaagcggacagcaacgagatgagtaggatcgtccacgccancacatagcatagagcttatctgattagtgtttgatactgacgctcaaacatagcgaggacaacncattcatagtcgacgctcagtgcagctgctgctccacgcggcgaggctaatagataccaagacgcgtagntatgcgcgatagcacacgacaagactctgtagatagagaccttcgcgcactgattgcgcatgagcgtatcggccgcacgcacgtcacnttacgatgtcgacagcgtgcgccacggcacgagacatgagcgaggtagttccggtacagtcaaaagcgctctcacgagcacgtgtgcgcccaccgctgtcacgcgtgtcgtacaggttgattcgctaatgtacactgactcacacgcgagtccattctattatggagttgacagaacggagttgcgtgtgttagtgctgtantccggtgactcgtattgatccgactgtagtagcngncttctgtttgagagagcagtatgtatatactttcatactngcaccagatgttggcctcgaatatgatggacgttaccgtctcatcccatacgccgagtgactcgcaaccntcgatgcgcgcgtatctttgtggtgctaaaccgaatccgctatccagatattt

SEQ ID NO: 5418 - DNA, 446 bp, Hordeum vulgare
gcatcccctagtatattcacaaacagtgtcaccctctagtagcaacacaactcacacgaaaaccattgctttggccagctcgagagccctttcccttccaaagagcttctccacgatggcaagcgagaattccatggaagtgcctggaccttggctagtgatcaggttgccatcgacgacgactctgttctcgcattcgctttggtccgcgagtttgctccacatagcaggataggatgtagccttctttcccttcagcaggccatgtggctcaagggcaattgctggggaggcacatattgctccatacagtttgtttgcctcggcttgcttcttgatcagaccaaccagcttatctgatttggtgtatgcttgggcaccaccaagaccgccaggtaataaaatgagatcgtactgctgcttaaggacatcatccaacagcacat

SEQ ID NO: 5419 - DNA, 280 bp, Hordeum vulgare
ggcacgaggcgaggacggcgtctccatggcggcgctcgcgctcatgaaccaggacaaggtcctcatggagagctggtactatctgaaggacgctgtccttgacggcggcatcccgttcaacaaggcgtacgggatgtccgcgttcgaataccgcggcacggacccgcgcttcaaccgcgtgttcaacgaagggatgaagaaccactccatcatcatcaccaagaagctcctcgaggtgtacaagggcttcgagggcctcggcaccatcgtcgacgtgggc

SEQ ID NO: 5420 - DNA, 546 bp, Hordeum vulgare
tgcatcctttaagagcagcactattaatagtacatttcggatagacgatggacgacacaaccagtagaattcagaatgattcagagctagcatgacaaaatcagggaaacagagggaggaaaaccaagccaaagtacatatgcaggttgacgcagcagcgcagcgccagcgagcaggaggaagatggtctccgatcggtgggcggttgccatggatctacttggtgaactcgatggcaaatgcgttggcgtagatgtaggtggtcttcatggctgcgaagccggcgcccttggccagggcctcgaactccctctcgtacctctccctgccgccggggttgtgcgcgagcatgatcatgtcgacgtggaacaccccctgcgccttgggcgtggcctccgggttcaccggcaggatgcactccacgagcaccaccttgccgtgcgccggcagcgcgtcgtagcagttcttgagcagcgtcgcgcagtgctcgtcgctccagtcgtggaggatccacttcatgaggatggcgtcgcccgagggcacctt

SEQ ID NO: 5421 - DNA, 552 bp, Hordeum vulgare
gtacccccgggcctgcagggaattcggcacgaggcctgccggagctgagcgtcttcacaggtctacaactcttcagaggctactcaaggaacagaagcaagaaagcaggatgtatggtgggatcggttattctccactgatattgcagaagcaaggtttactccaggataaaacggcgacagctcatccttccatagtcaatcagctcacttgccaggtcattgaccgatcaaaggttgtgattgatggaaatttgattactgggaagggactcggaacaaccatggatttttccctggccattgtaagaaaattctttggccatgggcgagcaaaaggtgttgcaaatggaatggtttttgactacaccaagagcagtcactgttagctatgctcaaaatttgaggtgactgccaatgtccactaaatatgttgggatgaaccacaactgcattgggaaaattcagttggggtcagttcatctcgagatgttctgcgccgatgcggcatcatgggccgcgcgctccatgtgcgagggtgcgctggacctcc

SEQ ID NO: 5422 - DNA, 551 bp, Hordeum vulgare
caatgtgtttttttaccccttcttttttatcgactgtcttataaaagcttacagagggagtcaatttttggcagtgttcagtattggcatttcaaaattctgacagcaaacataacataagctcgccagtccgaagcaaaattataatttgcttgctgtatcgtcatgtttgcagatcatgcacttcgatattcaggaaagcgtacggaagcagattgcccagaagttgaaaacaaacctgtcaacatagtgcctatatgttgtctagtgttgtcccgcaacgggtccagcgccaactcacgcacgacgctgctgccatacttggagccgcccgccggggaggtccagcgcaccctcgcacatggagcgcgcggcccatgatgccgcatcggcgcagaacatctcgagatgaactgaccccaactgaattttcccaatgcagttgtggttcatcccaacatatttagtggacattggcagtcacctcaaattttgagcatagctaacagtgactgctcttggtgtagtcaaaaaccattccatttgcaaca

SEQ ID NO: 5423 - DNA, 518 bp, Hordeum vulgare
gcagtctcccaccctctggcgttcggcggcggcggttgaacggcggctggcactgtcggatctgcagttttctgaagaattgcgtctgtccgctcttggtgcagagcgatctgagaatggcttggggtcaggctgctagaaggcccatactagggcttctgtctcgtgctcaacgacaagctgctcgagggtatacttctgcgacgttcgaaactcatctgtcgagcaatcattttgcacaaaatggcatgatccgtaggagatttagctccgaggtgcctgcttcggagcaaatgaatcttattagacaactacgagaaagaacttgtgctccgatcaaagatgtcaaggcttcgctagttacttgcaactgggatattgaggatgcacagaaggatctaaggaaaagaggggtgatatctgctgccaaaaagtcttcaaggactgccgccgaaggtttgctagctatggcacaagatgagacaagggctgttgtggttgagctaaactgcgagacc

SEQ ID NO: 5424 - DNA, 547 bp, Hordeum vulgare
tttgcatcttttttcgtccaccgagttaatagacaatgagagcaaccccaacattggcagccttgcaggtctcaatatgcgtggcctttcgtttcagttgtgcattattcagtttgcttcaatttactggttcctttttaattcatttgccaacaactagctaattgattgatgggcatttatacatttgcagaaaagaacatccccttggagaaaagatgaggacccgtataaattctcaggagaaaagaaccatggcatttgattcatctcagctcttcgcatttacgcagcacaagccgtagcttcaggcctcgctgtttcctcgcgtctctcaattccttctccaacttccagtctgataaaattgccaattgttactttagaaccaacctcctttgacaaatcactcagcagagtcttaatgtttgtgctatcattaacaacgtatttttgctccaaaagcacaacatcttcaaaatacttcttcaatcggccttccaccattttctctatggccatttggggtttacctgaactctcggcc

SEQ ID NO: 5425 - DNA, 347 bp, Hordeum vulgare
gggcttattatgggcctttatgcaaatctgcggtatcaatttttatgtggtcttgatagatcaatggcaaaccattttgatgtccttggtgttactatctttttcggcacagcgatgagattgatgaatattcaaattggggagctatcgagacgtgcctggcttggtgaaggagcagatctgcttaactcggataatctgttgagaacatacaatggaccagcagcagagcttgccatcgatcaacaggcagagtggtttatgtccaagaatgcaattgtatctggcttagaacttctaggcatcaagtatggtgcacctaaagatgcctctccaaagcttcggcg

SEQ ID NO: 5426 - DNA, 552 bp, Hordeum vulgare
  UNSURE (24),(26),(27): n stands for any base
gtcaaaaaatagcaaggcctttgntnncttggccccaaattgcaactgaaacaccagctacaattgtttttcctcatccatcctactttgataggcaactgaaacaccagttacaattttcttttccctcatccatcctacttccataggaaacacatgtcatggcggaactgaagcaaaactgtcccagcatggtatcaaaaccatcaaactcagcgtttgttgaaagaatagttaggtttttcctcatccaccctacttctttcggataattctttttcgccgaagctttggagaggcatctttaggtgcaccatacttgatgcctagaagttctaagccagatacaattgcattcttggacataaaccactctgcctgttgatcgatggcaagctctgctgctggtccattgtatgttctcaacagattatccgagttaagcagatctgctccttcaccaagccaggcacgtctcgatagctccccaatttgaatattcatcaatctcatcgctgtgccgaaaaagatagtaacaccaaggacatcaaa

SEQ ID NO: 5427 - DNA, 526 bp, Hordeum vulgare
cggcacgaggccttctggagccgtcgtcgtccaacccctccgacctcatccagcgtttccattcccccctccctctctctgcgccctcgccgttcaagaatcaaccgatctcgcgcgcaatgtctcagactgttgaactcagggttggcatgtcatgcgagggatgcgttggagctgttaagcgggttcttggcaaaatggaaggtgtcgagtccttcgatgtagacatcaaggagcagaaggtcactgtgaagggtaatgtgacgccggatgctgttctgcagactgtttcgaagacaggcaagaagacctccttctgggaggctgaaccctcagcggcatctgctgtttcgtcctaaaaaggcacctctaatatgtaaactgtgaagtttattgtagcaatggcccagttgaaatgctttgcgaggacatgattttctggtcggatggtatatgcaccatggatttactgcaaataatagcaaactggtaatttcgtttgtgtgcatcttatggttggcattcc

SEQ ID NO: 5428 - DNA, 551 bp, Hordeum vulgare
tcatgtggcaaactggttgaacacttgcaaatttacagtgcaggaatgccaaccataagatgcacacaaacgaaattaccagtttgctattatttgcagtaaatccatggtgcatataccatccgaccagaaaatcatgtcctcgcaaagcatttcaactgggccattgctacaataaacttcacagtttacatattagaggtgcctttttaggacgaaacagcagatgccgctgagggttcagcctcccagaaggaggtcttcttgcctgtcttcgaaacagtctgcagaacagcatccggcgtcacattacccttcacagtgaccttctgctccttgatgtctacatcgaaggactcgacaccttccattttgccaagaacccgcttaacagctccaacgcatccctcgcatgacatgccaaccctgagttcaacagtctgagacattgcgcgcgagatcggttgattcttgaacggcgagggcgcagagagagggaggggggaatggaaacgctggatgaggtcggaggggttggacgacgacggctc

SEQ ID NO: 5429 - DNA, 524 bp, Hordeum vulgare
ggaacctatggctgaaaacacccaggggtcttccactgtcgactgatggggaaggcatgaagagggggacacgtgtaggggaaggcgcactaagggaagttgcggcttatattctcgaccatccagtcggtgatcgtgaatcaggtcacggttctgggttttctggtgtgcctcccacagcattagtccgaagcttacataggggaaagagcttcaagtttggatctctgcagatgtttatggagaacgatggaagttgtgaggacatgggtcctcgtgctttcccggtgaaggaggtccacaaaatagcagtgttagatattaggttagcgaatgctgatcgtcatgcagggaacattctagtgtccaaggaagatggtgccacctgcaagctgattccaattgatcatggttattgcctgccagagaagtttgaggattgtacatttgagtggctttactggcctcaagcccgtgagcggtttagcaatgaaaccattgcatacattgaatcgctcgacgcg

SEQ ID NO: 5430 - DNA, 556 bp, Hordeum vulgare
gcacttggtaagcaagctccaatcaaaacgaacaatatggtagcccttaacctagttcagtgataagaactaacgcagcacagacatctatattcacagaagaaaatgttcttgagcggctacaaacaaacggaatcgtttggggctagaaacaaatgaaatcattagtcccttgatgaggagctggtctggggcagtgccttgtgaaacatacttacagcaaaccggatacagacgaacaactagatcagttattctgagtgtttctaaacagatattacttgccgaggaggtgacggtctatgatctcagacacggtctccaggaacaggttctcactcgtccccgggagaacggcgtcctccgcttcctggatgatgtcctcgatcacagagtctctattcacagtttccctgcacagtatacgtcctatgtcatagggtgtgagacctcgcgcagcgcccttcttcaggagcatggtgctgatgcgcaggacacgggcgcagctcgaagacagctcccacccgtggaacctgagaagcttgatgtcctcttc

SEQ ID NO: 5431 - DNA, 513 bp, Hordeum vulgare
gcagaagaggaagaagagaaggatgaggcaggatggagctctgccaatgatggtgatgacagtatggatgtcgaagataatgtatctgtccaaaatctggatagtgataatgaggaggggtgtagcggtggagtggagatgaactgggatgttggggatgataaggggggcgaggggacggcaccttgtttacagcaatgtgactttccaggggtggagtttgagaatttgaataaagggaatgttgggatgagggatggtgtgagctttgatgatggattcaaaatgggttccttgcatgggatggagtcaaacctcctccaggccatgaactctgatactgtgacatacaatgggacggagaatgcacatcacctgtcctctggaaatttcttggctattggggctgatgtacataagaacggagtggacctgggggctggtgattcatttttctttggcaataatgggaagaggcatgttgaggatattgatgatgggtatgatgaccag

SEQ ID NO: 5432 - DNA, 545 bp, Hordeum vulgare
aattcattacttctagctaaaacttccacagaccaacaggtgaataataacaaccgaatgcctaatcatactccgttagcttccaatacgcataataaggtacaaatcgactacccaccacacaaagacggatgcaaaagtaaagagacgatgtgaactgttctacacatataagattaacctgccaccgccccagtattatactgtattactccatgctggaactgaaccaaaaaggcatctaaacaaagcaagcactagtaatggacactgggacgcccttggatgacgaaacattgagttacacagctggaattatgtcgtcttcgctacagtctacgatgcacgacgaagtagcaacagttgccaatgcgctgtcgctgttgaacatcaaacaaccaatgcacatatccaagagagctctccatcttcacatcagaacctctaactatcagagaacttattcttcccaagcaagggctgcaggcttggcttttcttttttccttgagaagatcaatctcccgagtcaatgccagagttttg

SEQ ID NO: 5433 - DNA, 510 bp, Hordeum vulgare
gactctttcagtctgcgtcaccgtcacctggtgtctctgattgggtactgtgatgaaaggaatgagatgatcttggtctacgagtacatggagaacgggaccgtcaagagccacctatatggttcagacaacccctcactcaactggaagcagcgcctggagatctgcattggagcagcaagggggctacactatcttcacactggttctgcaaaggccattatccaccgtgatgtcaagtctgcaaacatcttgcttgatgagaatctccttgccaaagtcgctgactttgggctgtcaaagactgggcccgagctggatcaaactcatgtcagcactgcagtgaagggtagctttgggtaccttgaccctgaatactttcggagacagcagctgactgagaagtcagatgtctactccttcggcgttgtcatgctggaggtgctctgcgcgaggccggtgattgacccttcgctcccaagggaaatggtgaacttggcagagtgggga

SEQ ID NO: 5434 - DNA, 529 bp, Hordeum vulgare
  UNSURE (21): n stands for any base
ctgctaaatcggtgcccacanactgggtaaggccatcagaaatcgaaaccgtagttcagtacacaattacaagggatgaaacaaccaattacacgtgacacgtttcaggtaaacttcaacaagaaaagaaaaaaaaatccaaggcttgctcacacccctaacggtaccctacagatcatcaggcgcgttttcacctcccctcggctttgatcagctgagagaaaaccctgctcatcgacacgtcggagaggtcgtggtcaggctcgtgcgaagctccgtcctccgccatcgtcacgctgatgctctccatggcaccgacgtgctgaacctgcgacgacaggtcgacgatccggttcatgctgttcacgtccgacacggtcgaagaatccgcgtcctggagctgcaggacatactccaagttccagagcacgtcccccatcgacggccgctccacgccgtagtccgccaggcacttctccaccgtctcgccgaacttccttagagagtccggcctgatcgcgccggaaag

SEQ ID NO: 5435 - DNA, 294 bp, Hordeum vulgare
cgaggcatttgcctccacccggctggagggaacagagttgagcgcactcgctcaccaccggagcctcctgcgcaccacctgttcgacgaaacgcctctgacctctgaccccatggcggaggcatcggacgacgggagcattgaagacaagatcagcgccctcccggacggggtcctcgtccatgtcctatcccacctgtgctcacgcgaggctgtgcagacatgcgtgctgtcacggcgctggcgatacctctggcggtcggtgttctgcatcgacgtgtctttcgtggaattt

SEQ ID NO: 5436 - DNA, 553 bp, Hordeum vulgare
ggacagcagaaaatgtacagcaagttttgtgcatccatcagccatgcatctcagatcaacaacaccacgcacccatgaaaatgtcaaaatccgaatgagctaacagaatagttacaagaaaagcatcgtcggagtttggagccataaactcaaccagaacgggcaattttgcatattcttatgcagtgtaacgttctaccaaaagaattatggcaccacataggaaaatgacacatctaggtgatatcttccttttggtccaatcagcagaacatagttcaaaaccaacactaggattctagaagaaataatgtttgcctgcctgctatgacattccaatgggtgattccatgtaatttcaactgtagtgggacccgaaacaatcggatgcctcgcatcgaccttagttctggtgattgacacacatctgatcaggccttatgccgcattcttctagcaaaaactgattaaccccaggtagcagtgcatttccctccgagcatatgatttcaacaatctcaagctgttcgcacgtaaatgatctatcctccag

SEQ ID NO: 5437 - DNA, 517 bp, Hordeum vulgare
gaccgacccacctccacgcacgccgccgtctggggcattcaccggcgacgagagacgctcccgtcgcgctcgtccttgtctgatgatcctccagagagcaggctgcccagcgcgacgccgttggaggcgccgttcacaagcccgagggcggccgggctctaagtctccctgcgcgtgcggcgcggctgctcgacggagggcttgacatggcgaagccaaagggcataaggcagtggcgaggcggaggcgtgttgggcgtcggggatggcaggcgcggaggcacggtggcgttatcggccgcagcgtctgagaagttgtgtacgcatgatccgaagacggaggtcgaggccccggccggagcggagacggaggcgagggcgtcgccctccacctcaacaaccgcaggggtcagaggcggcagagaagcagcctcgcggctttgtcggtcacgtcctcgtgcaggggtgatgacgacaccggtcggttcaaggccctgcatcggcagcggcaccacggg

SEQ ID NO: 5438 - DNA, 555 bp, Hordeum vulgare
gaatatgactgatcgtcacttcacttttgattacatctcgggcaacaacagtaagaggcgtcgggctcgcacgtccgctgtggtgttgtgtggccggggcagccgaacggcatcacgccgtcgtccggagaagacaacgtgcatctatgatgcgtccgtacaagaaatccatccggagaaagctaactggattgtctattttcttaacagcattaagaatccaatggccgattgcctgcttctttcttgaatcaacgggcatctggaatcagaaagatggctccgtcatggcgtacgtggactccaacgcgatggtgcaggaaagtacagcggctctcgtcgccgccaccaacacactgccacggcgccgccgatgctggcctttgtgtcggctgcacggcagcccgtggtgccgctgccgatgcagggccttgaaccgaccggtgtcgtcatcacccctgcacgaggacgtgaccgacaaagccgcgaggctgcttctctgccgcctctgacccctgcggttgttgaggtggagggcgacgccctcgcctccgt

SEQ ID NO: 5439 - DNA, 501 bp, Hordeum vulgare
gcgccctcgcatcgccgccgaaacccatcgctctcgctctccgccccgtcgatccgctccgacgccagcgcgggttcctgctccggaggtttcggccgaaatggctctccccaacacccagcccgtggactgccccaacttcaagctcgtcctcgtcggcgacggcggcaccggcaagacgacgttcgtgaagaggcacgtcaccggggagttcgagaagaagtacgaacccacgatcggcgtggaggtgcggccgctggacttccagactagccacggcaagatcaggttcagctgctgggacacggccggacaggagaagttcggtggcctccgtgacggatactacatccatggccagtgtgcaatcatcatgttcgatgtcacctcccggctgacctacaagaatgttcccacctggcacagagacatctgcagggtgtgcgagaacatcccgatcgtcctgtgcggcaacaaggtggacgtgaagaaccggcaggt

SEQ ID NO: 5440 - DNA, 558 bp, Hordeum vulgare
cgattaaccctttcgcatttcatttcagttttaacaagcacaaaccatcgtcatcaaatgcctactgaaagtctgatacggatacagaagtttcacttcacttcttataagagtttgaaactatagatgctgctactaaactaggcacatcctccgattgatcagctcagtccatgatgttgtcatcatcgtcatccgggaggggcaatgccgccgcagcagctatctctgcgtcaatctgttgctgagcaacgaggtcgatggttacgtcggcgggaaggagggccgtctcctcgacgaaccggagggtcatgtcccctgacagcttcctggcaaggtagaggaaaggcttctcgaagttgtagttgctcttggcagagatctcgtagtactggaggttcttcttccggtggaaggtcaccatcttggccttcacctgccggttcttcacgtccaccttgttgccgcacaggacgatcgggatgttctcgcacaccctgcagatgtctctgtgccaggtgggaacattcttgtaggtcagccgggaggtgacatcga

SEQ ID NO: 5441 - DNA, 516 bp, Hordeum vulgare
ggttcatgtatatgatttcttactggtgaagaaatagcctgcaacaaaggtcatcacggccccgtccactgcgtccggtttgcgcctgttggcgaatcatacgcatcaggatcagaagacggcaccatccggatctggccgctgaaccccgcaagcaccgatgatgctgaggcgcccaccgacaacggcaaaccaaaggccgccgcggtggcaaacgaggtcgcccgtaaaatcgaaggcttccacatcagcaaggaggggcagaccgaggcgtaggagggaggatcgcatcgtcactgaacctggcagtgtttaagccttgttgggggtactgccgttgccgtccgtcagagccggtcctggtgtcatggtgtcgccctcgggtccatcacgtcgaagcttctttgccgaccaagggcggcggacgattccgtctggctcacgcccggacggtggatttctgtaaggggtactcttcggtagactgttaagattaatgatagcatctaaggaatc

SEQ ID NO: 5442 - DNA, 533 bp, Hordeum vulgare
tactgctgtgcaaaaaactaactgctggactcgctctcccccttcggtttattccgattccttagatgctatcattaatcttaacagtctaccgaagagtaccccttacagaaatccaccgtccgggcgtgagccagacggaatcgtccgccgcccttggtcggcaaagaagcttcgacgtgatggacccgagggcgacaccatgacaccaggaccggctctgacggacggcaacggcagtacccccaacaaggcttaaacactgccaggttcagtgacgatgcgatcctccctcctacgcctcggtctgcccctccttgctgatgtggaagccttcgattttacgggcgacctcgtttgccaccgcggcggcctttggtttgccgttggcggtgggcgcctcagcatcatcggtgcttgcggggttcagcggccagatccggatggtgccgtcttctgatcctgatgcgtatgattcgccaacaggcgcaaaccggacgcagtggacggggccgtgatgacctttgttgcag

SEQ ID NO: 5443 - DNA, 497 bp, Hordeum vulgare
caatccctagctgcccctcggcccctcccccctcgaaccagaacgcacaaccgctcctgccgccggcaacgaaaccctaagcgcagagatgctaccagccgaggcgccacaccttcccagaggccgctacccccatgatccggccaacttcgcatacccccccgacctatatggccctgcgctccagcgcctccatgatcctagcgagcagcaggaggtggtggcggcagaggaggaggagaagaaagggatcgcctccatctattcctgtatcgataaacatgctgatccggcgctcaaggccgaggcttcagagccgcctattcctcactgggatgatgtctggctatccgacagcgacgatgatttagctgacatgctcgacttggccgacttggccggcttggccctgccacactctgacgagggggagggagtggtgacagacgatgaggagacaaattgcccagggaaaaactttcccagggagaaagcca

SEQ ID NO: 5444 - DNA, 451 bp, Hordeum vulgare
tagcaatatttgtcaagtttcaacaacgtctgacctcaaacgtctgttgttttgacacatagggtttacagattacaaaaaaaaaaataacacccaaggggtacttagttaggagataataaaacgcacaatccagcagggggtgtcttcttcatttatttctggggtggcaagttcttaggagcaaagaacaccctcacatcaaattggccatactttgacatcgagtcgtcaggaatcctaacaggtccaacatgtccatcctggaaagtccaccgaaagagtgattcccccaactttaagcaaacatccaatttttcatctgctttcaccacgactacatgctgaaactgcatcttagtcccagagaatgtgtcatcaaacaacacaatctcatgatcaaagccactgctgaaagcaccaaatctcacatgatgaggaccgtcaacct

SEQ ID NO: 5445 - DNA, 499 bp, Hordeum vulgare
  UNSURE (256),(257),(298),(420),(435),(464),(467),(474),(482),(484),(489)..(491),(493),(494): n stands for any base
ccccccaggaagcgttggtgaatcgggagccaggaataagaagtatttaaatgaatatgggcacgagaaattgccttggcacggcggagaacaggtgctcaacgccgtgcgaagatcctccaaagcaatcaatgctacaagacttgtaacccacccaagacgtccgcacggttcattatgactcttacccctgcccgcccaaattcgtaactaaagcacaacactaaaccgaagccacctacgtacctccttcccnnaacaggcgccgggcacttgtcccatacctaggttcctgtcngggtagctgacctatgcttcgatcgcaaacttcggcgcaactctctgctcatatggcgtagactacaatcgtgagtaaaccgttactgacttgccaactaatcgtcgaagctctctacatancggattgaggagggngagattgcatacgttgaccgagcaggtcnacnagcttgnacccacgngnttcannnanngttaa

SEQ ID NO: 5446 - DNA, 551 bp, Hordeum vulgare
gcggcaacgactcgaaatttttgatacgatattgtcagggccgatttttctgggattttaattcccatcaaaatgacccttgtgcataccagccctaggaatattgttagctggtacacaaatccttgatacaaatgtccaagcaaattacaaatttgaagtacaagaccaagatggcatgtggagtacatcaaaaaggtttctactcattgatggcggaagcagttaggggatctccagcgtctatgggactccatttcccacaggaatagatcacctggataattcctatctcacatggctgctgtctttggcgcctaggttccgggctgtcgtcgggacgctcctctccaaacacgcaatctttcataccccaatatgcctcagtgaccatgctcgtcctacgagatgtcagtccccaaggtcatgtcttttcgagacacccactcttctcggatcccatccggtaggcatgtgtggcagaagggagtgactactagcacatgcatctcaatatgcaacagaattaatttttcaccatgtactcatgt

SEQ ID NO: 5447 - DNA, 363 bp, Hordeum vulgare
ggaagcctctagactgagctcctcatcagcgtgggacggatctctgccggatcgtatttccggggtgagcatccccaaatccatctccttcgtcctctcttccgcttgcttcctttacgcgccggtgacaacagggatggctaccggtagcgaagctggaaagtccgccgaggccgtgctggaatggcctaagcaggacaaaaagaggatgctgcatgctgtttaccgtgtgggagatcttgacaaaaccattaagtgttacacagaatgctttgggatgaagctgctgaggaaaagagatgtcccagaagagaagtacaccaatgcgtttcttgggtttggacctgaggatactaattttgc

SEQ ID NO: 5448 - DNA, 309 bp, Hordeum vulgare
tttttttttttttttttttttgtttcgtcgagcggaagaggctgcctttttattacatcgcacacagaccatttgctacatgaggtttgttttattacatcacacagaccattgctacatacggttcctcctcacgacactaacatctgagcctgctcatcttcagtgcagctccttgaggaagtctgcgtagtccaccagaaccactttccagccatccgggtcaaggaaagaggtgattttggtgttcagccccggtagtggccctggctgccttagaatctttccacctagttctttggtaaccag

SEQ ID NO: 5449 - DNA, 517 bp, Hordeum vulgare
cctcgtgccgaattcggcacgaggccgccggaaggagacgaacaccaaaaccctcacctgaccctccccgtcaacctcacccgccgccgccgccgccgccggaggaggaggaggaggaggaggagatggacttccaggtcgtcgtcctcgccggaggcacttccgagaagctctcgcccctcgtctccaaggacgttcccaaggccctcctccccgtcgccaaccgccccgcgatctcctacgtgctcgatctcctggagtccagcgacctcaaggacatcatcgtggtggtggaggggcaagaggcggcccgcctcgtcggagcgtggatctctagtgcctaccttgaccgcctcgtcgtggaggtagttgcagttaccgaggacattggaactgctggtgcattacgagctatttcgaagagactggtcgcaaatgatgttttggtgattagcggcgacctagtaactgatgtacttcctggggctgttgctgctacccatagaagaaatggtgc

SEQ ID NO: 5450 - DNA, 544 bp, Hordeum vulgare
gatagcatgattacccattttctctactttttgacagtacgtagaatgattaagccaagcaagccattgatccaagacgtgctatgaaaccatctcaagattaaaaaaatgagccacaccatgacaccatctcactaactgcagttcacattcgaagcacccaaaattttctgaatgttactggaaccaaaattctgctatcatatctcaaacgaaaaactgtaagaaaaataatctcaaaacagaactgtatcccctttctttactcataggagtgcatctgatacgcacatgtgctcaagtccaccgtaaaactatcgaaatgtgctctacttcctcgcgagggattctgatttgtgatcactaccagtagtcacagtataaccagctccaacctggcaatctttcagaacggcacgctcttgaagttgcacattattacatacaacagaaccttggatgtgacagccatcttcaataaccacatggttcatgacaacagagttgacaatcttcacattcgaaccgatacgacaatgacggc

SEQ ID NO: 5451 - DNA, 519 bp, Hordeum vulgare
ggcaacctcctgcagctcggcggccggtcacaccggtacttccagtcgctcatccagaagtacgggccggtcgtgcaggtgcagctcgcccgcgtgcggatggtcgtcgtcgcgtcgcctgaggcagccaaggaggttctccggacaaacgacgtgcactgctgcagccggccgaattcaccaggtccaaggatgctgagctacaacttcctcgacgtggcattcggaccatacagcgtctactggcgcgagatgcgaaagctcctcgttctggagctgctgagcatgaggcgcgttcagtccttcgcctacgcccgggccgctgaggtcgaccgccttgtctcctccctcgccgacacccctccgggcacccccgtcgacctcagcgacaggctgtactcgctctccgacgccatcatctgcacggtggccttcgggaagatgtacgggtcggaatcgttccagaggaccagcttccagcggatgatggacgagacgctgcgggtgctcgtctgcggc

SEQ ID NO: 5452 - DNA, 555 bp, Hordeum vulgare
  UNSURE (44),(45): n stands for any base
gaaggttggctcagatttcagggatttaaagatgaggggtttanntttgggtcggtaattacaaccttaaggtttatttcagacttcattcctccccatggcccaaacgtccacgtgtatcctggtgccagcaggcacgctgtagccagcgatctcgcagctctgcatggtttctcttggaatcagcagagtccccggtgggtgcagcctgaagttctctttcactaccatcttgaggtacttcaggccttgggcatcttcttcgtccaccctagatttattacggaccacggcgcgcacctcggactgggccttccgcatcacccttgggttcctcatcagctccgacatgatccagatcgtggtgacagcacaagtgtcgattccaccggtgaatgtatccatcaggattcccttgatgttatcacgcgtcagcgccagaggcccatcttgatccctccacatcttcaccagcgcatccaccatgtcctcctgcacgccggccgccagcctctccggctcgaggtgcttgtcgataaccgcgtcgaagaacct

SEQ ID NO: 5453 - DNA, 502 bp, Hordeum vulgare
caaaggaggtcaacatcttacaacactagggacagcgctagggatggaccaccagcttacccatctaattatcctttacaaccttttgaggctagtatgcctaccgcttttgtagggcttcaggctcaaactgaacatgccctagtaagcaacggtacttcatcatcaaatgctcctaatgcagacgtcaatttcttgtggaacaattttccagtaaatagggcccctatggagcacttcagctctggttcatctgcccgaccaatggcaccccttgctcaaccttattcaaccccacattctgcaatgagctctggctctcctgcatctcatctgtataaccaaggcactagcgttgtccagcctaacccatcttcatctctaatgaacgatgcaaacttaggcataaattctacatctggcagcgcaattctgtccagtttcttgccaacatttgccacacaacttctaatgggtaggcctccaatgtctagtccatttt

SEQ ID NO: 5454 - DNA, 389 bp, Hordeum vulgare
ttttaaactaatagcgtcacagcattgacatgttacatacaacgacgcatactttatgatgcacacaggcataggcatgcgcttctcttttcactattccgctagcaaagccgccgtcgcaccagaacatcgccgaaggcagagagtctagcagcatggccacgacaaacccaaagtcagacaccaccctcctatttgctgccgccgatgcgctcctgaagcaggtgcatcagtttagggtttgcctccagaagttggcaaagcttcgcacgatcgcttagcaggctctggattgcttctggagatgagaagaattggttcagatcaatctccggttctctctgctgttgagacgaaccatccgcttgtgcagtctggttagcaacttg

SEQ ID NO: 5455 - DNA, 511 bp, Hordeum vulgare
aatggtccgacatgtaattacaatgactagaaatctagatcgtccgatcatcagctcagttctgcagaccatgtttggtgtgtcaccaacacaccagtcatggagccctgagcacaatgccaccgttgttgattacacttggagcactggacatacaccatttggaccgttctcagagaccaaatcactgtcttttgttcagaaagatgcagcccgtaggaatgttcttcttaccaccctcaactacacaatcaccagtacagttgaggttctggagtcactggctgcccatggcggggagaatatactccttagaaagaaaaggcatgttgagttcattcaaaggtggaatctgctcacttataagttggagaaggtggtttcagccatgtcccgcctggattacaacaaggcaatgtatcttttgcgatcttcagatcatgatatgtatgccatttacatgttggtatatcaggcttctcaggagctggaggcctcactggtttgcttc

SEQ ID NO: 5456 - DNA, 534 bp, Hordeum vulgare
cacattatgtatgaagggcaattcaggcacattaaacttacaagacaagtggaagtgttgactccctcaaataatctagaatacctcttataagtttatcttggaacaagatgcacccattgcgagtgtctagtcactgctccatgtaatatgcaaggatgcaatttcctggcagccgtcaactatggtcgcatcagggtgaagctttcaaacagtatccaccaacaaaactgctgtcagaactcagaactgcttccttttgctcctaaacaaactatccctcttagaatacacaaaaaggaaaccaaaaacaaagactccagacaaggaaactgacagccatgggaatggtgggtctttgaagcaaaccagtgaggcctccagctcctgagaagcctgatataccaacatgtaaatggcatacatatcatgatctgaagatcgcaaaagatacattgccttgttgtaatccaggcgggacatggctgaaaccaccttctccaacttataagtgagcagattccacctttgaat

SEQ ID NO: 5457 - DNA, 343 bp, Hordeum vulgare
atttcgcccccgcacgcgcgccagaggaagaagaccgcggaggaggaggaggaggagagagagagagaacgcgcgcgagaggaggaaaaccatgttcatccagaaggcatggaggacggcggcgttcgggctctatggcttcacccagttcaccaaatccggcttcgtggaacacgccaagaaatttagagaggaggatatgcagatccggttggatgggaaaaattgcctcgtaaccggagcaaattctggcctaggttatgctacagctgagggcttggcttctcatggtgccactgtttatatgctttgccgtaacaaagaaaggggagagactgctttg

SEQ ID NO: 5458 - DNA, 477 bp, Hordeum vulgare
ctttaagcaaacataccgttgtgtatgagtacatagaaaactctatcgctagcacccatcatctttgtacgtaccaaaataatcgccgaggtcactatactcgtaccactaaaaatggtaaaacagactaaattttgttgcccctatggatagagaaataggaacagccttcatcaaagcaccagtggtctagtggtagaatagtaccctgccacggtacagacccgggttcgattcccggctggtgcacttttttcttttctcggtgagaagcttatgagtttgcaggcaggttacagatggagcgaatgctgtaaacaattgaacctatctgcccgtggtatgctgctgtcccagcaaactttaaatgtttttgcgcttcagcccggtcgaagtagaaaacccctgggactaatttctcctttggttgcaaagccaaccagaccaccgtgtcagccccttcttcgtttgatctca

SEQ ID NO: 5459 - DNA, 371 bp, Hordeum vulgare
caaacccagcccaacagctccactccatggggttcttcgccagagccgcgcgtttcctggtgctcctccagatcgctctcttcgtcatctctgccgtgatcatcagcggccccgtctgcaacggagcacgcccaggactcggtggtggtgctctggaccccggtagtcctgtgtgcgtcggtggacggtgcgcaccatctggccagccctacactcgccctgggtgcggcaccgtgtacaagtgcccaccaggtgctcagccctagcgcccgcagaccccgcctccccaacaatggagtaatcgcactcccacggcgtggatgcatggctctgtcttgttcgcagtaccagttactatcaggatcttatac

SEQ ID NO: 5460 - DNA, 385 bp, Hordeum vulgare
gtttaaagaacataatggcttaatattgtattatgtgcagaccctctcaagcaaacaaaaaaaaaagcaaattgtataggcagacgttggcgtgcaaccttcatgcctagagtacaatagcgtgaggagaaccccgttggagcaatattgagtctgaggtaacaagacagtgctcactcactgcccatctttattttggcaaatactactagatgggaacaccgttcatctttatttctgaaccgaaccatcattcatatcagtgcgcacacgagatgatattaggttcagtataagatcctgatagtaactggtactgcgaacaagacagagccatgcatccacgccgtgggagtgcgattactccattgttggggaggcgggg

SEQ ID NO: 5461 - DNA, 551 bp, Hordeum vulgare
  UNSURE (518),(534): n stands for any base
gtaccccccgggctgcaggcgcaaactcaccggagggtagtacaaacccagcccaacagctccactccatggggttcttcgccagagccgcgcgtttcctggtgctcctccagatcgctctcttcgtcatctctgccgtgatcatcagcggccccgtctgcaacggagcacgcccaggactcggtggtggtgctctggaccccggtagtcctgtgtgcgtcggtggacggtgcgcaccatctggccagccctacactcgccctgggtgcggcaccgtgtacaagtgcccaccaggtgctcagccctagcgcccgcagaccccgcctccccaacaatggagtaatcgcactcccacggcgtggatgcatggctctgtcttgttcgcagtaccagttactatcaggatcttatactgaacctaatatcatcccgtgtgggcgcactgatatgaatgatggttcggttcagaaataaagatgaacggtgttcccatctagtatttgccaaaataaagatgnggcagtgagtgagcanctgtcttgttacctcga

SEQ ID NO: 5462 - DNA, 546 bp, Hordeum vulgare
aaaaaaaagcaattgtataggcagacgttggcgtgcaaccttcatgcctagagtacaatagcgtgaggagaaccccgttggagcaagattgagtcgaggtaacaagacagtgctcactcactgcccatctttattttggcaaatactagatgggaacaccgttcatctttatttctgaaccgaaccatcattcatatcagtgcgcccacacgggatgatattaggttcagtataagatcctgatagtaactggtactgcgaacaagacagagccatgcatccacgccgtgggagtgcgattactccattgttggggaggcggggtctgcgggcgctagggctgagcacctggtgggcacttgtacacggtgccgcacccagggcgagtgtagggctggccagatggtgcgcaccgtccaccgacgcacacaggactaccggggtccagagcaccaccaccgagtcctgggcgtgctccgttgcagacggggccgctgatgatcacggcagagatgacgaagagagcgatctggaggagcaccagga

SEQ ID NO: 5463 - DNA, 519 bp, Hordeum vulgare
ggatgaagccatcatttactaatgcaaagggagctgccggctgtcagatgggttggtggtgttgaattagaattaattgccattgcgacaggtgggaggattgttccaaggttccaagagttgactaccgaaaagcttgggaaggccggattagtccgagagaagtcatttggaacaacaaaagatcggatgctttacatcgagaagtgtgccaattccaaagctgtaactattttcatccgtggtggcaacaaaatgatgattgaggagaccaagcgaagtattcatgatgctctatgtgttgcaaggaatctgatcatcaacaactcaattgtgtatggtggtggctcagcagaaatatcttgctcaattgctgttgacgctgcagcagatcggcatcctggagttgagcagtatgcaatcagggcatttgctgatgctttggatgccattccactagctttagctgaaaacagtggtttggcacctattgatactctcaccgtcgtaaaatctcaa

SEQ ID NO: 5464 - DNA, 550 bp, Hordeum vulgare
ggtccaaaacactagcctaagcagacaacacaacgaagggctaaaactggtatcgacaggatttgtgctactgtctcaagatctacaaagtgtgaaggcacatcacaaagctagatagctcatcaaatagaacaagtgagcactccatgtaagaattctacgggtaaatccaaattaacacaataaatgtgcaccctactggagtgcatgtcacttggcacagtcgatttccattatcgcaggcgccatcaatactcagaaggcgttataacatcatcgatcttgaggatcatcttgacaacctgtgttgccagcaagatctgctgctgcttgccgatcagagtctcgaaaacattctgctctttcatgtcgttggtaccaacatcattgcaatcgatgccacagcgggaattgttctccttgacgtgttgagattttacgacggtgagagtatcaataggtgccaaaccactgttttcagctaaagctagtggaatggcatccaaagcatcagcaaatgccctgattgcatactgctcaactccaggat

SEQ ID NO: 5465 - DNA, 551 bp, Hordeum vulgare
  UNSURE (11): n stands for any base
gtctcccgggnctgcaggaaattcggcacgaggtgcagctggcgtaatgatatcaacaaccgatcttgcgcaacatactgcttgaacaaattgaaccaattcgaaatctctttgctgcccttttccttgccagcattgggatgctaattaatgtccatttcctgtggaaccatgtggatatacttcttgcagctgtaattttggtgataacgataaagacatttattgtctctattgtcgtaaaagggtttggctataacaacaaaacatctcttcttgttggcatgtctcttgcacaaattggagagtttgcttttgttcttcttagccgtgcttcaagcatccatctgattgagggcaagctatatttgcttcttcttggaaccacagcgcttagcttggtaacaacacccctgctattcaaaatgatcccagctgtggtccaccttggtgttcttttgagatggttttccgtcgatagcaatcagttgggcctaaagggcgaagtcctccgcattgatagcggcaagcgcataaatttgataatccaa

SEQ ID NO: 5466 - DNA, 351 bp, Hordeum vulgare
ccaatgaatttcttgcctgcagaagggggaagttacactggggagatgacaatggcaaactcactgcacagcaaaattcatggagttgctttttctgcacactttgtggaattaatacagtggtgtaccggtcaagcctaaatcctatcatgctaatccaatcaatcaatcagattacattcttatactacagaaaaccctcattagagggatcacaccgcaagcagtgcgctcaccacccgcatcatccatgctcacaaagctggtgaaatcctcgtcttgcatttccggtcgtcactatggggaagggttgacctcgcacaccttgaatgagatctgatttcttctgct

SEQ ID NO: 5467 - DNA, 533 bp, Hordeum vulgare
ggaattcggcacgagggagaaaggagatttgaaagaacttgaagggaaatcagttgttaaggagggaaagatatctggatcacaaaaaggagattcagcgaaacatgatgtggttgataaggacctgttgcaggcttttaggtacttcgaccaaaacagagttggttatataaaggtggatgatttaaggtgcatccttcacaacttggggaaatttttatctaacagggatgtgaaggacatggttcaaattgctcttgctgagagcaattctgcaagggatggtcgcattatctatacaaagcttgtgaagaaagccgatctctgatctggacctgattttggtctttagcagctccttgagttatggaacttgttttgttggagattcttgacaatgaatcgatgatcaatggaaaatataccatccgaatagtgtactctatgtagctgggagctagttttcatttccttgaatgaatatttgttaatgaaagcaacaattgatatcgtgtatgttgacttactaggaa

SEQ ID NO: 5468 - DNA, 537 bp, Hordeum vulgare
ttttataggcctgacgtttgctgtgtgcaaaaaaatcctattgaattttcctagtaagtaacatacacgattcaatgtgctttattaacaatttattcaggaaatgaaaacagctcccagctacatagagtcactattcggatggtatattttccattgatcatcgattcattgtcaagaatctccaacaaaacaagttccataactcaaggagctgctaaagaccaaaatcaggtccagatcagagatcggctttcttcacaagctttgtatagataatgcgaccatcccttgcagaattgctctcagcaagagcaatttgaaccatgtccttcacatccctgttagataaaaatttccccaagttgtgaaggatgcaccttaaatcatccacctttatataaccaactctgttttggtcgaagtacctaaaagcctgcaacaggtccttatcaaccacatcatgtttcgctgaatctcctttttgtgatccagatatctttccctccttaacaactgatttcccttcaagttctt

SEQ ID NO: 5469 - DNA, 87 bp, Hordeum vulgare
gaggcgcagctgcaggatggcgcgaagcatccttgatgttggatgtggatggggatccctctctgtatacatagcaaagaaatatag

SEQ ID NO: 5470 - DNA, 551 bp, Hordeum vulgare
  UNSURE (11): n stands for any base
aatattactanggtaccaacctgcacgatggatgtttctaacatacaattctactttgctccagaaatgttcagcagtacttctacttctttcggaacaggtgatgtgcaaccatccattcatcaccattgttatatccgaaaagttcggcgactgagatgaagaacgtcctccaataagctatccatttggtagctgattctctcccataagtattctcaaagattggccttatggtagcgatgttcctgtccatacgtttcagccactcctcactagttctagcataatgtgtgccactgacaagccaatgattgaccacagatacatcttcctgaaagtagagaaggaggtttgctgatggcattgttcctccagtgaagaaataccttgtgatccaatcatcatcattcttgtcctcgaagtgatacgcaaatgtcttgtggcagaagtagtgaacaaacaataaggaatcctctttcatccatctggatatcttcttaagaagtgccttgtagtttttcatgtgctgcgtaacaggcccattacaa

SEQ ID NO: 5471 - DNA, 518 bp, Hordeum vulgare
cagatttggaacgttcagtttgtcgcatggtcaatcgtcaggtggcgacaattgcttggtttgaagctgattcaatttgtggtagccactctatagctattcctctagttcttgtgctcccttatttgtgtcgtttcttccaatgccttcgacagtacaaggatacaaaggagaagagttgtcttctgaacgcactgaagtactcgacagcattcccggtgatttttttatcggcactcaagtatcatgtattccctgatcagtgggttagcttttaccggcccctctggcttatttcgggtgttataaattcgctctattccttctactgggatataaagcgtgattgggatttgagcattttaaccaggattttcatgttcaaaagcccaagcacatggacaagtcttctttatgggcggaactgggtgtattactgggtgttaggcagcaacctcattcttcgctgcacatggacgtacaagctgtcggcgcatcttcggcacaactacctcaca

SEQ ID NO: 5472 - DNA, 554 bp, Hordeum vulgare
  UNSURE (59),(60),(70),(71): n stands for any base
ttcagcattgctgttattatttatgtgtaacagacacctctcaagaggattacattgcnntccgcgccannacaatttcagcttcttctacaaacctactattgtgtatccctgaccttctaagccctacaaacaaaacagaaccgtatgacctaaagccggctacaagcctgtaaagggtcatatgaaaagaatgtgatgaatgagtcacaaaacgcgatgttgtgggattcatactgtatgactactagactccagtagcctgtctgattctgagggcatgtcggatgacatttcaaaattttgcttggttgtcatcttgttccactcattctcaacgcggaagaaaacccactgaaaccgcctcagcatttccaaagctgttatcgcaaacactgtgaggtagttgtgccgaagatgcgccgacagcttgtacgtccatgtgcagcgaagaatgaggttgctgcctaacacccagtaatacacccagttccgcccataaagaagacttgtccatgtgcttgggcttttgaacatgaaaatcctggttaaaa

SEQ ID NO: 5473 - DNA, 519 bp, Hordeum vulgare
caagagttgacttaccgaaaagcttgggaaggccggattagtccgagagaagtcatttggaacaacaaaagatcggatgctttacatcgagaagtgtgccaattccaaagctgtaactattttcatccgcggtggcaacaaaatgatgattgaggagaccaagcgaagtattcatgatgctctatgtgttgcaaggaatctgatcatcaacaactcaattgtgtatggtggtggctcagcagaaatatcttgctcaattgctgttgacgctgcagcagatcggcatcctggagttgagcagtatgcaatcagggcatttgctgatgctttggatgccattccactagctttagctgaaaacagtggtttggcacctattgatactctcaccgtcgtaaaatctcaacacgtcaaggagaacaattcccgctgtggcatcgattgcaatgatgttggtaccaacgacatgaaagagcagaatgttttcgagactctgatcggcaagcagcagcagatctt

SEQ ID NO: 5474 - DNA, 549 bp, Hordeum vulgare
  UNSURE (26),(27): n stands for any base
ggtcaaaacaagtacacattatatgnntctgactacataatttacctagaggtaatttaggcaaagcaaacaaaagaaagaaacgattacgataaagcagacaaatttgtggtccaaaaccatagcactaagcagaccaacacaacgaagggctaaaactggtatcgacaggatttgtgctactgtctcaagatctacaaagtgtgaaggcacatcacaaagctagatagctcatcaaacagaagtgagcactccatgtaagaattctacgggtaaatccaaattaacacaataaatgtgcaccctactggagtgcatgtcacttggcacagtcgatttccattatcgcaggcgccatcaatactcggaaggcgttataacatcatcgatcttgaggatcatcttgacaacctgtgttgccagcaagatctgctgctgcttgccgatcagagtctcgaaaacattctgctctttcatgtcgttggtaccaacatcattgcaatcgatgccacagcgggaattgttctccttgacgtgttgagattttac

SEQ ID NO: 5475 - DNA, 518 bp, Hordeum vulgare
gggggccgtcgccatgcgcctgcacaccaaggaccaggccagggagggggagaaggagccccaggcgccccccgtcgccaggtgggagcccaccgtcgagggctacctgcgcttcctcgtcgacagcaagctcgtcttccagaccctcgaggacatcgtcgaccgcgccgccgtcccctggtatgcggattttaggaatactgggttagagagatcagagccactgaagaaagatctggaatggttcacggaacagggtcacaccattccagaaccaactgctgctggtactgcatatgcttcctatctggaagagttgtctgagaaggacccccaagcatttatctgccacttctataatgtgtactttgctcatactgctggaggccgaatgattggcaaaaaggttgctgagaagattctgaacaagaaagagctggagttctacaagtgggaaggtaccctgtctcagctgctgcagaatgtccgcaccacactaaaccaagtcgcttctagct

SEQ ID NO: 5476 - DNA, 556 bp, Hordeum vulgare
tatgttatgacaatttgattgaaaggcagttcagaaccggcagagcatgttcctccccggtgcacagacatggcttagtatttacaatgttcatcgtgaaacgtaatggagatcgttcttggctcaggtgaatatctggcgtaggaggtcccctgagtaggcaaacgacttctcggtctcctccaggcagtggtccttctcttcccgagaccagctagaagcgacttggtttagtgtggtgcggacattctgcagcagctgagacagggtaccttcccacttgtagaactccagctctttcttgttcagaatcttctcagcaacctttttgccaatcattcggcctccagcagtatgagcaaagtacacattatagaagtggcagataaatgcttgggggtccttctcagacaactcttccagataggaagcatatgcagtaccagcagcagttggttctggaatggtgtgaccctgttccgtgaaccattccagatctttcttcagtggctctgatctctctaacccagtattcctaaaatccgcataccagggg

SEQ ID NO: 5477 - DNA, 519 bp, Hordeum vulgare
ggggttgctgccggccctggccctggggccgtcgcggatggggcggaagcggaaaggccattggataagacgttcggattcgggaaaaacttcggggccaaatacgagctcgggaaggaggtggggaggggccatttcgggcatacctgctcggccgtcgtgaagaagggcgagtacaagggccagaccgtcgccgtcaagatcatctccaaagctaagatgacaacagccatatccatcgaagatgtccgtagggaagtgaagattttgaaagctctatcaggtcacaacaatcttgtcaaattctatgatgcatgtgaggatgccctcaatgtctacattgtcatggaattatgtgagggtggagaattgctagacagaatattagccagaggtgggagatacacagaagaagatgctaaagcaatcgttgtacagattttgagcgtagtggccttttgtcatcttcagggagtagtgcatcgtgatttgaagccagagaacttccttttcacaaca

SEQ ID NO: 5478 - DNA, 548 bp, Hordeum vulgare
tgggggcttgggaaaaatttgaacctatatttctcgaacaaccatccgatcgccttcattacaaaagatttttacatgtattctctctacaagagctatggtgacaacaaccgacaacatcacaaaaaggaagaagaatgatcattaaccacaagacagaagaagcaggggtggggcaacagcaaaatcaggggagccatataatgagcaacggtaaaattagaaccagatacattttctttggtccacggttacttaatgccgtcttgtgtttgcaccccgtattgtaacaccatgtaaaaatttggtaaacccaagaaagtttagcttgccatccgtttttctgatccaatcttgcacgatggaataatgagtcggagcaagatttagttcctgtgccaactcctcgactgatatgactcggttgccctcctgttcaaagtgctgaaaagctgttccagcaatctcctcccatctgtccagagcctcgagctggtaagggctgatagctgcggcacagaattcttcgaaatccatactcctgtatg

SEQ ID NO: 5479 - DNA, 367 bp, Hordeum vulgare
  UNSURE (2): n stands for any base
gnaattcggcacgagggactgatcgtgctcgatctatatatgagcttgctattgctcagccagcccttgatacgcctgaagttctatggaaggagtacttgcagtttgaaattgacgaagatgaatttgatagagcaagagaactgtatgagagattgcttgatagaacaaagcatttgaaggtatggatcagctttgctgaattcgaggcctcagctggcttgggagaagacgatggaagtgaggagaataagaatgatgctggttatcaggaacagcagacagagcgggtccggaggtgtcgggctgtctttgaaagggcattcgactacttcaggaccaatgctgcagagctaaaagaagaaag

SEQ ID NO: 5480 - DNA, 495 bp, Hordeum vulgare
cccatacagctcgtacaatttccccaatggaatttctgactgcagacgctccgtttcgatgttaggaaaacactcatctggcagtttagcaccaggtaccaaatgggagaaacatgatatagtgctaagctcaaataatacatgtttgagttacattcaacccaaggaaccggggtaacaaaaccaagataaaagttgactcctaacaacgaacataccgttcaatccaggggtaacagaacccagataattcagcatccatccgtcagaaatacagcttcaataactccactgaacaagctgcaaaaaggccatatgtagggtataagaggcagcgcaaactccacgcctacacccgagcgtaatggaaaccttctctacgtctgatttttgcatggtagcactcgtctcggacggtgggaaaccattcacaacaggcggcctctggatgttcagatcagtcatcctgtgtgtcgtttgccttctgcttcttcc

SEQ ID NO: 5481 - DNA, 512 bp, Hordeum vulgare
ctcaccttcttctgcttagggaacagggaggtgaagaggagtggggagtatgaacccgctgatcgtccattgcctgggtcagcctatgaaagggcacaaaacgctcggcggttcatgatctatgttcactccaagatgatgatagttgatgacgagtacatcatcgtcggatctgccaacatcaaccagcggtcaatggacggggggagggactccgagattgccatgggcgcattccagccacaccacctgaacgccaaaggccaggttgccagagggcaggtccatggcttccggatgtcgctgtggtatgagcaccttggaatgctgcacaacgatttcgtcagcccgggaagcctggagtgtgtccagagggtgaacaagatggctgacaagtactgggacctctatgctagtgatgaactgaacgacgacctccctgggcaccttctcacctacccggttgccgtgacaaaggacggcacggtgaccggagctgcccggtgcgaggt

SEQ ID NO: 5482 - DNA, 558 bp, Hordeum vulgare
attcttaaagtccttcagtactctaaagtatgcatcttgcaagacagaccaaggctagccagcagaatgttcaggctttaggtaagacgatcagctatagactctgactagaaccatcatatagaggtagcaacaatagaataagcttacagtgcgggaagcgcatcatatctagctagaagcatcatctagcattgccgaggttgcaactatgcaaatgcatcctatgtggtgagaatagggggcaggtgtttggatttgattccaagcaccggagcctgcgtgtcggggaagcacctcgcaccgggcagctccgtcaccgtgccgtcctttgtcacggcaaccgggtaggtgagaaggtgcccagggaggtcgtcgttcagttcatcactagcatagaggtcccagtacttgtcagccatcttgttcaccctctggacacactccaggcttcccgggctgacgaaatcgttgtgcagcattccaaggtgctcataccacagcgacatccggaagccatggacctgccctctggcaacctggcctttggcgttcagg

SEQ ID NO: 5483 - DNA, 358 bp, Hordeum vulgare
gcctgcgtgccgaattcggcacgaggcgaacgcccgcccaataagcggcgacggcgccatgggggatcggccaaagcttcctgcccgctacgagcaggtgaagctgctcggcgagggtaatttcgccaaggtctacctcgcgcggcacatggataccaaggaggaggtggccatcaaggtgatggataaggagaagctgatcaagttgggcgccgttcaacagatcaagcgcgagatcgccgtgatgcgccgcctgcgtcaccccaacatcgtgcagctccacaaggtgatggcctgcaagtcccgcatcttcgtcgtcatggagtacgtccgcggcggcccgctctaccgccacatc

SEQ ID NO: 5484 - DNA, 552 bp, Hordeum vulgare
atccctgctgcttttaccccacaataaattctctaaaatttcaagcaacattcaccgtcgggggaaggccatcctcaggcaggccatccacgagacctcgaagaccaggcttgagctcactgccgcagaattgccggtattcagcagtgtctccggctttcttgcatacctggaccatgacgagctccggcgtgagctggaatatcttggtggatatggccagcgctcccttgtgcccatttcttgtcgcctcgaagctcacttggcaatccttggtgcgcgccgtgaagctaacctgccccgcgatctcctccagcttggagatgatggtgttcaccggcgcgctggacacgaaacgcaactgctcgccgcgctcctcaaacagcccggacagatcgaagcttggcgaggaggcgatgatgtcgaacgcgttcatgctcttgatccgtcttatgcgtggctcggtggtacgagctgcagcaatgtgcatcttctccagatttaccagcgacggcgctgacaccgaggtgtgcatgccgccgtcgccatgtg

SEQ ID NO: 5485 - DNA, 433 bp, Hordeum vulgare
atcgcctcatcgagctcggctcacatcacaagagttgtatcgaagctctagctagtcacgtcgtatcgcatcgaagccgaagaagcaattaatggccgccttcaccaccaggccggcggccttcctcggcctcgccgtcgtgctctgtgccctcgccggcccggcgaccgcgcagcggctctcgcccaacttctactcgaggtcctgccccaacctggcgtccatcgtgcggtcggggatgacctcggcgttgcagacggagaggcggatgggcgcgtccatccttcgcctcttcttccacgactgcttcgtcaatgggtgtgacggctccattctgctggacgacacgtcgacgctcaccggcgagaagaacgccgggccgaacgccaactcggcccgcgggttcgacgtgatcgacgccatcaagaccagg

SEQ ID NO: 5486 - DNA, 370 bp, Hordeum vulgare
tttttttttttttttttacgtgaacctgaccaatgcctggtctttccaaggcatcaaccattattcagcacacttgttacgtctacttgcccttaatttagttgggcctcctgcaattgagcctgacctccgtccgcgtcccgggcgacggcagcaggccgcccatcttgagcatggccgtgacgaagtcggcggagaactgcccggggctgctgctgtactgcctgaccagcgagtcctgcgacccgccgttgaagagctcctggtccgagtgcaggaggccgcgctgccccaccaggttccggtagtaggcgttgtcgaacccgtcggcggtctgcgcgtccaagggcgcgaggctgctgccgcctcc

SEQ ID NO: 5487 - DNA, 517 bp, Hordeum vulgare
agtccaggagcagagccaggcgtccgcgctggcctccatcgacaagctcagcgagactcttgaaatgttagaaaagaaggaaaatttactaatgaagaaagcaaatcttgaagttgagaaggccaaggcgttcaccaaagccaagaacaaaaaagctgcaatacagtgtttgaagaggaaaagattatatgagcaacaggtggagcagcttggcaatttccaattaaggattcatgatcagatgataatgctggaaggtgcaaaagctacaacagagaccgtggatgcattgagaaccggagcatcagcgatgaaagctatgcacaaatcaacaaatatcgatgatgttgacaaaaccatggatgaaattaatgacaacatggagaacatgaggcagatccaggatctactatctgcgcctatgggagcagcaagtgatttcgatgaagatgagctggaagctgaacttgcggatttggagggcgaggagttggaggcacagctactggcacctacc

SEQ ID NO: 5488 - DNA, 540 bp, Hordeum vulgare
ctttttagctgataatgcgctaatagcgcatcttagatgtttgattacaaagtaacatgataaaatattatacataagagatcatcagggtgagatgcaactagtttctgtgtgtacttctgacgtcttcacaggaagacctccatgaaaacaccgcgcggtcccaatatatttgcagaatcggtctctaaacatgaccacaccaagtcctgcaaactaattacatagccatttctgcttgtaaagctgccagctcatcgtcttcggttttactactctgagcagtgggccgactcgactgctgaggtacccgcgctggagcagtcataggagcacttgtggtaggtgccagtagctgtgcctccaactcctcgccctccaaatccgcaagttcagcttccagctcatcttcatcgaaatcacttgctgctcccataggcgcagatagtagatcctggatctgcctcatgttctccatgttgtcattaatttcatccatggttttgtcaacatcatcgatatttgttgatttgtgcatag

SEQ ID NO: 5489 - DNA, 520 bp, Hordeum vulgare
ggtcggtcaagtcgttcaacagtattatcatgaagttcgcgaaaatcgacaagggcttgagaaaatgcaagactatctttcagcaattcgatgaagattccaatggtgaaattgataaagaagagctcaagaattgctttcagaagctggaaatctcattcacagaggaggagataagtgatctctttgaagcttgcgacataaatgaagatatgggcatgaagtacaatgagttcattgtctttctgtgccttgtttatcttctcaatgaccctgctgcatcagaagcaaaaacaaagatgggattaggagatcttgagtcaacttttgagaccttggttgatgcatttgtcttcttggataagaacaaggatgggtatgtgagtaaggatgagatgattcaagcaataaatgagagcataccaggggaacgctctgctggccgtatagccatgaaaagatttgaggagatggattgggacaagaacgggatggttaccttcaaggaatttctgtttgc

SEQ ID NO: 5490 - DNA, 549 bp, Hordeum vulgare
gttatagtgtaatctctaaaagacttatatttaggaacagagtagtattaagctacacaagaccaaattaacatgggtgagccaaggttgttgctgacacgagccctcttgctatcaatgtttcaatattttgcttactacacaacataacttgcaatggaggcgaagccgtcacagacactgtttggtacaggtgttcagacatgtcagtccttctatggaacatgccgagtcactattaacagaaagataaaaccaccacgcaaccaatttatagtcagccattcttcggctgtcagcttccacatcattcattcatcttcgtcctcgttttcgcctatcccaacccagcgagtgaatgcaaacagaaattccttgaaggtaaccatcccgttcttgtcccaatccatctcctcaaatcttttcatggctatacggccagcagagcgttcccctggtatgctctcatttattgcttgaatcatctcatccttactcacatacccatccttgttcttatccaagaagacaaatgcatcaaccaaggtc

SEQ ID NO: 5491 - DNA, 516 bp, Hordeum vulgare
gccttcgttgtcagcaagaacgccgacgagatgaaggctgcgatgagcaccatggatggcatcataaacacggtgtctgcaaacatccccatggcccctctcttcgggctactcaagcccaacggcaagatggtcatggtcggcctcccagagaagcccgtcgaggttcctccctttgctctggttgccaagaacaagaccctgtcagggagtttcatcggcggcatgagcgacacccaggagatgctggacctcgcggcgaagcatggtgtgacggcagacatcgaggtgatcagcgcggaatacgtgaacacggctatggagcgccttgccaaggcggacgtcaggtatcgattcgtcatcgacattggcaacaccctcgacaaggccgccgccctgccaccgagtgactgactgaccgccaaacataactcagcactgctcacggtccacgttggtctctggttctctgctattgtcagtggtggtaacaatgaagaatctaaagttcttgtc

SEQ ID NO: 5492 - DNA, 535 bp, Hordeum vulgare
taattattagtggctagatgtacaaatagcatcctcagtgcacacaaatggaccgatagagtttacaacctctttgatttgcaggaattctaaagcacatgaatataacatgatgccgttttgaataccacacgaatgtttggatgtttaattgtacacatgaaaactatgagattcttcactggaggatggagtggatgaaaatttcctatgagaaaagttcgaaagggatcctccaaaattcctttgacaatcctttgaaaccaaagaggcccttagacaataggaaagcagtaggaagaagctccgttatcccggcaagaagcaaactgtccatccatcctccaaacgcagttttctcacgaacaacatcgcaccatacatcagtgacaagaactttagattcttcattgttaccaccactgacaatagcagagaaccagagaccaacgtggaccgtgagcagtgctgagttatgtttggcggtcagtcagtcactcggtggcagggcggcggccttgtcgagggtgttgcc

SEQ ID NO: 5493 - DNA, 518 bp, Hordeum vulgare
gtcatcgaaatgctacttttcgatagcatgctacttgcaccacaaatacaagtcaaccaaatcgaccacttacaggaagaacggagaaacttgcacaattagctatggctctgggtcaattgctggcttcttcagcgaggacagcgtgttagttggcgagcttgttgtaaaaaatcagaaatttatcgagacaacccgtgaagcaagtcctacttttatcattgggaagtttgatggtatacttgggctcggatttcccgagatctccgtgggaagcgcccctccaatttggcagagcatgcaagagcagaagctgatagagaaggacatcttctccttctggcttaaccgcgaccctgatgcatccgcgggaggtgaacttgtgttcgggggtgtggacaaaaagcactacaaggggaaacacacgtacgttccggtcactcgcaaaggctactggcagtttgacatgggtgatcttctcattggtggcgagtcaactggcttctgtgctggtggtt

SEQ ID NO: 5494 - DNA, 551 bp, Hordeum vulgare
cactcaaaagaaaatcattaggacaattgtctctaaatatctactgctcatgagaccatgctaagagacggtgcattgggagtggccttataaaggatgattctcatcgtgcttattacatcaacctcgtatcgtgtgtgctgtgtgcaggtccatatcaagccatacatagcaaatagctatacaaatgctggtagcaagttcatctgttcctttctactaataagtttcttgttgaccttgcaactcacacgtgcttgcagtatatacataccggccctgagccctgatacacgggagatgctgggattcacaagtcctcatgcggacttggcgaacccaatcctgctctcgccaaagtcgaaaacggtgtgataggcgcccatgaagacgtctccaagtatccagagcgggccgcgagggggtggtacatcgaacgccatgaacccactgatgcaaattgtctggcctgattgctccagcctcactacgtactgctctggcgtcaaggtgaaagtcttgtttgctatggtgaaagcaagatcaggcat

SEQ ID NO: 5495 - DNA, 519 bp, Hordeum vulgare
  UNSURE (20): n stands for any base
ctgaagtgccggcagcaggngctcccccaagtaccacgagaaaatgagttgcagcctgggctcatggattaaagtttgaaaccagctttcatagacccggatgctattgaagcgatagctggcttgactttgcttttcttcaaagcatcttgacaaaccaaaatccgtcatttttggcaccatgttttcgtctagcaatatatttgcaggttttaggtctaagtggtgaatatcgatctctgaatatattgataaccttcacaaatttgctgattatttttgtagcgctctttcatgagaaatgattgtcccacatgcatatccatgactaaaaaaagcaaaaaagtaataattgggtgttgtgttctcacaaagaaagatggaaaagtttaacaaaaacttgtgaaggaagatgaatgctttgattatgcatgaatccataatgataaagtgctattgaatgatcaagtaatttgtaaggtttttattatcttcgcaagagttgtattgttaatttag

SEQ ID NO: 5496 - DNA, 542 bp, Hordeum vulgare
atcggcttaatactgaaggcaaaatgatctaatacatgtactctgtctggtgctaaacaacaattgtacattggtggacttcgctgcagctctttggaacatttatctcttagacaactaatgccacttgacctcctccaccagcttgaagtacctaaagatgtacactaggctctaaaaaaaagaggttactgaagcatgtcatggaacataagtgagtataccagcacaactgatgtctgaatatgctctttgtgttttctgttttgtaagtcaattgactattatgtgcatagtatgtgtttctacgatgctccccatgatttcgaccttgcaagtgagtattgcaaccataggttatgatatatacataccttgttatcaggcaaacaagtgggccaacacaggtcatcaatgtccctgctttcatacatagatccaaactgttttgaagcaatagcctggctttgtttttcctccaagcaacttgagagacaaaaatccgcaactttcagcattgtgctttctcctagaaatatact

SEQ ID NO: 5497 - DNA, 176 bp, Hordeum vulgare
ggttggagaaatgagctgggagctatccagaggtcgcaacctttcaacttcaaatatgcatgtgctggatattccatatacctagatgacaaggagagctctacaccaaagggagagaagtatgcagagctccctatttgtgttggagttgagttattgacagacagagctccaac

SEQ ID NO: 5498 - DNA, 454 bp, Hordeum vulgare
tccgcaaggaagccaaatggcggcctattattattattattctccaaggctccttaaataggcgaaagatgagctctttcatagttttgttacattgctggaggaaccagcagaatgaagattgcattgcaagttgggcagcggagaggctctattaaaggaacacaataagaatcgaaacaggcatgtaacagcctgttagcgttaggcatgagctgacaaacagcaaaaccacagccagagcctcagaaaccaagcgaggctactcctacgccagtgcctctggaagtaatagattacatgctcccacatttttctctattctactccaggatttaaggagaacaagtactagattttacttgggacgcttgcggtatgggtacaggatgtcatccaccgtgtctttcacataagtcccaactttattcatgttcctaaccacaccactggc

SEQ ID NO: 5499 - DNA, 959 bp, Hordeum vulgare
  UNSURE (533)..(556),(558)..(573),(575)..(591),(593)..(607),(609),(611),(612),(614),(616)..(618),(631),(639),(640),(646),(648),(665),(686),(696),(700),(743),(824),(945): n stands for any base
tgtcccccgggactgcaggaattcggcacgaggagcagccaccctttaaagagtgcgtaatagctcactgatcgagcgcccttgcgctgaagatgaacggggctaagcgatctgccgaagctgtgggatgtcaaaatgcatcggtaggggagcgttccgccttagagggaagcaaccgcgaaagcgggggtcgacgaagcggaagcgagaatgtcggcttgagtaacgaaaacattggtgagaatccaatgccccgaaaacccaaggtttcctccgcaaggttcgtccacggagggtgagtcagggcctaagatcaggccgaaaggcgtagtcgatggacaacaggtcaatattcctgtactaccccttgttggtacggagggacggaggaggctaggttagccgaaagatggttataggtttaaggacacaaggtgaccctgctttttcagggtaagaaggggtagagaaaatgcctcgagggggggcccggtacccaattcgccctatagtgagtcgataaaattttaaannnnnnnnnnnnnnnnnnnnnnnnannnnnnnnnnnnnnnnannnnnnnnnnnnnnnnnannnnnnnnnnnnnnnanannanannnaaaaaaaaaaaanaaaaaaannaaaaananaaaaaaaaaaaaaaaanaaaaataaaaaatataaaaanaaaaaattanatanttaataattttttttttttatatttttatttataatttatatnattattatatttttattatattattttttttttaatttttttaatttatatatatattaaataaatatataattttttatnttttaaatttttttttatttattatttttattttttttatatttattaatttttatttttaattatttttttttaataaaaaatatttttttataaatatatattttttttattttttttntaaaattctttttt

SEQ ID NO: 5500 - DNA, 572 bp, Hordeum vulgare
  UNSURE (4)..(10),(41)..(48),(64)..(69),(149)..(153),(181)..(184),(202)..(213),(218)..(229),(245)..(250),(344)..(347),(492)..(495): n stands for any base
gatnnnnnnngttacagcactggaccacacgcctgcaaaannnnnnnntctggacagaaaaaannnnnncacaaggttgtcatggcaagggccctttgatatgttgcaccttgccaaggccagatccccagggacatcaggcaaccccnnnnnatgctgcagaaaagcaaccatccaccgnnnnacacgcacacagcacacnnnnnnnnnnnnacacnnnnnnnnnnnngaccgtgaagagactnnnnnnggaacaaggacaaactgagagaagttgtagcagacacctagaggcggatcgaagaaccagagctaagcttctacgacaggcacacaccgacaannnnaacttgctatggaattgaaaccagaagtactgatgtcccacaactctggaacaagattgtactggaaaagaagacacaactgacaatatttgagctcccacacagaacttgataaggagagaaaaaaagaagcatggtgtagggnnnntaatcacaagggcataggttgggggtagagggacagggtgccacgctaatggcagccgaaggctcaaggaacaggca

SEQ ID NO: 5501 - DNA, 415 bp, Hordeum vulgare
gtcctccgggcctgcagggaattcggcacgagggcagaatcggccgctcccgcctccccgagcgagcgcgcgcaatgggagccgcctgcgacgacgccgtccagcagctcgcccgcctcctcgaccaagtcgaggagccgctcaagaagacgttccagaatgtgcaccagggctatccaacagagacactggtgcgcttccttaaagccagagagtggcatgtaactaatgctcataaaatgcttgtagattgtctgaattggaggatacagaatgaaatcgacagtatactggagaaacctatagtcccagtagatttgtatagaacaatacgagaatcacagcttgttgggttatcgggatactcaaaggagggcgtcccagtatttgcctttggtgttggacagagcacata

SEQ ID NO: 5502 - DNA, 479 bp, Hordeum vulgare
caccatttatttctgattgaaggatgatacactcaagattattttagcatccatgttacaggatgatttagtcctagcttacaggatgatttactcatagcttacaggacatacatatgacagtacattgccaaagtatacatcaggtgaataggtggttatttctatctagtatacatccgttgcttcttctacctcagtcttgcaccatggaactggtcaccccacaaacatcagcaggccggtcaagcaaacgtcgcaaataccgaaatggatcatcagtttcatcacagcaacacacatttgtcatgccacgtcgctgacatcttacacggacaccgttatttatggtcgccattggcagacccatcctgctcactgagcttgtgaaactcggcctggatgacctccacaatcatggcgtcctcggtgtcttgctcggggatgtctacatgcaaagaaccctgcttgatgagttc

SEQ ID NO: 5503 - DNA, 512 bp, Hordeum vulgare
cggacgtggagtcgcggcggatcgagcagcagcccgacaacgtgaccatggcggaggccgtgggcgtgctgcgcaacatgttccccgaccgggacgtccccgacgccaccgatatctacgtgccgcgctggtggtccaaccgattcttcaagggctcctactccaactggcccatcggcgtcaaccgctacgagtacgaccagctccgggtacgacccaccagtaggccacgccacgcaggcgtatacagtgcgccgatgctgaaacttaggcatcatatatatgacttgtcgtctttgattgatcatgatcatgatcatgatcgcatgcatgcaggcgccggttggcgggcgggtctacttcaccggggagcacaccagcgagcactacaatggctatgtccacggagcttatcttgcaggtatacactccgcggacattctgatgaacaaggccctcaacaacgtcgactttaaagtccgtcccaagtatgacgacgagctgaaagctga

SEQ ID NO: 5504 - DNA, 535 bp, Hordeum vulgare
agagtgttgtcaatatagacccttcagctcaaggacgaactttaggcctcgacggccaagtgtttttattcgataaattacaagaaattacatcactggaacgcttcaacaggaaccacatactctcggagaatccaaacacgggaggcacgaaagaaagctggaacgtcacattatttcgcctcacatcaaattcttggggaaaagcttccacgttaactgtggcacgcgtctgagtttattccatgacgatgcatgcgagcagactggcatggcatctcaacttcctccttcatttagcctgcagcgacgagtagattcaagcagtgtatttttcagaaattcagcagatcttacatgcatctttggtgcagacaccaagagatcaaacgttgatggattagttgtacgtatgtatatatatacctcagctttcagctcgtcgtcatacttgggacggactttaaagtcgacgttgttgagggccttgttcatcagaatgtccgcggagtgtatacctgcaagataagctccg

SEQ ID NO: 5505 - DNA, 518 bp, Hordeum vulgare
gtttcggggatgatgagctaaggaggtatagctcgtgcaagccgccgcgcctttgttgtttctgataaacccacgagcaggagccagtcttgcttgaggtggtagcgagagatggatgcggtgtccgaggttgccgatgccatcggtgcattgggtgttgacaatgggccgagccagaaatttctgcccaaagacagtccagacaacgaagagttggccgatgtggcgctttcgggcgagagtgaggtgattaatccatctgaagaggtgggtggggaagccacctcgccatcggaggacgtaaagtcacaaccggaggacatcaaggcccgtgttcccaagggaagccacagccgttcccctaaggttaccaaatcacagcgccagagcccacggagcggcgataagagtcaagctaagaaaaacactcccagttctccgtatactaaggcacccattgcacgagtgtccgatccagatttagttgatagctcttcaagcaatggtgatgctgatgt

SEQ ID NO: 5506 - DNA, 554 bp, Hordeum vulgare
  UNSURE (5): n stands for any base
ctggnaaatcaagggtagtatatgcaaatgttacttagctacaaataataccactcccttgtactgtttgaacacaacacaactgagaagataaacggtacattggctacttgccatgttccaaactccaggtgattacactaattcaagcacatgataccagccagaagttcactacccaaataacaaaaatgcagaaatgggaggctgaggcatgactctcagctttccgaaagactgaactcgattgttttctattcgttgatcacatggtcatctggagtaacctgagcacggattggcgtcaggatgggatctgcagttgagttgctaatttctagctgttctgcagaagatatagaagttgcaatgtcaacagaacctgtctgctctgatggcaatttggggagagatttccgttgggacttcttgggagcaggtgttgtcttggcgctgttttgggaggccctttggtcaaggctcagacgaactggacggcttgaaggattggtacttactgttgtgactgctgaggttgtgttctttgagcgacc

SEQ ID NO: 5507 - DNA, 518 bp, Hordeum vulgare
cacctgtggtgtcagatggtgttgtccttccctggttgcaatgggaaactagcaacgatctacatgcctcccccaccacaatcaagacacaggacgcaagcactgcatgcagcactagtagtcacaccatgagcagccgtgggagctggagccctggagaccatgatagctcagctggctcaaaaggtggactactctccaggtttgacgaggccgcgactcgcctaagcagctgccctgataacaaccgaagcacgtcgttccatgtggacgactatctgcatctgcggaggagcgaggatttcctctttgagcgattgagtcagaagcaaaggatcaactatggcggtctaaccgtatgcgggagatcgacaataatgtagattattatggcctaggattctcctgctgggttcaggcggcgaacatatttaatgtgcccagttgataattgattgattgggttaagttaggctaataagtgtgtagatttagggcctgtttagtagggagctaac

SEQ ID NO: 5508 - DNA, 548 bp, Hordeum vulgare
  UNSURE (11),(24): n stands for any base
ttcattcatgnttttacaggctantggctctcatgcccatcttgctactcaaaacctgtgataggattctgttaaccaagtcaaaagagggctaaattctgaaagaaaaaaaaagaaaaaaaaactaagccaaagttagctccctactaaacaggccctaaatctacacacttattagcctaacttaacccaatcaatcaattatcaactgggcacattaaatatgttcgccgcctgaacccagcaggagaatcctaggccataataatctacattattgtcgatctcccgcatacggttagaccgccatagttgatcctttgcttctgactcaatcgctcaaagaggaaatcctcgctcctccgcagatgcagatagtcgtccacatggaacgacgtgcttcggttgttatcagggcagctgcttaggcgagtcgcggcctcgtcaaacctggagagtagtccaccttttgagccagctgagctatcatggtctccagggctccagctcccacggctgctcatggtgtgactactagtgctgcatgc

SEQ ID NO: 5509 - DNA, 519 bp, Hordeum vulgare
aagaaaccttcatgccagaaaggttttatccttgatggcttccctagaactgttgttcaagcacaaaagctcgatgacatgctggcaaggcaaggcgctaaagttgacaaggttttgaactttgcaattgatgatgcaattttggaagaacgaattactggccgttggatacacccatcgagtggtagatcttaccatacgaagtttgctcctccgaagactcctggagttgatgatgttaccggagagcccttgattcaaaggaaagatgacacagctgcggtcttaaagtcaaggcttgaggctttccatatgcaaactgaacctgtgattgactactactccaagaatgggttggtggtaaatcttcatgcggagaaaccaccaaaggaagtgaccgttgaggtgcagaaagccctttcatgaagcagcccattttcacattgaaaacggcatgtaccaaagcccttgtccgggttcctagaactaggaagtaataaactgataacggcatcgtac

SEQ ID NO: 5510 - DNA, 556 bp, Hordeum vulgare
gctcatgtatatgaaaaaggatgtccatatgtataaaataatgctcatttgtacggctaaatcgctcggaccaatcatgagcttgcaaaacctgtaacaaaatggtgcaatcacgcacatggcaggcagaaaatgtgaattgtacgatgccgttatcagtttattacttcctagttctaggaacccggacaagggctttggtacatgccgttttcaatgtgaaaatgggctgcttcatgaaagggctttctgcacctcaacggtcacttcctttggtggtttctccgcatgaagatttaccaccaacccattcttggagtagtagtcaatcacaggttcagtttgcatatggaaagcctcaagccttgactttaagaccgcagctgtgtcatctttcctttgaatcaagggctctccggtaacatcatcaactccaggagtcttcggaggagcaaacttcgtatggtaagatctaccactcgatgggtgtatccaacggccagtaattcgttcttccaaaattgcatcatcaattgcaaagttcaaaaccttgtca

SEQ ID NO: 5511 - DNA, 477 bp, Hordeum vulgare
ccctatgacctcaacgccttcaagttcagccccatcaaggagtccatcgtctcccgcgagatgacccgccgctacatgaccgacatgatcacctacgccgacaccgacgtcgtcatcgtcggcgccgggtccgcggggctgtcctgcgcgtacgagctctccaaggacccctccatcagcatcgccatcatcgagcagtccgtgtcccccggcggcggcgcgtggctcggcggccagctcttctccgccatggtcgtgcgcaagccggcgcacctcttcctcgacgagctcaacatcgagtacgacgagcaggaggactacgtcgtcatcaagcacgccgcgctcttcacctccaccatcatgagccgcctcctcgcgcgccccaacgtcaagctcttcaacgccgtcgccgtggaggacctcatcgtcaaggagaaccgcgtcgccggagtcgtcaccaactgggcgctcgtctcc

SEQ ID NO: 5512 - DNA, 553 bp, Hordeum vulgare
aatcactaacattaagaaaactataagataacatcggaattaaacaccgagtctgacaaatcacataggcaagccctcgtccctaagcatcctctgtttcaccgaaccatcttattgatttgttgcccccaaacaccagctcgttgcttaggcgtcgacgatgtcggcgttgttggtcgccgccaggatcatctccgggtgcagcgccggggtaacgttcttgagcgtcccgtcgatgccgttcggccggccgagggccttgagcgccaggtgcgccgccttctggccggagatcatcatggcgccgaaggtcgggcccattctcggggcaccgtcgatctcggcgacctccatgccggtgacaatcatgcccgggacgacctcgcgggtgaggcgcacgatggcgtcctcggccgtgttcatgtcaagcgccttcatcccgggcaccgcctggatcatgccgatgtcctggagccgcttgaccccggtggcaccgaagggcccgtcgtggccgcaggagctcaccacgaccttggcctccatgacgttgggg

SEQ ID NO: 5513 - DNA, 549 bp, Hordeum vulgare
  UNSURE (20): n stands for any base
gtacccccgggcctgcaggnaattcggcacgagggaggatatggccgaggccgacgacgcggccgccgcccgccggcgcaccgtgatcacggagtaccgcaacaagctcctcaacgcccgcgagctggagacgagggtccgcacaggcagggaaaacctaaaaaaggcaaagaaagattatgataaaactgaagatgatttgaagtccttgcagagtgtgggccaaatcattggtgaagtacttcggccattggacagtgaaagatttatcgtcaaagccagtagtgggccacgttatgtggtcggctgcagaagcaaagttgacaaagaaaagctgacagctgcaacacgagttgtccttgacatgacaactttaacaataatgcgcactctaccacgtgaggttgaccccgtggtctataacatgctacacgaagaccccggcaatgtcagttactcagctgtaggtggactgtcagatcaaataagggagctgcgggagtccatcgagttgcctcttatgaatccagaattgtttcttcgcgttgg

SEQ ID NO: 5514 - DNA, 555 bp, Hordeum vulgare
ttaaattaccaagttttaccacagttttttgcattccgatcaaggcacagtaacttcatctcaaaaaaggccagtaacttggagaaacaaacaatgtaaatctaacaagagatcgctcgcaagccagccagtttcggactttcgcttacatcaacttgcgcggcaaaggcagtagtcatcccacaacatataaaaggtagaaacacatcatgttcgatatcttccgggtcgggatgacaaactccaccatggtacaagaaaacagacagtgcgtcgcctgacagtctcctaccctcgtcttagtccttaccaaagtcggcactgtagtgcgcgctggactcgagcttcttggcgtcattcaatttccgcaccgccttcatgaagtcttcgtggatgacgtagtcacgctctgctcgaatggcagccatgccagcctcagtgcagacattgcgaagatcggcaccattgaagccctcggcaagcttaaccacagcctcgtaatcaatttcaccatgcttagcgataccagccgcatggattttcaggacctccgtc

SEQ ID NO: 5515 - DNA, 518 bp, Hordeum vulgare
cggccgctgcctatggcgcggactccgaggacgaggactacgcgggcggcggcgacaaggatgaggacgacgaggactacgtaggcggcggcggtgacgacgacgacgacgaggatgccgccctcgccgctgcgtccgcggcggtggatgagaggaggaggaggaggcccgcgaagaggcagaagaggagccaccaagcgccgggcgggagcgagggcgcgagtgggagggggactgtgaggaccctctccgatctcggaggcggcaaggggcgcgcggggtcggacgaagacgaggactcggacgacgacgagtgggcgccaccccctgagttgtacaccggcggcgagaggagaagtgctatagaaattttcacttagcagcatggacaaaaacggaatggctgttagagatcgatccaaacgcaaaaatgttgcggatgaggttttcaagcaagctatgaggaagggagctaagcaaggcccagctcgccggcaaccttctagttcaaggagctt

SEQ ID NO: 5516 - DNA, 544 bp, Hordeum vulgare
taagaacagtgcctgctaacaactaaccccggtcgctcgcaaatagcaatcggtgtcaggacaacggttcgatgaaaacaacgaaacatgaatgatgggcgtccgttgcagctaaccatccctgtcccacgaccgtaccagacaggccgttagtagacacgaacaaaaggactgccaacagaccggacaggaagcagaagtgcaagccaagtatacttacgctatagtagatgatgaataagacggacgggtacccagatcttgccgatttttacaaatcttaatacccgaggggcggctggctcaaaagctaaaatccaagagagctcagggacggacaaaagggcaaggaaatgtgcacgcttgggacggacggacggatgatgagttcgacgacgtggggtcaacagcctgttgagctcagactctctggatgatgacccagttggccaccccggcttcctcgatggtcttggtcgcgtcgtcgagcggcttcggggggaatccgacctgtaacgtgtagtcgcttgtttctcctggcctt

SEQ ID NO: 5517 - DNA, 1037 bp, Hordeum vulgare
  UNSURE (11): n stands for any base
cgacttccggngctgcaagacttctgttcgaggcacatacaaaacctcagtgcatcccaggacggacaattttgggcatgtctccattaatgaagaccttcatttaagaggtgaaggccattactaatacgtgctccggtgcctatatccggctccagacccggcactaaaaaaggtgccctgactatcgatggccacaagaccatcacttaggcatggaggaccacggtatctgagaaaacgaggtactctggcgggctctaatggcactattcttgagatgaagaagcttactagagcgactcgagtgtgggctgacgctccaacggcccccactaatttccggcgcttatcattctatgtgaggataactcttactaccaaagatacggtgacatcctctacgtgttcaagccgtacgccgggcgtcttggatctgcctcttacgccacgagtcttggggactgcccttgtgtgtctagggcatggaaattcgacaatctttgatgagccggcagcacgtgtgatggaatattgcgggataggcacgatccatgaccgtaattgttattctacccgatccggatgttgccttggaaaagaacttagtcattattggatttaggtgtgaagtgcagtagtatccatccacatacattcctattgattttcagtttgatcttttttacgttgtaaatttttaagtttatgttatcactctcggggtcttttattgtaaaatatatccatgcgcgtgcattctgtttctattataaaattcgtttgtagctccctttttcttaatcttcttatttatccgcccccatgttatttttcagctattttagcttaccctacattctttggctggcttattgaatgttcattttccaattaaccaacttctcttctcatggacatttactaccacctgtcttatgttttcgttcatgagttctcttcctttcttgattccattgttattgtatttttcagttgctgggtgtgtgtcatctgtagtcttacattcttgttat

SEQ ID NO: 5518 - DNA, 516 bp, Hordeum vulgare
gtgaacttctgaacaagcccaggttattgatctctctgaagaggctccggataaggttttgcaccgtttatatgtgaatgttgaaaggctcaagattgaaggcgacattcttgccgttcaaatttggagaactatgagattaattgttgcaggtggcgatggtacagcgagttggctgcttggggttgtcagtgatcttaagctttcccacccacctccaattgccaccgtacctctgggaactggaaacaaccttccgttttcatttggatggggaaagaagaatccttctacagaccaagaggctgtaaaatcattccttgggcttgtgaagcatgcaaaagagattaaaatagatagctggcatctaattttgaggatgcgagctccaaaagatggtccgtgtgaacccattgctcccttagagctgccccattcacttcatgcgttccaccgtgtgccaagtggtgactcccacaatgtggaaggttaccacacattccgcggaggattttg

SEQ ID NO: 5519 - DNA, 517 bp, Hordeum vulgare
gtctacaagagcgtcttagcaaggctcgttctaaacaagcaaagttggcatctttcatggatcatgaccaggtcaaggtggctgagaagaggcaaaggatacaaaagcgtgcattctctcctgagaatgatcggtatggtaagccacagaaaaagaagaagctaaacattttgctggagcaggaggatagaccaactctgtcagtaaaacccacattgtctaagagggcaactgattgtctaacagaagatccacaggggaatagtgaagaaaaagctccagggaggagccaggtacataagaaagacatcacagtggacctactcctagctgttgaaagttccttaccaaatggtcatttgggagatttgtgcaaagaaaacactgacgatatcctcatagacaaccgaggagccaaagatgggtatcagccgtttgagaacgccaagcatccactggagaaattaccattgcttactgagaatgttgctaaaactgctctatcagaagttgggaa

SEQ ID NO: 5520 - DNA, 542 bp, Hordeum vulgare
ataagtttctattcctgattcgtagctcgtacagatgataagcttgtatagatgaatctacagagttcagactctgtatttgcaggagtatgttcttttcccacaaggatcgatcatcattgcctcattggccaaatctgcagtttggtaagtagttgctggttcgtgtgatctaaataacacgaaataaatggtccggagaaacgtctcataaagatactttcaatctcatcaggacgagtctactctgccagtaattttccacttgggcacttctcgacacaaagcagcgttttgttcaactttggtaaggggcttgatcagcagttttgatgttccgcgaaaccagagatactctgaaactcaatttccttcagagtaaatataagggtgaaaatggactgcttgataagatgactggtatcaggggtaagcatacaagacttcaaccatctgtcaaaggagaggttgtgcttcttccattatcaatgtaactttttctgggactaaaggctttgttgttgttaagcttttctgaacac

SEQ ID NO: 5521 - DNA, 519 bp, Hordeum vulgare
cactggttaagcaagaagtaattacctgaaaaactgccagttttgaagcatgtctactctggaaagaaacgtggaaggacacccaagacagaagatatgggttctgaagctgcatccaagaaccacaataaagaggcctccgaaacaccttctgcaaagcagaaagctcagaccacaccctgcgccgaaaacgagaatgctggctcaaagaagcagaaaaccgtggacattcagtctccttcaaagaattcgaaccctgggaattcttgttcagctgcagagaagctgaaaattgggaactcatcctcagctgcaaaggcgcagaaaactggaaactcatccccagccgcaaagactccgaaaacagggaactcatcgtcagatggaaaaaagcaggcagctgcaaactcatcatcagctgcaaagaagcccaaaatggggaactcatcctcagatggaaagaagcaggcagctggaaacacattcacagctgcgaagttgaagataggaaagtcatcc

SEQ ID NO: 5522 - DNA, 552 bp, Hordeum vulgare
aggacaactatacataagtagcatatttttagtttggtgacccaaactaaaaggttaggaatatctacactaaattactttgcgagaagccgctgtcaatatagctatgaacttcaacaagacgaaagggatagattgataaacaagacctgtttcccataattacactaccctgaatttgagcagtccggttttgcttcagtaaaccttaggcttccgtaccctttgactcctcctgctgttcacctccaccaagatagctttctcaatcctaagattggtgtggatgttttcactcatctccttccttgcaggtgcggacgagtttccagctgcctgcttctctccatctggggatgactttcctatcttcaacttcgcagctgtgaatgtgtttccagctgcctgcttctttccatctgaggatgagttccccattttgggcttctttgcagctgatgatgagtttgcagctgcctgcttttttccatctgacgatgagttccctgttttcggagtctttgcggctggggatgagtttccagttttctg

SEQ ID NO: 5523 - DNA, 518 bp, Hordeum vulgare
ggcatcaagccccgactactcggattcaatcccctcctctcaccccgcctccgcccgccgccgccgcctcctgctccgagcttgttaccaatctgagtttcttcctcggttcttcttcccgtccgtcgaccaggtagcagcttggaatcccaagccctcgagcgtttggcgattcatcagtccggtgaccctggaagaagatcgaagggcgccgcctggtggtgacatggtgatggtgagcgtgcagagccccgtggtgcggtcggaggaggacctgggcccgccgtggctgcggccgctgctgggcacgagcttcttcgtgccctgcccggcgcacccggacctgagcaagaacgagtgcaacctcttctgcctcggctgcaacgacgccgccggcgccctctgctcctactgcgtccccgcgcaccgcgaccaccacgtcgtccagatacggcggtcgtcgtaccacaacgtgatccgggtgtcggaggtggggaagctgatcgacatcgcgcacg

SEQ ID NO: 5524 - DNA, 485 bp, Hordeum vulgare
tctcggccctagccaagctaaaaaccctagctatgtttctattagctgtgtttcttaccatcctttcttccttcttcgccttattttctgcatggagcagggcaccgcgccatgcccttgtgcgatttgacaacctttgccaatatatcatatttacacacactccacctacattattgtgtgtatgtatatgtatatatatacaagtatatataccgtgcttgctatagctaatacggagtacctatctagtgatctactaactggatcacttcactactcagtcccaaccgacacacattgcattgcaataccggtagtagcattgtcacttttggtgcagagtggtttccactggaagtctaaccgtagaacggggcgcggtgggggatgcccttcctcctggacggccggcaccggttgatcggcggcgtgctcggcgtcatcggccgggtgttggacttgctgccctcgtcgtcggacca

SEQ ID NO: 5525 - DNA, 518 bp, Hordeum vulgare
ccccgtcgcccggcttggcgattccttcagtctggagctctgctgcgacggcctcctcctcctcgccaagtctggcacgcctgccaatcgcgcccgcctcaccgtctgcaacccgctcacgcgtcagcacgcctccctcgcccccctgccggacgacttcaacatcctggggatgtacctccacggacctacctgcgagtaccggctgttactgcaatgggtgagcgacagcgacagcgactcgcctacaggcgaaaatggctgttatgtcgtcgcgttgggatccgaccagccaccgaggtacatcgggtggtcggaccccgaattctcgtcggcttacttccaaggacctgcccgggtgcgtgacagactgcattggtgcctgttttatcgcccaggcgagaacccgctggaggatggtgaggctggatggaaactggtggtattcgacaccgtagctgagtcgtttcggcagatccgtgctccagttgatcccaccaagtcattcatctttgagg

SEQ ID NO: 5526 - DNA, 535 bp, Hordeum vulgare
agagctaaacggattggtaattttagcatcaagacaagtggtagtcgcttcatcccgaaatggtatctaaagtctgaaacaagcatatatagctttcatgcaaccacactgcataacagtcacttctgatcaacacaaaaagaagaattcagcaggaccatacttgatccaatacatagatattgcaactcatgaggatacgaaaacctgttcgttaagaagcaccgcctcggccgtcagatgaaaggtgaagcgtcggcagcatgaccttgtactgttgtgaagaaatcatgcggaacaagagtttgtttgaaccgatgcctggatgtatagatgtcttggaagctagcaaccagtttgccatcagtgtcaacgtagaacagcgaatgaccaaaactgaccagcaagagcaggtcaccaccacccgaagcatcggtcgcataccaatagccctcaccatcatggccttcaagctttcccctgatttctgcgatcggcaatgcaacccggtgcttcaagtcccaaaccccagtgt

SEQ ID NO: 5527 - DNA, 552 bp, Hordeum vulgare
  UNSURE (12): n stands for any base
gtcctcccgggnctgcagggaattcggcacgaggggtgtcctccgtcgctgccgtcatgacgaaccccagctggcctgaaggcaagcccatggatgaagactgctggtctgacgtcgactactgcagaaccacagagaattggtacaacctttccaaaacactagcagagcttcaggccttcgattacgcaaagagaagcggactagacgtcgtgactgtctgtccgtcgctggtgattgggcccttgctgcaacctacggtgaacgcgagcagctcggtcatagttgatttcttgaaaggtgaacatgaggtaaagagcaagatcagaaacttcgtggatgttcgggaccttgccgatgctctcatcctggtgtatgaaaccccagaggtctccggacgctatatatgcagttcacatgcaaggaaggtctccgatgtcatagacctgctgaagagcatgtatcctgcttacaaatttgccaacaagattgtccatgtggatgacgagccctcgtttagttcaaggaagcttgagatgctgggctggaaaa

SEQ ID NO: 5528 - DNA, 507 bp, Hordeum vulgare
  UNSURE (32): n stands for any base
gttcaaggttcttttttatgatatgctatgantccatgatggtcccaaaacaggatattacaaatgaggctgacataaacttacaaaatgaacaaaatccagaatgtgctcattatcggcagggaaatcagccaccggcatctcaagcttatgaaagaaactaaatcaacattgtttgttcaattcaagacagctgcagccttgtatgattcgacactgtccctgagggtctcttcaagtggcttgattttccagcccagcatctcaagcttccttgaactaaacgagggctcgtcatccacatggacaatcttgttggcaaatttgtaagcaggatacatgctcttcagcaggtctatgacatcggagaccttccttgcatgtgaactgcatatatagcgtccggagacctctggggtttcatacaccaggatgagagcatcggcaaggtcccgaacatccacgaagtttctgatcttgctctttacctcatgttcacctttcaag

SEQ ID NO: 5529 - DNA, 454 bp, Hordeum vulgare
gtgatgttgccgatgctcttctattggcatatgaaaaaccgaggcgtctggacggtacatctgcagttcagtaccagtaaaagtctctgatatgataagcgtactgaagaccttatatccgacatacacttatcccaaaaactttgtagaagtcgaaggaaatactatttatagctcggagaaacttcagaagctagggtggatcttcaggcctttagagaagaccctcggagatagcgtggaatcctacagagcatctggcgtcctgaactgagcatccaaccagggaaagtttggctgttaatgcttgcaaactcctggttcatgtaagcagtgaaacaaaataagttggtgatacaaccgtcaggagaatcatgtgagcataagcgaagcatgaatcttatgtgcgcctttcttttaaaaaaaaaaaaaaaaaaaaaaaaaaaaaaaaaaa

SEQ ID NO: 5530 - DNA, 414 bp, Hordeum vulgare
gtaaggcgcacataagattatgcttcgcttatgctacatgattctcctgacggttgtatcaccaacttattttgtttcactgcttacatgaaccaggagtttgcaagcattaacagccaaactttccctggttggatgctcagttcaggacgccagatgctctgtaggattccacgctatctccgagggtcttctctaaaggcctgaagatccaccctagcttctgaagtttctccgagctataaatagtatttccttcgacttctacaaagtttttgggataagtgtatgtcggatataaggtcttcagtacgcttatcatatcagagacttttactggtactgaactgcagatgtaccgtccagacgcctctggtttttcatatgccaatagaagagcatcggcaacatcac

SEQ ID NO: 5531 - DNA, 550 bp, Hordeum vulgare
  UNSURE (20): n stands for any base
gtacccccgggcctgcaggnaattcggcacgaggtatcatcgttaccagccacagctttagaagaacgatgcatcttgtgggcctattctttctaatggaccggcggaaatttgttgaattggaagagttactgatctgataacatgtcactccgacttccacttccgcaaggcctctcctttttcaaaagtgttgggtggtttgaagacagtaaggttgattcagctgccaagcaccacttgtctccaaaatttaagctccagacagataaggaggtgtatagacctggtgattcagttaccgcgacaatagaaatctctagtccctctagtttaaaggatgaagcggggacagcgtcaggtggagatgtcacatctctcttggtagatgggctatctttcgaacttaaaggaattgagaagttggatagccaatggttctctgttccaaagcccttaccagggtctaagcaaaggagaggtgaatatttgtttttggattgttcggcaccctcattagtctccaaagtaataattgcttcggggcaaa

SEQ ID NO: 5532 - DNA, 544 bp, Hordeum vulgare
gcaacacaacgtgaggatgtaattaatagtcttaatcaagcgccccaaaaaatcagtccattgggtagaaggtatacactcggtacgctctgtgtagtatcttgcgctacgcatgtccgcatcacgtaaatcaagtgccaacctgttatgttctctggtgatgagagaaagactgtttgtgtacatcagacagaagcagactagtttgtgcaacccaagtttgcctctcactcactgtcttcttcaaaaccttctggacattttacacatatggcctgggtgcagttgtgcgtgctgaactacatacagtatcacccaccgaatgtccgcaagcaggtaccgattttcaaataacagcaacagcaacttgttcatctgaggtaagatacaagagggtaggggtattcagattatcttcaagagttgaacagatttccaactaatgcatatctaccgtttcttccatgagtagctcgtctacgcattggaggtgcataaactgttattgggaggacccagtcccccttctctcttttctcaacaa

SEQ ID NO: 5533 - DNA, 488 bp, Hordeum vulgare
ctcgcgattcctctcccctcgcctcctcgtcctccccctcctaggggatcgccggagaggaatcgcgacgagggcttcctcttatcagttaattaaccaaagccatggagcacaaggagacgggctgccagtcacgggagggtccgatcctttgcgtcaataactgcggcttctttggcagcgcggcgaccatgaacatgtgctccaagtgccacaaggagatggcgatgaagcaggagcaggccaagctggccgcctcctcttttgacagcatcgtcaacggtggcgatgcggtgaaagagcaccttgctgctggcagcacagcggtggcagttgctcacgttcaggcgaaggcgctgatcaccgcacagcctgctgacatcgctggtcccagcgaggcggccatggagagccccaaaggcccaagccggtgcagcacctgcagaaagagggtcgggctcaccggattcaactgccggtgcgggaac

SEQ ID NO: 5534 - DNA, 549 bp, Hordeum vulgare
ctaataacagacgacgacgcttactcgataccattacttaccggttgcgactgtaagacagacagacagacagacggacaccaggaggaaacagcagtacattacagagtgctagccaaaatgcgaaagccacaataccattaccgttccgccgcgcagagagacgaccataaataaagcttacacaacatagccaacaaggagaccgttcggacctggggctgccgccgaggcgcgtgtgccgtgcatcacgattgcccaacaactaagattgcagaagccagcatgatgaaaggataatgcagcaaagacgcacgatgacgaggtagcgcagattgattttgggaccttctgttttgccgaccctttcctagatcttgtcgagcttctccgccttcaccaccgggttggccttggcgatggcgtccatggccgcagcgcggtagtcgaacttgcactcgtgcttgtccgagtagcggtgcgtcgcgcagtagaggttcccgcaccggcagttgaatccggtgagcccgaccctctttctgcaggtgc

SEQ ID NO: 5535 - DNA, 516 bp, Hordeum vulgare
cactacctgagcgggccctacggggacaccacgtacaccaaggtgttcgtggggggcctggcgtgggagacgcggagcgagggcctgcgcgcgcacttcgacgcctacggggacatcctcgaggccgtcgtcatcaccgaccgcgccaccgggaggtccaagggatacggattcgtgaccttccgggatccagattcggcgaggatggcttgcatggatccatatccagtaattgacgggcggcgtgccaactgtaaccttgccatcctggggcgacctggaccagccctgcctttcggacctataaggccggtcatgccatataatggaggtgcggttccagggagtatgtatgtaccaagcccaacatatcagcaaccgccctacaactactcgcaggctcttgtgtatcccccttatgggccatcaacgtatggaccggaatacttgtatccacagaatgcctatggtccatatgttggacagcagtatgtcccggtatatggtggtcccaga

SEQ ID NO: 5536 - DNA, 485 bp, Hordeum vulgare
tcagggtagaactggccttatttaattacaaggtgatgtaactgatatacaagttcagtttagggataataatttacacagccaacagagagacactatgacactgaaagacctatacaaccacattcacacatgatacgaaaaggacgagaatggatatacacagcatgaaccagatgggaccgaaagaattgaactgttctacgatttgaaccctacatgagctgcagctactatacacaggttggatgtccgaactccttttcgggcatccagtttggtccaggcacagaccaccagctatcagaattcctggcaggggatggagaatgtacaagacaccgacagaagcagagcaagagtggctttattctccagctctcgcgttctgcttcccgccccatccaacggagcggcttaacattcacataataagtgttgcaagtaaccatggataaggacaaccattaagaatgcaaaagaag

SEQ ID NO: 5537 - DNA, 551 bp, Hordeum vulgare
gtacccccgggcctgcaggaaattcggcacgagggagagaactaagctccgcccagagtgtgcttctcgcagcagcccccctacggcgatacggagtgggaaggtcgaatgaacgtgggtatgtcaaattcggtagcgactgcaatcagggacagcataagggatacatcaattggcaaaataaggaaccatgagaaggccgatcgtgctacggtggaacaggccattgacccaaggacacgcatggttttgttcaagatgttgaatagtggtgtttttaataatataagtggctgcatttctacagaaaaagagggaaatgtctatcatgcaacaaaaatagatggccaggagctagcaatcaaagtctataaaacctctgtccttgtctttaaggatagagacagatatgttcaaggagattatcgttttagatatggttactgcaagcataatccccggaaaatggttaaaacctgggctgaaaaggaaatgagaaatcttaaacagtgggatataattttcataccttattcataatttcatattgc

SEQ ID NO: 5538 - DNA, 549 bp, Hordeum vulgare
aagcatatgataaatttattgaaagtttaaatttacatgtattccggtgcgggagttgggcaagtccctggccgccgttgttccttgcccgccgagagaggaccatggccccgatcgagggccgcttccccgccgccacttcagagaaactgagaagaaaaagggcctctaaaagtgtgaagttcctggttacttttttcttgatttctgatgacatatttaagaaagttctctccacattaaaagttctctccacattgatggattccttagcataattcgcaagaaaattcattcctaatgattctacaaatgcctgaaattaatcatagatattttaataacagcaatatgaaattatgaataaggtatgaaaattatatcccactgtttaagatttctcatttccttttcagcccaggttttaaccattttccggggattatgcttgcagtaaccatatctaaaacgataatctccttgaacatatctgtctctatccttaaagacaaggacagaggttttatagactttgattgctagctcctg

SEQ ID NO: 5539 - DNA, 2019 bp, Hordeum vulgare
  UNSURE (10),(18),(33),(48),(59),(67),(68),(77),(89),(160),(164),(169),(173),(177),(190),(191),(208),(209),(227),(229),(230),(239),(240),(243),(249),(253),(254),(272),(298),(299),(309),(314),(322),(353),(431),(471),(473),(482),(484),(520),(550),(613),(869),(943),(1022),(1035),(1131),(1149),(1153),(1235),(1253),(1322),(1384),(1418),(1428),(1431),(1467),(1508),(1527),(1587),(1654),(1686),(1694),(1708),(1710),(1711),(1749),(1763),(1768),(1771),(1773),(1777),(1781),(1783),(1796),(1807),(1838),(1854),(1859),(1871),(1879),(1881),(1886),(1893),(1909),(1917),(1927),(1930),(1944),(1969),(1992),(1994): n stands for any base
aggagcctcnctctgganggcgtcgtcaggggnagatattcgggttancagcagggcgnaagtgtgnnatatggggnaggttagttcanggcagagagcaggagagtctgtattgatgatagacgctcgcactcagggacgatcaaggggtgggctatgncgtncaatnactncgtngaggcctccggtnncaacggccttgcctgcnnctgctgcgcaaagtggcncnncacctctcnnacnttgttncccnngatgaactgacgcagatnacaagccgaactggcgcgcagtgagnnatggccttanagganaactgacnctccactgcgttcgaaagtgtcgggccttanggagaagggagaatctgtatgaaggagaagaaggactctgcgagaacgctgggcctgcactggcgtgccttagacccncttggccatgagaaccctgatccaggaccatggcgacttnanaggaaaacnanaacagagaggagagcctggaagccttgaggggaggnaggagcggtagaatagacgcacgtggtggnggcaggagggcacacctgagattgtgtgcgctctggtgcgggtgcggggggggtgtggcgcgngcgtagggtgagatgtggtaggtagtaaggtgaggttgagtgagagcgggaagtggcgggtgtgtaggtcggaggcgcgagtgaggcggcagtggaggggcgagtaagtagcagagaacgttgaaggagggaagtggtctggagaagaggagggaggaagcagcgtgtaggagagcgagtagcgtagtgatagaggggagaggatgaggagagacgcaagatgcagcagacgtacgagtagtgatgacgatggagngcatgtggtggtcgagggtggtggtggagtagagagagagaggtgtgagtgggagggagagggactagagtagnagagagtgatgtaggcagagaggagcggatgagatgagcagcagagtgagcgtgatggtgatgagaggagaggagaggncacgacgggaganagagacagagagcggggagacgagcgaagcaggaagagtgcatagggagatatgatgagatgccgtgagcgtgcggtgagcggcgcgcgcgtgctnggcgtgtgaggaagcgantagntgttgatggtgagaggagcgaataggaagacggctggcagctgtgcgcgtgagctattgagggagaggtgaagaacgtatantaggatagagcgtggagngatgcagcgagtagtacgaagagtagtgtgcagtgcgtgtgggggatgggcgttgatgagacgctggtngtaggctgagagagagcgtgagaggagacgagacaacggagaagtgagtgacggagatttgntgtgagaggtggagcgaagagtgggctagtagantatgctaagngangagacacgtgacgtgcgcgaaggataggacgtaggnaggagtgcgagcgtgggcgaggtcagcgtgatcgatgatgntaatacatacctgcagcgnacgcgcgaccgcgcgtcggcgtgtaggagcggcaggcagcggtgcgtcagcgggaaggancatatacgcactaatatagatcatgatgcatgagtcgatagtcgtgaccgctaatggacgacgatantgataaggtgatgtagggaggtagtagtgtgntcgactgntgagagagcagagngnngtgctgagtagagatagatagtagtgcatctgctgtantaggcgcggtgagngagcncgntngagntagnangtagatggctgtngtcaggacgantgatcgtagtgtagtggcgttcatactactnatctcgtcgaccgagncgcgngtcgacgctcgntgtactgngnagcgngcagtgngagggacggcgtgcgncgtaggcnagcgtcgtgnagnagtgcggcggcgcngagggcgatagcgcgggatgacgantgtgtggatacgggtaggatagnanatgatgtgtcgtggtagagtcgcgg

SEQ ID NO: 5540 - DNA, 556 bp, Hordeum vulgare
ttcccaatgtttcttttattttaccatgattcccttgatgattgtgtcaccagcttatttgtttcactgcttacatgaaccagaacgagcttgcaatgcaagcattattttccctagttggatgctcagttcaggatgccagatgctttgtaggattcgacactgtctccgagggtcttctctacaggcctgaaggtccaccctagcttctgaagtttctcagaactcataactttaccttcttccacctccgtaaagtttttgggataagtgtatgttggatataaggtcttcagaatgtttatgacatcagaaacttttattcgtactggactgcagatgtaccgtccagatgcctctggattttcatatgccagaagaagagcatcggcaacatcacggacatccactagattccagaatctattttctacagtctcatgttctcctttgagatatttgaggagaattttactgctcgcattcactgttggctgcatcaaggggccaagtaccaatgatggtagaatagctacaacatccatcccagttttcg

SEQ ID NO: 5541 - DNA, 502 bp, Hordeum vulgare
  UNSURE (501): n stands for any base
gtccctcaggtcctggtcgccggcgcggacggtgtcacacccaacgcccatgcattctccgccgccgtcaaggcctgcgccgtgctccacgaccacaacgcgggcgcctgcgtccacgggagcatcatcgctcgtggattcaactacgacgacatcgtgctgagtgctctggtggacatgtatggccatgcggcttcgccaggtgacgcgcggaaggcgttcgaggaaatgcgcgcccctgatgggatatgctacacgtcgctgttatcagcatttgtgcggaactattggtttgaggaggctgtgaggtggctccggactatggtcatgacgaatggggttgagccggatggctgcacatttggctcgatgatgacagcgctagggaacttgaagagggtgaggcagggacgcgaggcgcatgctcaggtactgacccgcggtctttctgggaatgtgattgtggagagcagcacgctcgacatgtacgccaagtgcggng

SEQ ID NO: 5542 - DNA, 544 bp, Hordeum vulgare
  UNSURE (27): n stands for any base
gttcaggggctatttttgtaattttgncaccccgcgcggcgtcgggtcaggctgtgctgacggtacagctctcctcatgcgctgacagttaaaagggcacaggatgatgaaatgaagaaacgaaagcagaatacaatgccagggcgtatatgggcaagtgagcgcaacgacgtatggctggacgtggcgcctgtcggagatctgatgacatgagctaggagttttgagtttgacagctggatgtcctagatgaagcgccatcgacataggtagaccagctggtgtgcccctgaattgtccctcgtctcgagcacacctgacgtatgtatgcagtggctccacgcattcaatcactctgcatctatgctgcaccaatggcgatcggccgcggggcaagggcgctctctcctcgcatcctgagagcattgcctctggatttataaataccattagatgaagcatggaagtgatgaaataagcacgctcgatcaagcacttgtgattacaaatgaagccaataagtagacagcctgtctgagagtcc

SEQ ID NO: 5543 - DNA, 495 bp, Hordeum vulgare
caaccagtcctccgccggcgaggactcctcggagctcgaggccgtcgaggacctggatctcgtgggcctccgccccatccgcgtccccaagcgcaagatgccgctccccgtcgagagccacaagaagaacataatggagaaagaattcttcactgagtacggagaggcaagccagtaccaaatccaagaagttgttggcaaagggagttatggagtggttgctgctgcaatagatacccgcaccggcgagcgggttgcgattaagaagatcaatgatgtgtttgagcatgtctcggatgccacacgcatcctccgtgaggtcaagctccttcggctgctccgtcatccggacgtggtagagatcaagcacataatgctccccccttctcggagggagttccaagatatatatgttgttttcgagctcatggagtcggatctccatcaggtcatcagagctaatgatgacctcacggcggagcattaccagttttt

SEQ ID NO: 5544 - DNA, 550 bp, Hordeum vulgare
gccagcagtgacgcttgttgatatattaagaatgttaacagcgaaacaggacagcgttcagatgtcttgctctgttcgttacaatcatgcatagatgatatgtgtaggaactaatcccggtgttacatctgtaatcttgagtgtaaaaatacatcaacccatgcagggcaacagttcctgcgtgcagcagcgatgcttggcaggatcacacactcgctaaacaatctccaacttgtatgcagtgcttccctaggaccgcactgctttgctatcagcatccggtgtacctgacggaaatgagaaatgcggtgccgacttccgtcatcggcgctgcactaggcatgcatcttggagaccttctcggatagtccgtcgacggccccttccgtttcctcggagatcgcatcgtcatactgaacaataatagaaacaaagaatggaaacggactcagtgcttgagctctaaagcgaaccaaacgaagttcaacttgcaccaccatcttttctcatttgttgattgtgcaaagctatgccatgcctagttgtgata

SEQ ID NO: 5545 - DNA, 431 bp, Hordeum vulgare
atcttcctcaggtcggcttctggacgcgcctcaactgccccctcaccttcaacttcccccccggcgccgtcatgcccatcgaccacgacagctgccgctccaggtcgccgtagcacactgctcctcctctgctctgctctgcttcgccctcctcctctgctctgctctattctgcttagcccgccaatggcgtatgctctgcttagcccgccaatggagtatggtctgctattcattataggttcattcgtcttagcgagcgacaagaacgtacatatgcaattcttatgcaggcaaagaatgccggtagtatgtatatagccgcagctgcgaggaaaactatatatatatagtcagcctaatttgtggttctgtacagtacatatattgcgtatggaacagttcacagttcaaccccaaaaaaaaaaaaa

SEQ ID NO: 5546 - DNA, 413 bp, Hordeum vulgare
gggttgacctgtgaactgttcatacgcaatatatgtactgtcagaacccaaattaggctgactattattatagttttcctcgcagctgcggctatatacatactaccggcattctttgcctgcataagaattgcatatgtacgttcttgtcgctcgctaagacgaatgaacctataatgaatagcagaccatactccattggcgggctaagcagagcatacgccattggcgggctaagcagaatagagcagagcagaggaggagggcgaagcagagcagagcagaggaggagcagtgtgctacggcgacctggagcggcagctgtcgtggtcgatgggcatgacggcgccgggggggaagttgaaggtgagggggcagttgaggcgcgtccagaagccgaccttgaggaagat

SEQ ID NO: 5547 - DNA, 517 bp, Hordeum vulgare
ccgatctccagccgacgccggcgaccatggcttgccgtcacctcctcctcctccttcctctcatcgcgctcgccttctcctccgccgtcgccgcccctgagggtcagggagacgccgctgccgccttcatcgacggcgcgtcgcaccgctacctgcgggatcagcaagacgaccaggccatgtcgatgtcacttgatgaagtttctgcagctgtttctgtcttgcttggttttgcaccacctgccatgcttcctgcaccttcttctgcaaagttaaacgagctgctactgccaaaaccatttgacaggcctcgtgctgttttcttgatgcaaattgatggatcccatgactctgtcgatagcttcgtatctgatgccggtagtatttacaaaaccaagattgatggtgcaaaaagtgctgctacagggcttacagataaggatgaattgattgtcattcgttcagatgaatcttctggatcagatgttcttgacaatgaactcaccgacttggcaat

SEQ ID NO: 5548 - DNA, 430 bp, Hordeum vulgare
cccaatgaatatccaagtagcaaatttgttcacatgctggtattttacaacaatacagtacaatattcgctgatattgacaaaatacactcccctcaactatttttatttatttatggaaaagcaagagaagcccatacaagcagcgtcagtatacagttctcaatgaatgatccacatagcaacaatatgtttatgctacacagggtggacagcaaccccagactcagcgtccctactgtaaaccccagggtccaaaggaaaataccaagcatgactgttgaaaacttccttgccgtcgtgtgaaaattcatatgcagcacaaactaatcaattttgacatttgaatataggagcgtgtccttggtaagcggcatgttcatgagcaggcaaatcccaatgagggttgagacaagaaggatgatccctgt

SEQ ID NO: 5549 - DNA, 493 bp, Hordeum vulgare
  UNSURE (41),(43): n stands for any base
cccgacgccctctcctcccccgccgccgccgcactccccananaccgcaggcatgggcgtcttcaccttcgtgtgccgcgactccggcgccgagtggtcggccaagcagcacaagggcgagctcgaggcctccgccgccaccccctacgacctgcagcgccagctcgtctccgccgcctgcgccgaggacaagtccggcggcgtccagtcctccttcaccatggtctcccccaactccgccatcttccaggtggtcattggtggtgcctctgctggtccgatcggtggtggtgccgctgctggtgccgctgcatcaggtggagctgctgctgaggcccccaaggctgaggagaagaaggaagaggagaaggaggagagcgaggacgaccttggcttctccctctttgattagatcttcttcttcaccctattgcacgccagaaatgacatggtcctattgccgcagtaattttgatgtcatgcctagtttgat

SEQ ID NO: 5550 - DNA, 543 bp, Hordeum vulgare
aacacataatgcaatgataccatcaagaatttcaggacttgacaaaaactataaactggtaagactaaagccatagtaggatatcgaagctgcagaataacataaccaaatcctcacatgaacagaaagtaacacatacatcccttgacaatcaaactaggcatgacatcaaaattactgcggcaataggaccatgtcatttctggcgtgcaatagggtgaagaagaagatctaatcaaagagggagaagccaaggtcgtcctcgctctcctccttctcctcttccttcttctcctcagccttgggggcctcagcagcagctccacctgatgcagcggcaccagcagcggcaccaccaccgatcggaccagcagaggcaccaccaatgaccacctggaagatggcggagttgggggagaccatggtgaaggaggactggacgccgccggacttgtcctcggcgcaggcggcggagacgagctggcgctgcaggtcgtagggggtggcggcggaggcctcgagctcgcccttgtgctgcttggc

SEQ ID NO: 5551 - DNA, 543 bp, Hordeum vulgare
ggcctgcagggaattcggcacgaggaacgggaaaattgttgggctagtaatgtccaccaaggaggcttcaacatccttgtcatccatcatcgatggaccctcttcattgcacatctcaagacggcttgcagaagcatccagaactaatgctacagcttctatagctgctatatatcttgttagactgagtcttgcatggattacagggatcatccttcttgtctcaacgctcattgggatttgcctgctcatgaacatgccgcttaccagggacacactcctatattcgaatgtcaagattgattagtttgtgctgcatatgaattttcacacgacggcatggaagtttttaacagtcatgcttgggtttttcctttggaccctggggtttaacagtagggacgctgagtctgggcttgctgttcaccctgtgtagcataaacatattgttgctatgtggatcattcattgagaactgtatactgacactgcctgtatgggcttctcttgcttttccgtaaataaataaaaataatcaagtgg

SEQ ID NO: 5552 - DNA, 559 bp, Hordeum vulgare
  UNSURE (16): n stands for any base
tatcccaagtggcaanatttatttcagataccctggcttttttgttacaacaatacagtacaatcttcgatgatattaacaaaattacactccacttgattatttttatttatttacggaaaagcaagagaagcccatacaggcagtgtcagtatacagttctcaatgaatgatccacatagcaacaatatgtttatgctacacagggtgaacagcaagcccagactcagcgtccctactgttaaaccccagggtccaaaggaaaaacccaagcatgactgttaaaaacttccatgccgtcgtgtgaaaattcatatgcagcacaaactaatcaatcttgacattcgaatataggagtgtgtccctggtaagcggcatgttcatgagcaggcaaatcccaatgagcgttgagacaagaaggatgatccctgtaatccatgcaagactcagtctaacaagatatatagcagctatagaagctgtagcattagttctggatgcttctgcaagccgtcttgagatgtgcaatgaagagggtccatcgatgatggatgacaag

SEQ ID NO: 5553 - DNA, 518 bp, Hordeum vulgare
ctccggcgatccgcggcacctcctccccgacgcttcagccatggcaggaatggcaccggaaggttcccagtttgatgcaaagaactatgattctaagatgcaggagctgctgagccaaggtgagaccgaggagttcttcacctcatatgatgaagttcatgagagctttgatgacatgggtctccaagagaacctcctcaggggaatttatgcttatggttttgagaagccttctgccatccagcaaagggggattgttcctttctgcaaggggcttgatgttatccagcaggcacaatctggaacaggaaagactgctactttctgttctggaatcctccagcagcttgactatggtttggttgagtgccaggccttggtccttgctcccacccgtgagcttgcgcagcaaattgagaaggtcatgcgtgcccttggtgactacttgggtgtgaaggttcatgcatgtgttggagggacgtcagttcgtgaggaccagaggattcttgcaagtggag

SEQ ID NO: 5554 - DNA, 558 bp, Hordeum vulgare
gataatataagaataacgatagcattactagcagcgattgcaggattacatgcgataggtaaagagtcaaggatgacacaaacaaataacatcattcggtcattacatagtcttaacaaataaagtgaggactccagcaacagcaacatgagcagcgacgcctccctccccagcacatagaaccacagcctagcaactacaaaaattcccaaaacatggcttaataaatcccaaattgtccacgacaacgactttaaagtagaaccccagcagaccatttatcccttaaacccgccttcccccacagacaagaaacttggtgatatttcaacaaaaacaaagccctgtcaggacccccaccccccttaccatatgttctccacagcccgcagcgtaacaaagttgatggccacacccttccttccaaaccgaccactacgaccaatgcgatgcaggtagttctctggctgggtcgggaggtcatagttgatgaccagggacacttgctggacatcaataccacgagcaagcaggtcagtggtgatgagcacacgtgaa

SEQ ID NO: 5555 - DNA, 870 bp, Hordeum vulgare
  UNSURE (18),(775),(790),(831): n stands for any base
gtcccccgggctgcaggnaattcggcacgaggggcttggcaccttcgacactgccgacctggcctctgctgcctaccaggccgcctcccggagctttatcgaggagaagcgtcgccgccgtggccagtccggtgccgcggcctcacctgctcagtcggccacgtcctcaccggcgtcgtcttccacaccgacggcatcttcgtcgtcctccacctcggctgctccatttgcgcacccgtcaccgtcttctgttctggaagccaccaagctggcagctgagtccatttcgcctgagccgacaccagttcccgtcatggtgtccaccacacccgagacagcgcagcttcccgacgacccagagttctaccaggacctcctgcgtgggcttcagctgccggacattgacccgatggacttccgcgcggggcttgatgccttggacgtctcggaggcgtcggcttacttggacggcgaacaggacctgctgctcggcgacttggccgacgaggagctggagctggacatggacctcgacatcggtgacgacttcctggagatgcccggctgcgactttggccgaggcatggatgatttcctgcaaaccgtcgatttctgcgtctgaattgggagaggtttaaggttttactatctcttaagtaatgcttggtgtgatggaccggcctcgtgtgagtgtaattcggtgtgcattgggagggaggaggaggatcctctttgggttttttcgccgggcagctcaaccagctcgtgcccaagnatggtgtctgttttnccgagcacattagcgttatgggggagagtatttttgatagnaggttacattggggataagttatagtagctgctgggttt

SEQ ID NO: 5556 - DNA, 552 bp, Hordeum vulgare
  UNSURE (17): n stands for any base
gttctttcgtaataatnctttagataaaagaggagacttcttagtacaaggggagaacaataacagggaatcatctagcgttcaggaaatcaacagatacatttgtaatatgtctttttgagggcgcctcacacgaaatcacagctatgatgaaaataggtgatatgtatgcggaatttgatcacatctgacgtcctcgtcgcgtaccccggtacttcaagaacggtgcttgtcgacacgcttcttgctcttcctccggctgcccttgccatcagaatcagaatcagactcggactcagattcagatccagaggacgacgacgacgtgtccctccggtgccttctcttcttctgcttcgtcttgctccggcgcttcttcttgtcctccgagtctgaggagctgtagcttgagctgccgctctcagaagaatactcagagccagtccctgatgattcagagtcggagtcggagtcagacaccggcgcgcgatgtttcctcttgctctttgacttgctccttgccttccttttctgagacttctccttcttcag

SEQ ID NO: 5557 - DNA, 516 bp, Hordeum vulgare
  UNSURE (21),(138): n stands for any base
cacaatcatccttgtttcagnaaagaaggtcaattctgcagatcaatgcaattatgtcctgaaggtttgtcgcacactgatggactagagcttgatgattctgtccgggttcacatgcttaaagagagaaacagcgangaaaaaatatttacggttgagatggaagaggattgataactttcttagctgcacaggtggctctgaagacattttctcggagctttttggtcatcagaatgctgaagatacattttggctggatagctcgtcagttgatcagaacagggcacgcttttcatttatgggaggtaagggcggacctctgtggaagcaaatgacgtttcacctctccagtcaaagagccaactgtggaggaaccattactattcgaggtgctcatggatctgctgtgaaaaactctcttaaagatggcttcttggaattccttcacaaggagatccagtccattaaatacaatgaagaggactttgaagggctgccatttgacttccatgg

SEQ ID NO: 5558 - DNA, 547 bp, Hordeum vulgare
  UNSURE (49): n stands for any base
gcatacacttcttaagtaagattaccaacaggggggaaaccaacactancatcgtccccaaaaagaatagctatcagtgcgcattaccactggtttaattcttggggggaaacgaaataatgtatgccaaaatttgatttgcctgtatattctagtcaatgctactactaggccaccaacatgaaatcttcacttccggcttttcctctaaaaaacaaaaaacaaaaatccctttcaagcacgctcttgttcaccaatgattttcagcccaccctccttctgccaaaggccaaccgcagcagagatgatgagcttaccttgtcaggccaaaatccatgcttgttgatgtccgctgaaccttgccacgctggtttagtttcagagagctgcttctagcttatagttgtccgcaccgaatccgatcggtccggactgctgtgcgccgccgcttgttggctgcactcttcgacgaccctcgtcggcgtcctcgccttgagcatcatctcggcgtactccgcctccgggtctgacagcgccacaatcgccc

SEQ ID NO: 5559 - DNA, 524 bp, Hordeum vulgare
  UNSURE (58): n stands for any base
gcacgagggcacggcggcgactgggaggccgtcccgatggacaccgaggactcggcgngacagcgcgcctactgcggcggcggctgcggtcaggatttctgcggctgcaacctgctcaccctgtgcttcccgggcgcggtgcacattttcatgtccgtctcccctgacaaggtgtcgcaggtggaagctgcgctctcgctgcaggggagattggatccggcggactccacggctgcaccgcccgcctcgcgcaacacgctcaccatgaccttccggggccaggagtgcaagttcgactccgtaacccctgatgaggtgcaagatgtacttctgtcgctcgcgggaatggagctgatggtccctagcattgagctaaaaatgcacttcccgggtgggagccacgacttcgactctgtatcccctgataagttgcaagctgtactttcgatgctggagggaatgaagttgacggtctctacggctgtgccatgggccttgcacaaccagctcactgaacccttgat

SEQ ID NO: 5560 - DNA, 531 bp, Hordeum vulgare
  UNSURE (12),(28): n stands for any base
tgtaacatgttncacaacatacagacanatttcgtgtcctcagcttacaagtagacactggtaaggactccagagaacctgctcatcgattttgggaaggttttcatcgtctagcaacttccaagtctgtttaagtctgactcccatccatgatctctgccctttcttgagttcgatataaattttcccgagcgctcggcaaattagggcttccataggcacatggtataaaattcctgagctcccctcgcccagtgaggacttccataggcacatggtaagcacagccaccgccagaacagaaccatatcccactaagggcctcttggttagaaggattctaaaaacataagaacaagaaacagaaaaataggatacaaaagcatgcgtaaaatgaaggatcagaaaacacatgaattttgtaaagtgggtgtttgattcataggaataggaaaaaactaggaatccaggaaatcattaagatgataatgacgaagagagaaacctcttacatctcccatgcagacaagg

SEQ ID NO: 5561 - DNA, 354 bp, Hordeum vulgare
gctcccagaaaacccgaggaattatccagcggcagctaccccgtgatcatggcgcaaaaggagtccggcgtagcggcgagcggcggcggcggccgcaagggcaagccgcacgcggtggtggtggtgtacccgctgcagggccacatcatccccgagacgcacctggcgctgcggctggccgcgcggggcttcgccgtgacggtggtcaccacggaggccgtgcacgaccagacggcgcgcgcgctcggcgtcgacccggccgggcacgacgccttcgccggcgcgcgctcggcggggatggacgtgcgctacgagctcgtcagcgacggcctccccgtggggttcgaccggtcg

SEQ ID NO: 5562 - DNA, 385 bp, Hordeum vulgare
ttttttttttttttttttttcgacagaaaaatctgacttttgatagcaattaagtacacactgcacacgaacatagcacaaagacgcttatacatacaccagaatataaactgaactgcattcgttctccgacggcggatggacgatgcttcaggctgatcggtcggcccagctcaacatcccccgcaacgccgcgttagcacggcgatgaactcatcgaagctccgctgcgatgacccgccgtccgccgcggcggcctcgagcgtcgccctcaccttcttcacggactcccggagctcctccccctctttcccggacatgacgcgctcgatcgtcgccttcacctcgtcggcgaacaccgcgccacgatccccgatggtcaccc

SEQ ID NO: 5563 - DNA, 519 bp, Hordeum vulgare
aaaacttttcatgctcctgagtttgtttacaagcatttgcggctcaagcatccagagcttgtgttagaagttacttcaaaactccgggaggatatttatttcgaaaattacatgaatgaccctaatgcaccaggtggaacaccagttatgcagcaatctgcagcagacaaatcaaggcggagatctgacaatggtatggatagtcgtctgagatatgaccgtggcaatcgcagagaatatgatagggcagataaagatggaggcagacatggtagaggtgatggctctccaagccgtgatggacctgacgatcagatgtttgattccttccgtggaagaggctccaatgctcctttttcggctgaattccctgctccaccgatattgatgcctgttcccggtgctggtccattgggaccatttgttcctgcacctccagaaatagccatgcatatgctgagagagcaaggaccttccgcattcgaaccaaatggcggacctcatggcaactcaggagtg

SEQ ID NO: 5564 - DNA, 545 bp, Hordeum vulgare
gacgttgcatccttttctgtgactgcataatagtagcaaatatcaagttccagccatttaagctaaatctgacaacacattacaggcgtcctcaaaaaatagcacatcttcctcctatgcctctgtattgcctgtatgacaggacacagcctacaaacttctgtagtcaagaacagtaacttcctcgtcaggggcatcgagatcattatagcttcgcagacgtcgaggatcacgatggaaagatggtggcatggctataattggtgttgggcccccgcccatcatcgatccaagcactcctgagttgccatgaggtccgccatttggttcgaatgcggaaggtccttgctctctcagcatatgcatggctatttctggaggtgcaggaacaaatggtcccaatggaccagcaccgggaacaggcatcaatatcggtggagcagggaattcagccgaaaaaggagcattggagcctcttccacggaaggaatcaaacatctgatcgtcaggtccatcacggcttggagagccatcacctctaccat

SEQ ID NO: 5565 - DNA, 494 bp, Hordeum vulgare
gctggacttggagtatcacctgcaacacatggaaataaatcgtttggccttatttctgctactgatgctctgctgggttcatcttcaaccaagtacagtgcactagattgtcaaaggccagaactcttaaataagaggaaagttcaggggaaaattctgttgtgtggctattcttttaattatatttctgggacagcttcaatcaagaaagtgtttcaaacagccaggagtctaggtgcagctggctttgttgttgctgtagaagatagttacccagggacaaagtttgatcctgtgcctgtcaatattcctgggattctcatcacagatgtcagcaaaacaaaggatcttatagactactacaactcttctacaacaagagactgggctggacgggctacagcgttccaagcaacagtcggtatcgcagatggtttggcaccaacactgttcaattcagctccccaggtggcgttgttctcttcccgagggcc

SEQ ID NO: 5566 - DNA, 540 bp, Hordeum vulgare
aaataacaatgtattctcgcgtctacaaacaggcacacgtacaatgttatatgcagcactggcaacctatacacgttcgtgcttaataatacctcaagcgaaggtgcagagatgccagactcagactgaaatgcattagaactgcagaaggttggatcgtatggatacctggagagatctatctaccatgtcatataaataggctacagaaccccacgtatttttacatcctggggcaccatcataacacagacaatacatcattaccgaattacgtcggctcttattgttcctaccaaactacaaaatattacaacactcctcagctcagagcatcataagagaacaatacacgaccctatttgaaccccatggcaaccactgggatcctgactaggtggcgccggtcacccttcatcgtgatctcgccgaaactgtaggtaccggtcaccgtcctcgtcgtgagggtcacggtgatctctctagatgacccagggagcaccgtcagcgcgggaggtgagacgtccagcgcgatctccg

SEQ ID NO: 5567 - DNA, 551 bp, Hordeum vulgare
  UNSURE (42),(47): n stands for any base
gtacccccgggcctggcaggaaattcggcacgagggggaagnatggnaagcttgacacactgtgtgacctgtacgagactcttgccatcacccagagtgtcatcttcgtgaacacccgccgcaaggtggactggctcaccgacaagatgaggggcagggaccacaccgtctccgctactcatggagacatggaccagaacactagggacatcatcatgagggagttcagatcaggttcttcacgtgtgctcatcaccactgacctgcttgctcgtggtattgatgtccagcaagtgtccctggtcatcaactatgacctcccgacccagccagagaactacctgcatcgcattggtcgtagtggtcggtttggaaggaagggtgtggccatcaactttgttacgcgtgaagatgagaggatgctgtttgacatccagaagttctacaacgtggtgattgaagagctcccagccaacgttgctgaccttctgtgatcgtgcgggctgtggagaacatatggtaaggggggtggggggtcctgacagggcttt

SEQ ID NO: 5568 - DNA, 554 bp, Hordeum vulgare
tctgataattacgaatacgatagcattactagcagcgattgcaggattacatgcgataggtaaagagtcaaggatgacacaaaccaaataacatcattcggtcattacatagtcttaacaaataaagtgaggactccagcaacagcaacatgagcagcgacgcctccctccccagcacatagaaccacagcctagcaactacaaaaattcccaaaacatggcttaataaatcccaaattgtccacgacaacgactttaaagtagaaccccagcagaccatttatcccttaaacccgccttcccccacagacaagaaacttggtgatatttcaacaaaaacaaagccctgtcaggacccccaccccccttaccatatgttctccacagcccgcacgatcacagaaggtcagcaacgttggctgggagctcttcaatcaccacgttgtagaacttctggatgtcaaacagcatcctctcatcttcacgcgtaacaaagttgatggccacacccttccttccaaaccgaccactacgaccaatgcgatgcaggtagt

SEQ ID NO: 5569 - DNA, 379 bp, Hordeum vulgare
  UNSURE (365): n stands for any base
atcaccaagctagctagccaccacaaataagcacttacacatttcctgagagctccgactaacaacgtccttccgcacctccaatggcttccagctccgcgcttaagatggctgccgctctcatgctggcactgtttgccggacagctgttgatggctacaccgacggtggcataccaaaggcaggagatacacgaagcaagatgtatttttccttgcaaactcgagtgtttccgaatcgaatttcatatctgcgtcgtcgactatctgaaatacaaggtagactgcaatgagtgggcctatgacatatgcaagttgggccattaataactgaggccggtcaaagaggaccacaacgcgtgttanatgcatcagtacgc

SEQ ID NO: 5570 - DNA, 253 bp, Hordeum vulgare
acttttttttttttttttttttttttttcctttaatggacaccaatttattattacatgtaccttaaaaaatatattattacatgatgctgcatatccaacagtcgaacaaatgcgacaccgtgatgatacaaaaatgaagggaaatacattaattagttaaacaactgacaccgataaatgtaaataaacaatagaaactcatatagtatacataacaacatatcatgccaatatatcagcaaggaataata

SEQ ID NO: 5571 - DNA, 495 bp, Hordeum vulgare
ggctgcagtggtgctgaaggtgctgaagaagtgcccgtcgacggcgagcatcttcttcctcagcgcgctgaacggcagccaacaacccggcggagaggaaaaggtacggcaagaggaggaggaggaggaggattgtgacgtcggcatggacggcgacgtgacgatgagtcgggaggagctgtttgccaacacggagaggttcatcggcaacttccgcaaggagctcagcatgcagatacagtagcccccggaagctagcgtagatattttttgcttagcttttcttatttttctctggttcatggtcaggagtatgtttagcgggacacttagtccgtgatcacttgtgtaacccctgttcataggcttaggattttcggtgtgcttaggttttcgaatgacataatcatactagtctctcaattatgtccggcaatctctgaacaaagtgaatgcagctggtggcaaagcccaacaacatatttttcaatagac

SEQ ID NO: 5572 - DNA, 498 bp, Hordeum vulgare
  UNSURE (8),(9): n stands for any base
gtagcaannagtctattgaaaaatattgttgttgggctttgccaccagctgcattcactttgttcagagattgccggacataattgagagactagtatgattatgtcattcgaaaacctaagcacaccgaaaatcctaagcctatgaacaggggttacacaagtgatcacggactaagtgtcccgctaaacatactcctgaccatgaaccagagaaaaataagaaaagctaagcaaaaaatatctacgctagcttccgggggctactgtatctgcatgctgagctccttgcggaagttgccgatgaacctctccgtgttggcaaacagctcctcccgactcatcgtcacgtcgccgtccatgccgacgtcacaatcctcctcctcctcctcctcttgccgtaccttttcctctccgccgggttgttggctgccgttcagcgcgctgaggaagaagatgctcgccgtcgacgggcacttcttcagcaccttcagcacca

SEQ ID NO: 5573 - DNA, 423 bp, Hordeum vulgare
cacagatcccccgcctctgccgcacacgcccccttccccccgccgaagcaacctaatccatctaccctgatcgaagcggaggaatacgggggcggaatggatctggtggtcgtgtcggaggagcccaatcccaacagcgaagccgccgccgcgcacagccggccggagccacctccactccggtgcccatcgatggtcctccacaccgtcccccggagctgcttcacccactctgcttgcccccgagcaggactcggcccgcctagcagcccctttcccccttcattcggtccgtccggagctgcaccacccaccacaacaaggttcctggaggttggaggaggccttggggaatggggatggtgagcggccagctgtcggtagaaccccactgccatctcccatatcctgccgctggcgagg

SEQ ID NO: 5574 - DNA, 442 bp, Hordeum vulgare
  UNSURE (2),(12): n stands for any base
angttatatttnactagaaatagatattatcatctcatagtacaacatggagaaaagagaagatctaccgatgctacaatggagggcatgtatattgaaacagtaggaaaaaattccttgtcaaatcaacaaaacgtcgtattcccaacataattgcaatgtctacagtaaacatggtaatttcatagaagtcaggaacattcatttaaaaagaaaagcaaaaggggggaagaacagggaagaaattgccacaatccaaaaactactgataatatttgttaagagttaatcctacgctggcattgtttggagcatggaggtaaggtggtcttgttcaatctatcctcgtaagaaataaatgatcaggatatatgttccacttctgatgactaaactattttcctaataatacaaaatgttccaaattgtatttaagaattat

SEQ ID NO: 5575 - DNA, 518 bp, Hordeum vulgare
tgttggtggccatgatgtcggaggcggtgccgccgctgaaggacgtgctgaaggttacgggcgtggacgccaatgatgacaccatgatgattgggggcgtgaagccgcccaaggagcacgcctttgtcgccgcgcaccagttccggtggctgttgtctcagattaattacccgaagcttggcgatctgtgctggttagtcattccatgtgctttgacggcattggatcattggtcgccggacgttaaggaacaaggaatgattagcttcatgcacatagcaaagaatgtgaaagtgacagaattaagtttgtatgaagatgcaatacttgatgcctgttgccataacattcctgcagatgatgagttatggtatcgcgttgttgaggtatcggtgctgctgttgacttgcactcagagaagcaatccacgtagcccttggtacgaccgtgtactctctgagatgttgggacacctggaacggcaaccactaaacaaagaacgtcgtgttgcatggctt

SEQ ID NO: 5576 - DNA, 550 bp, Hordeum vulgare
cagttgcaaacaaagttaaacagttacgaacctagtacatttctataaaatggaagggttttatgccttgatttggtacactgttacaaacctacatttctctaaagaagttacaaagttacagcataagagtggcttgcccctggtatgttacctcagttcatgtatcaagccagcgccaccgcgctttcatcaggaccagaagcctccagtgctcttcgatccttgagagtaggtgggcaaaccttacaggaaaaaatgcatgcaaatacaaggacccgaattcgaacactgacagctaagatgtaacagcattgatttgatctatgttaaacaactatctacagcgagaatatcagttgaactcaaaattctggcaaaccatcttcggtgcatagttgtctgaaacgggatagcagcaatgttaaatctgggtcagcttcatgcttcttccaagcttcctcaaactgctcccccttgcatttctggagtagcatgagtatttccactatgtgatttcgcatgatctcccgactctttctcgtggctg

SEQ ID NO: 5577 - DNA, 522 bp, Hordeum vulgare
gaggctctgtttattgctagacaactgttttagcagagggaagcattctaccattgctcctccaatgtcttacagctgtgctctttgtggaaaagggtacaggagtgcaaaagctcatgcgcaacatctcaccacgcgatcacatctcttgagagcttctcaggagcccaatgcctccactgctgcagtagtcaagccacttcctgagcgagtccctcgtagagccccctccgcaatggaagaagatgaagatgaagatgaggatgaggaggacgagtgggttgaaatggacccaagtgagttggagtctacttcaaacatgcaagtagatgaggactctaaatcagatgatgagatggctgatcttgaaatgttggatccctctgtctgcttcatgtgcgatctcaagcatgacaacatagaggactgcatgatccatatgcacaaaaagcatggtttcttcatacctgacagtgaatacttgaaggatcccaatggccttcttatatatgttggactgaa

SEQ ID NO: 5578 - DNA, 523 bp, Hordeum vulgare
gcaagtactaagctggagtacaatttagtcagtctccgcatgagacacgagactcgtcataggttcagctgggctgaagggtgtagatagcagtgtcgataccagcagccacacaaaacttcgacaaaggacgctgttattctagatatcgtcgacaaaacacgccaatggcggcaagggcagtgagtagtgctggagctccacggactgactgctcctacaggaagggtgggcgtcgcgactagtacgggacgttcttgggcaggttccggatcacgttgctcttcatcccgatcttggtcctcatcgtctccaccccgctcttgttcatcgctcgcaggaccttcagcctcaccatctgctccttggactggaccgtcaccaagcccatgctcttgtagctggaagccagggaaagcgcaagtgcacggtctgctgcaaccgaaggccgtggcttctggcggtagtagcggatgaactctcgggagccaagagtcgtcacacgtctccccttctcgctctt

SEQ ID NO: 5579 - DNA, 503 bp, Hordeum vulgare
ctctccccgtcctccatagcagccagctccagctccacgttgtcctcaacagcagcagttctcgatccctccgcggcgaggcaatcgcgacggtcggtgacttggggcaactctcgacaggccttgtagcaacgaagtttgcttgtgatggcagcggttgcaatccacccgtcactgccacgtgcttcttgcaactataaccctatcgccgccccgctgcgatgaagctcggtcgcgccggcggttgtgctcgagtgaaactttgccggcgaccatcgggtgttgcaagagctttcgacgggggtggccgatgctgcgatgtagcaccgcctgtgtgatggtgcgctccaattaagcttcgtcggcggcgtcgggtgatgcgctgaaccaccgccgcgtcggtctgacgctgcaatggaacatcgccggcgaccatcaagtgctgcgatggagcaccgccgtgctggcgtcgccgtcgacgctgcagtgaagcattgtggggc

SEQ ID NO: 5580 - DNA, 524 bp, Hordeum vulgare
ctcaatggtatttgataataccaccggtggtatgtaggatcaggaacatcatcgtaaaaccgaaggtttcgaactccccgtcatgcaagacgatgattttgaacggtatctttgttaggacatgtgtggaatgagtgggaacaaggaaagggggctcattttaaggacatggggtgcacatggatcttaaagggcaggggaaaatatctgtgttaatgggtaccaatacttgatggggatgaagagaggtgtgtcataggctcatagcccgatgccacgacatcatcggacagaaggtggaggacataaatacagcttgtggagagctgccagcgagggatacttgctgcttgtggagaggatcagaggagccaccggagagcagagaatttagagtagaacgggagcaaggctgaggaagaagacatgctcagttcatttctgttcgggagcaaggctgaagctgctctcattttgtagctagcggatccaacccaacggtccagtcccacatgccatcggcc

SEQ ID NO: 5581 - DNA, 518 bp, Hordeum vulgare
ctaattctgtcagtggtaagaggactgagattgcgagaaagaggatttctgatggacagacttcttcaagaccaagcggcttaagtgggcagtccagtttaggtcattcaccttccttgtatcctggcattactggtcctagagtcagagactctgaacaatcagcttctcaacaaacaacaaggactagcaacagaactattcggaattctgcagattcagtaaggatgagacgtccttctactcagcaggctaggatgaggatgccagatgaaacagagcagggcgtgtttgctatgcgtgagactgtttcgggggctcgtcaaccagattgggcccgattttcgttggacgaagctcccccacagaggtcagctaggccttttcctatggaacttcctcatgcaatttactcttctagtcgtcaaggctctagtaaccgtacatcaaggagcagagcgagttctcgtcccgaggatagctcatcacaaatgtttagagatgtctacagacgcatg

SEQ ID NO: 5582 - DNA, 525 bp, Hordeum vulgare
tattacaagttggagggaatcacgacttgaggcagtacaatctctagcacagtttcatgctatttgacatggattcatgcgctcccctcgtccgcgtccgacgacgacgaaggtactgctgaagctttgcatatcggacaccagttcttctgtcggagccactcctggatgcagctcacatggtactgatgctcacacttcattctaccaacctcttcgtcttcggtgtattcctcctggcatatgctgcatttgacatcatccactacaggtctgctcacttccggcgctggatttgcttgtttatacacgactcgactgaggcactttgccaattgctcttcagaaagggcagtgcttacggagccaattctatcttctagttgtaacagttcctcataagacatgtcatcaatatccattctcatatctctatgctgatcattcaagccgaggccactgaggaatagattggtttccagaaccagcaattgctcataagacaattcatcatggtgttcgatc

SEQ ID NO: 5583 - DNA, 539 bp, Hordeum vulgare
  UNSURE (27): n stands for any base
gtcccccggctgcaggattcggcacgngggccgcggggcggcgaccgaggcgggaggggagccatggagatcggggggcagcacccggcgagcagctgctccaaggagcaccagaagatctaccgcgactggttcgccctcgccgactcagatggcgacggccgcatcaccggccccgacgccatcaggttcttcgccatgtccagcctcccccgcgccgacctcaagcaggtctgggccatcgccgactccaagcggctggggtacctcggcttcagcgaattcatcacggcgatgcagctcgtctctctggcgcaatcggggaatgagatatcccaagacagccttcagcgtgaagatctaatcagcttcaatcccccagtgatggagggtttggatgctctgcttgcgaaatccaagcatctggcaaagagggtcgatcatgatatggatggatttcctcaagcacaaggaccttctactaaccattggtttaactctaaatcatccaagaagatacccctgactgctgttacttc

SEQ ID NO: 5584 - DNA, 524 bp, Hordeum vulgare
atgccttacaataagggcgttctccagccggcaattgagccattgcttctggctcttattcatacagttacacaacaatgggtacaaacaccctactagactggcagccgcgactctatgggcagccaccgacatccgcgcctgacataccgaagccggtcttccaatcatgatgtctgctcactcgtaagggttcctgaagttcttgagcagctccgggatgtcgtagccgagcatgtcgtccaccgcctggatcatcttgggcttcaccttctcgaacttgtcgatgctgtacccgcccaatgcttctctgaagtgctccacgtaagggaaatctcctgcggggagatgatgttccctttgtacctttgcaaactcgtcctccaaattgtctatgagtttctgttgggctttagctttccccatcatcgaaggcatttgattctttagatgcccaattatataagcatgtatcttggcagctctagcacgtttgacgaattcattgatcctgcgatcacaag

SEQ ID NO: 5585 - DNA, 553 bp, Hordeum vulgare
gtacccccgggcctgcagggaattcggcacgaggatttccgcccattccggtatttagctttccattgcagctgtatttgtattgtacccacatactcgcatcttcttttaagcttgaaaagcacaacctgtacttcaaactttgcacagctttggggacacatcatgactctagatagtaatcaattgctgtcagtaaccacctacttgggtaggagtgatctatacccaaaattgcttaataaacactggatccatgtctacagtagctctttcagttatgcagtacttcagcaatcaggaaattagcaatatggttacctaaaaccgtttcggatttttagttaacgtacttaacctattatcttggcggtaacacttagacgtttttaggaataacttgcttgagttgcaacatgactagcctttggcttcgaaacaatttaggttaattcataactagggcagttactggctcttccttcacaagcttttcagtggaatactgtgagctgttgctagtctcattgtgatcatcagctcttgcttcatt

SEQ ID NO: 5586 - DNA, 552 bp, Hordeum vulgare
gaggggtgatgggctcattggcaggacacaggaaaggaacaatcaacagacatacatccttgcttgcttgcttgcctgcccacccaatcaaacactgtacagagaggttttgctgcattgcatttgcatcctggaatcgacaccggggcgcctagatccggctcgagtccctcccgaatatgaacctccgggtccagtcggacaccaccaggacccgagtgcgccagctcacctgcttgctgctcatccatgcaggaaagaaagggacagtctcagttgcggctaaacgacttgggaaggagataaggtggataaggcggcaccacggtttcttccggcagggatggtagatcatgagatgcttgtatgtcgagcgacaacgacatcttaccttgcgtacacggagtaccagagccactgggtgctgtggcccatcgagacccagtcgcccgggagctccgccgcggcttgctccccgcccaagggcgcgaactgcccgagatgcttgtaccttgagtgccaggacatcaaaagatgagggagcgtatgaga

SEQ ID NO: 5587 - DNA, 392 bp, Hordeum vulgare
acacaaacacaatcttccttccatccatccagctttgtcctcatcaatcaacctagctagcttacgaaacgcatggctcgcatggcggtctcggtgctttcgatcctcctcgccacttgcgccctggcggcggcgagcttcgacaaggagttcgacgttacctggggtgacgggcgcggcaagatcctcaacaatggccagctgctgacgctgggcctggacaaggtctccggctccgggttccagtccaagcacgagtacctcttcggcaagatcgacatgcaactcaagctcgtccccggcaactccgccggcaccgtaaccgcctactacctgtcgtcgcagggtcctacgcacgacgagatcgacttcgagttcctgggcaacgtcac

SEQ ID NO: 5588 - DNA, 367 bp, Hordeum vulgare
tttttttttttttttttaccacgggctagtttacacatctccccgtcactaatcattattgatttccgttcactttatacagacacccccatcttccctatgctccggtcgtcctgctcaggtgatcgccctatgcacagtgcaatgctagcagctgtgcgcgcttgctcgatggaggatggacatggggactacatggagcactcggcggggacgccctgagcgaaacgcttggggtcggtgcagtagttatagatcatgtagttgctctgcacccaccgcatccgctgctgccgtgtcaggtccagctcctgattgtaccattcgccggccgcgccggtgccgggggcgacgtccgtgccgacgc

SEQ ID NO: 5589 - DNA, 497 bp, Hordeum vulgare
  UNSURE (12),(50): n stands for any base
gtttttccgggnctgcagggaattcggtacgagggggtggccaacgatangccgccaccaggaacgggccagcggcaaggccagcaggtcgatgagctgccaggaacgcctgggcggaggaaaataggcacggattaagcgaggatgatgtataaaccgtgagctggagactggcgccgagagagagagagagagagaggaagaaggatgggatatatatataattatttgtttaaagataagggcaatttagttagggcacagaatgcaatgcatgctccttcatcatcatcttcatcatcaccataatgtcatcaagagcagatgcctggtcgatggcaaatattggtagattagtagtgctacttcgtaaatgagtcccgtataatgagatgaggtgagatgcctcggcttggcttggcttcaaaaaaaaaaaaaaaaaaaaaaaaaaaaaaaaaaaaaaaaaaaaaaaaaaaaaaaaaaaaaaaaaaaaaaaa

SEQ ID NO: 5590 - DNA, 387 bp, Hordeum vulgare
gccaagccaagccgaggcatctcacctcaatctattatacgggactcatttacgaagtagcactactaatctaccaatatttgccatcgaccaggcatctgctcttgatgacattatggtgatgatgaagatgatgatgaaggagcatgcattgcattctgtgccctaactaaattgcccttatctttaaacaaataattatatatatatcccatccttcttcctctctctctctctctctctcggcgccagtctccagctcacggtttatacatcatcctcgcttaatccgtgcctattttcctccgcccaggcgttcctggcagctcatcgacctgctggccttgccgctggcccgttcctggtggcggctatcgttggccaccc

SEQ ID NO: 5591 - DNA, 493 bp, Hordeum vulgare
  UNSURE (19),(474): n stands for any base
ggctaagtccagctctccncgtccgctacggtggcctctgaaactttttcctcccagcctccaacgaaccctccatgaaccgaacctctactacatatacgtgcatatgcatgaagaagtgtgtatgtgtgtgtgctgctgttgctgctgctgctatacgtgcaaggcatggcccccaagttgctgcatataggtgtgtactgtttaatcacatgccgtatttgtgcatgtatgaactgctgctgcgtgtgtgtgatgctaagttgctgcatggttaactgctggatccatccatggatcggtctatgtgtttttggttgccttttttgagacgctaagaacggtggttgtactcttatatcctccttaagctgcagatcaagatgtatcaagccatgctctctgtttttcctctatgaaaaatctgtgttctcctttatcgaagaatgaaaaatctgttctctctttttgttnaaaaaaaaaaaaaaaaaaa

SEQ ID NO: 5592 - DNA, 464 bp, Hordeum vulgare
gaagacagatttttattcttcgataaggagaacacagatttttcatagaggaaaaacagagagcatggcttgatacatcttgatctgcagcttaaggaggatataagagtacaaccaccgttcttagcgtctcaaaaaaggcaaccaaaaacacatagaccgatccatggatggatccagcagttaaccatgcagcaacttagcatcacacacacgcagcagcagttcatacatgcacaaatacggcatgtgattaaacagtacacacctatatgcagcaacttgggggccatgccttgcacgtatagcagcagcagcaacagcagcacacacacatacacacttcttcatgcatatgcacgtatatgtagtagaggttcggttcatggagggttcgttggaggctgggaggaaaaagtttcagaggccaccgtagcggacgtcggagagcttggacttgagcc

SEQ ID NO: 5593 - DNA, 315 bp, Hordeum vulgare
cttcgtgctttgcttccctttgctctgaccgatcctacgctggcacaaactctgcctcacgcttgcgagctggtccaagagcaatggcgccgtccaagaaggtgctgatgctgtgcggcgactacatggaggactacgaggcggccgtgcccttctacgcgctggccggcctgggcgtcgccgtccactgcgccgcgccgggcaaggcccccggcgacccctgccccaccgccgtgcacgacttcctcggctacgatctctacacggagctccccggccaccgcttccgcgtcaccgccgacttcgccgccgcgg

SEQ ID NO: 5594 - DNA, 401 bp, Hordeum vulgare
ttttttttttttttttttttttccataaaatcgctttttcgcaaactgttacaaaatcgttttttcacgaactgttttacagatcgacgtgtagggtccgcgctcaagtgagggctcaaggaagtatttgtggagccaattatctgctgaaagatcaacagcaccagccgcctcgtccagcgccctctgatagttgttgattaacaggaaccatatggccattcgcgccattaataacagctcttggacaatatctgaactctgcagagtgtgacagtgctcagtgcactcaagttattacagacggaggagaagatgcattgcatcttcagattcagaaggagacggtgatgcccaagagatccacgaggtgagctatgaactcggcaaggtccggccag

SEQ ID NO: 5595 - DNA, 551 bp, Hordeum vulgare
  UNSURE (20): n stands for any base
gtacccccgggcctgcaggnaattcggcacgaggaatctactgtggacgcatcggtgagtctctagttcagatgcagtatttgtccaagctatctgtgaatgcaagtgatgagaaggaggttctcttgttgaacgtcctcccgccaaatctgcaaacgctgtctttgagaggacgattagagcaaggagcgttggatgagtctcctctcttccaagatgttggtggacagaacttgtcttcattggctctgtcttggtcacagctgagaaaagaccccttgccatcgctttctttgttgccgaacttgacgcttctacacttcaccagagcgtacaacggagagcagctgacatttctcacggggtggtttcccaagctgaagattctctttctaagagatctgcctaatctgaaccggctagagatacagcaaggtgccatggcgagcctggaaagattatcccttgtcaacctcaacagcatgacggaggtcccatctggcattgagttcctcgtgtccctccagtatctagtcttccacgaaatcacc

SEQ ID NO: 5596 - DNA, 547 bp, Hordeum vulgare
tcgaataataaggtgatattatataaatggaagtatgcaattgaattgaatcatgtactgcaaaaatcagtgtgaatatgaaaacacaactcactcgcggtcttacagtaagtgtcatgttacttaagagccaaggcacaatccaaatcgatattaccacaacctcataagcaatcacacgcaagtcacgaacagtagtagtagcactagtaaacacaggcagtagtactagcaaacagtgtgcccatcaggcagtagtatcagtagtacatcaggagtgcggagatgatggatatactcatcttgagattcattgacgccttatctgtgtgcggcccaaattataaagcatcttcattcgggcccggtgatgtatctacacatttcccgaccagtgcggcaggtcaaagtcggagagtatgatgccacttcttccctcgaatcgcagagcattggcgcagcaacgtcaagaagtcaccggtgatttcgtggaagactagatactggagggacacgaggaactcaatgccagatgggacctccgtca

SEQ ID NO: 5597 - DNA, 522 bp, Hordeum vulgare
  UNSURE (20): n stands for any base
gtacccccgggcctgcaggnaattcggcacgagggtccttcctcgccccaccgtcgtcgcggctccagctagggtttctcgcccccgccgggcccgtccgccatgtcgaagcaaggagggaaggccaagccgctcaagcaggccaaggtcgccgagaaggactacgacgagaatgacctggcatacctccagaagaagaaggatgagcaaaaggccctgaaggagctgaaggccaaggctggccagaagggtgcgctgggaggatctggtctgaagaagagtgggaagaaatgagtctgcctgcccattcgtaatgcccagaaaatgataatctatctatctacctatctgtgtcgcgcttcactatctgtggttgtaacagactaccttcagttgtgttgagcattatgcatcgtcgcagtcggttgctgaaacctatggtattccagcagcctcttctgcctatctgtgatacagatggtccgtagctaataatgacatgacgtaatttgtgatgaaaaa

SEQ ID NO: 5598 - DNA, 478 bp, Hordeum vulgare
acaaattaccgtatggtattattagctacggaccatctgtatacagataggcagaagaggctgctggaataccataggtttcagcaaccgactgcgacgatgcataatgctcaacacaactgaaggtagtctgttacaaccacagatagtgaagcgcgacacagataggtagatagatagattatcattttctgggcattacgaatgggcaggcagactcatttcttcccactcttcttcagaccagatcctcccagcgcacccttctggccagccttggccttcagctccttcagggccttttgctcatccttcttcttctggaggtatgccaggtcattctcgtcgtagtccttctcggcgaccttggcctgcttgagcggcttggccttccctccttgcttcgacatggcggacgggcccggcgggggcgagaaaccctagctggagccgcgacgacggtggggcgaggaaggac

SEQ ID NO: 5599 - DNA, 1792 bp, Hordeum vulgare
  UNSURE (1)..(8),(19),(22)..(26),(79),(130),(135),(136),(176),(177),(248),(471),(738),(893),(909),(1178),(1179),(1183),(1439),(1456),(1481),(1489),(1515),(1538),(1540),(1547),(1618),(1674),(1700),(1761): n stands for any base
nnnnnnnngggctttcggnccnnnnntttaatcgcacacaagaacggcccccacagggggttcccccaaagtggcgggngaccgccaaacaagcgacagcggagcggggcaccgacgcaccttactaaanaatcnnaccaacatacatgccgccctgtgatagttatatcatcgtnngtcctccgttagactcagcaccaaattacgctatcttctatatgaatacaaagcggtggtcgcgcgtgttncattgagcgcggtatcgcgcaatgtctttacgttctaccggtgccatctcatccgctttgtgtcccccgcgctctccccgcctccaggtgcatccccggctcctctgccacgcgtcttccgcctcctcctttctgtctgccctcctctccctccacctacgttatctcggacctccctatccaccttgaaacccacttttactggtattgatgctgcgaacantcgccaacagacgcgcaaggaagcacaccaagactagccccgccaggacaaacctactccctcgccttattcaacctcgccacaccgatcccgcgacgctacgccacaaacgaatgagacggattagcaatgcaatagctagaacaatgaacacagttgacgcatgcatattatatcactgagacgcgtatcgaattcatgtactcacacaatatagatgcaactacaaccgaaatactcacacgcgacatggttatgtattgtctntgtccgttggtgtatcaccgaattattaaacatcacatggataatcagcacccacgtcacaccccgacaccaaatgttacgatagtgatactccaccgcctgcatagccgccacgtcctacacgtagacatagttgacgtgacctactcccgtangatcgtaccattcgcnagatccgatccacccatcatcatcttactcaccacctcctcaataacaacacaacgcgcccactctgattgtcaatcatacaggccaccgacccaaggtatccctgcccaccctctgtacgacatcgactcgcgcacaaccaccgccagcctcgtctcgcacagacccaattacacgactacccgctgctatattacgcgcgcaccgctccgctatacatctactatttctatactatataccctccacataatctactcgacttcacnntcgntagacgtttgcgtccatagagtcagcacattttcaccacgctgtagtccaccgccactaattactatatacatatcgcccgcttaagtcacacacaataacaattagagacatccacgtccacgctcttaagacattcataccgcgatgagattgtacccactagaacgtcatataataaacataaaatgccaccggtccgacgctccgcccactccgcgcagtatgtcgtcaactctacaccgaccgaacactantctacatcacccagagnagactaccgcggtaatagcaagatnacagatangcacataccatgataacctctcctancttcactatcagaccagcgtacntncacgcancacagagtgtcgcacgcagcgcaacaatcgcatgatacgcctcgccgactgtctttcgtaacatgacagtngtatcaccgaattacaacacaacatgatctcatggtaacatcggcgttatcaggcnatctctcccctgcccgctcgcctctnccatagtattctccctactacacgctatgaagacataacaccacgcgcagtaacacaccanactaatcatacgctgatatacctcgaacggt

SEQ ID NO: 5600 - DNA, 550 bp, Hordeum vulgare
tttaaaaagctacacaacatgaaccatttattttttttgtgactacacatgaaacctagctgctatgtttattcagccaaaagctaaaactttaaactatacacaacacgtatgtaaattcactgccccatgagaaagcatgctcatatcttcttcagcctaatttgagcaccgtgctgcggctgcagggttatcacggtgtacggcgcgtggatgtaggacggcgagagctcgaacgagaagcgctggaggatggtactcagagccatctttgcttcctgcaacgcaaagttctggccgatgcagattcgaggcccccctccaaacggaaagaacgccgccggatgctttgccgcattcgagatgccatcagcaaatctctctggattgaattctcttgcatcttttccccaaatatcgggatcatggtggataaagagaatgggcaacataaggttcactcctgccggatatttgatgccaccaagttccattgccttgtatgttcttctcgtaaggaaggttattggcgggtacaatcgaagaacct

SEQ ID NO: 5601 - DNA, 518 bp, Hordeum vulgare
ggtgggcgtggcaaagaaactgaaggagacgatcagaaaagtcccgtccagggcgagcatcttcttcatcgggagcgtggacccccgcgacgccggcgagatcgtggatgcgacgtcgacgctccaggacgatcaggcggaggaagggcggaaaaggtggaaaatagacggctcctccggggatctcatgagcaagcaggagctttacgccaaggccgacgcgttcatcggcaacttctacaagcagctcaagatgcagagggagcaatcgtggaacaagctgcaggacctgtgcagctaccaccaccacaactacaaggccaaggccttctagggtttctcgatctacgtgcgtatctagaacctagatgcatggctagcatctatatatatgtacatgcagatacgctatgtgttggtacgtagggtaactgtgctgagcagtggaaggagccgagaggaaccaacagatattatgatgttggttcctcaattcttaccttcatccacccattgat

SEQ ID NO: 5602 - DNA, 547 bp, Hordeum vulgare
atagcgaccgatataattaacttgtgtgttgacttagtcttaggggaaagaactcctatgaccttctaacccaaaacaaatcaatgggtggatgaaggtaagaattgaggaaccaacatcataatatctgttggttcctctcggctccttccactgctcagcacagttaccctacgtaccaacacatagcgtatctgcatgtacatatatatagatgctagccatgcatctaggttctagatacgcacgtagatcgagaaaccctagaaggccttggccttgtagttgtggtggtggtagctgcacaggtcctgcagcttgttccacgattgctccctctgcatcttgagctgcttgtagaagttgccgatgaacgcgtcggccttggcgtaaagctcctgcttgctcatgagatccccggaggagccgtctattttccaccttttccgcccttcctccgcctgatcgtcctggagcgtcgacgtcgcatccacgatctcgccggcgtcgcgggggtccacgctcccgatgaagaagatgctcgccc

SEQ ID NO: 5603 - DNA, 520 bp, Hordeum vulgare
  UNSURE (24): n stands for any base
tctcctagagatcggatccatggngctcctccgccgtccagcacgactccgtctccgcgccaggaaacatggagtgtgctgatgaccctggaagcagcagcagtagcagaagcaagtgggccaaaatgatgagcgacgacacttggaggtggtgtttagggctgatttacatcgttgctattgcgggcatatggattgctgcaagctacatcgttcagtctgtcgtggatggcggtgtttctccctttttgatcacctacatatgcaattctctgtttgttgtttacattcccatagttgagtttgctcggtacttcgaggattctatcgacaacctgtggtcgaagttgaaaggcaaggatggtgcagacctgcagcagcccgctgacttggagagcgtgaatcttctagagagaagcgagcgggagggcaatgcagcctcacctcagtctgaagacaatgtggcttcagatgcaaacttccctatccacacagagctagctgtcgcagattgcagcaa

SEQ ID NO: 5604 - DNA, 555 bp, Hordeum vulgare
gtttgaattcatgtaactaatactgcaactccgtacgtacttcagtacagttgcccaaaaaacacgtttccaccttgtacaacaaaatttagctacacaacacaccgacagaaattatacaaatgattttcccttcccgcgcatgaggctgtacaatttgttacgcggatgacaatatccatcccttccattgcggtgtcgtagcatggggaaaacctgaccgaaccggcctggcgagcccaggcatacaatgcttggtaattacacttggacaagaacctgaaacaagccagacagctactatgaaacagcatccgtagaattcctatcactgggcgaatgctgcgagtcatcgacaatggtaacaatgggtgcttcctgctcatgccgagaaggctgtagcacatcggatgggatgttgatgccagcaaaaccgactaatacagcagcagctccgatgtagttcaacagaccgggagcatgaccagtgagcgtgtccacaagggcagcgataggaacttggattgtaagaccggctgtagcaacggtggttgt

SEQ ID NO: 5605 - DNA, 519 bp, Hordeum vulgare
atcaccttggaggtggagtcatctgacaccattgacaacgtgaaggcgaagatccaggacaaggagggaatccccccggaccagcagcgcctcatctttgccggcaagcagctggaggatggccgcaccctggctgactacaacatccagaaggagtccaccctccaccttgtcctccgccttcgtggtggcatgcaaatctttgtgaagaccctcaccggcaagaccatcaccttggaggtggagtcatctgacaccattgacaacgtaaaggctaagatccaggacaaggagggcattcccccggaccagcagcgcctgatcttcgctggtaagcagcttgaggatggtcgcaccctggcggactacaacatccagaaggagtccacccttcacttggtgctccgtctccgtggtggccagtaagtgcctggcaatggagctgcttctctcctggttcacagttcttgtgtcttcctgttgtccaacaggggtgtctgtctgtcgtcctggtcgttt

SEQ ID NO: 5606 - DNA, 553 bp, Hordeum vulgare
ggctactattatatagttacagaagctgcttacaaaggcagaagttttcagataccagccgatgcatcacagtacggtggaaacatagaaacgaccaggacgacagacagacacccctgttggacaacaggaagacacaagaactgtgaaccaggagagaagcagctccattgccaggcacttactggccaccacggagacggagcaccaagtgaagggtggactccttctggatgttgtagtccgccagggtgcgaccatcctcaagctgcttaccagcgaagatcaggcgctgctggtccgggggaatgccctccttgtcctggatcttagcctttacgttgtcaatggtgtcagatgactccacctccaaggtgatggtcttgccggtgagggtcttcacaaagatttgcatgccaccacgaaggcggaggacaaggtggagggtggactccttctggatgttgtagtcagccagggtgcggccatcctccagctgcttgccggcaaagatgaggcgctgctggtccggggggattccctccttgtcctg

SEQ ID NO: 5607 - DNA, 505 bp, Hordeum vulgare
ctcaaccagcgcgctctcctcctccccctcgccgtcgtcgtcgtctccgttccaccgccgctccgcgcaaccatgtcttcgaagaggaagaccagggagcccaaggaggagaacgtcacccttggaccggctgtccgtgagggggagcatgtctttggcgttgctcacatctttgcatccttcaatgacaccttcattcatgtcactgacttgtctgggagggaaaccctggtgcggatcactggtggcatgaaggtcaaggctgatcgtgatgaatcttcaccctacgctgctatgcttgcatctcaggatgtcgccacccgttgcaaggagcttggtatcaccgcactgcacattaagctccgtgctactggaggcaacaagaccaagacacctggacctggagctcagtctgctctcagggctcttgctcgttctgggatgaaaatcgggcgcattgaggacgtgactccagttcccactgacagcacccgccggaagggag

SEQ ID NO: 5608 - DNA, 556 bp, Hordeum vulgare
  UNSURE (43): n stands for any base
ttagactgaaaagctagttttacgcataaataccgagtttctngaacaaaaataggatccacgcaacattcatagttggactaacagtaaatgatcctcaacagagcaaaattaaagctcatcttgacattcatagaaacagcaggactacccagagaggagcaagtttcttgattgccaccagtagagttgaaagatagcctacagcctccttcccctccttcctcccttccggcgggtgctgtcagtgggaactggagtcacgtcctcaatgcgcccgattttcatcccagaacgagcaagagccctgagagcagactgagctccaggtccaggtgtcttggtcttgttgcctccagtagcacggagcttaatgtgcagtgcggtgataccaagctccttgcaacgggtggcgacatcctgagatgcaagcatagcagcgtagggtgaagattcatcacgatcagccttgaccttcatgccaccagtgatccgcaccagggtttccctcccagacaagtcagtgacatgaatgaaggtgtcattgaaggatgca

SEQ ID NO: 5609 - DNA, 518 bp, Hordeum vulgare
gctttctctccgcggcctgagcgagtgaggaccggcggcgacgatggccggcatggtggcgctgcagggcgccatgggggcgctctccgtctcggccgcgagcaccagcgccttctggggcaacccgctcgccgccaccttctcctccgcgccgtctggggtcagattcatggccaagacaagcccaattgaaatgcggcttaagcgatgggaacggaagaagtgcaagccaaacagtcttcctatgctgcacaagatgcatgttagggtcggcgacacagtgcaagtcattgcaggtcgtgaaaaaggtaaagttggggaagtcgtacggctttacaagcacaacagcactgtgatagtgaaggacctgaacttgaagtccaagcacaagaaaggcacagaggatgaaccgggagaaattgtcatgattgaaggccccatccatagctcgaacatgatgctctactcaaaggagaagaacgtgacgagtagggtcgggcacaaaatcctcgaagacg

SEQ ID NO: 5610 - DNA, 548 bp, Hordeum vulgare
aaatggtgacaactttgtagtagaagtattacaagagaggctgtgaagctacaaaaaaactgatagtacaagcagcggcaccaacagagtaagcgtttgggcagcaacaagcgcagccaacattgagagcatgtgcagcatttccatactacgatgatgactctgaatctccttccttgaacaccttcacccagttatcaacgctgtcgattacttcgccggtcttcttcaggtagcggaccttggtgccgtcttcgaggattttgtgcccgaccctactcgtcacgttcttctcctttgagtagagcatcatgttcgagctatggatggggccttcaatcatgacaatttctcccggttcatcctctgtgcctttcttgtgcttggacttcaagttcaggtccttcactatcacagtgctgttgtgcttgtaaagccgtacgacttccccaactttacctttttcacgacctgcaatgacttgcactgtgtcgccgaccctaacatgcatcttgtgcagcataggaagactgtttggcttgcacttc

SEQ ID NO: 5611 - DNA, 944 bp, Hordeum vulgare
  UNSURE (1)..(5),(916): n stands for any base
nnnnnggtcaaagccccctagtgccccacagtgtgcgagccacttaaagacacgggggcactaccgtcgccgacaagccgcaccgctgcagggtcacggggatagcatgagcccctcgctactccttccgacccgcccaccacgcgctccaggaaatattggattccctcggtccttttgctgatggcctgaagttctacggaggatctcatagtttgatgggaaaggaactgatcagagagatcactgatttagcgcacaagcatgacatgtatgtgagcactgctgattgggcacagcatcttctgcgccaaggacccttgtctttcagcaatatgtagaggaatgcaaagagctaggctttgacaccattgatctcaacgctggatatatcaagcttactgaagaggctatcctgacactagacctcctcataaagaacactggctcgcgaaccaagcctttgattgcgggcaaggtcgacaggtccgaaatgcctcctgctctagatagggaatatggcgcttacatagctccatggaagcgacgctcagaagatcccctaaacgtgacctgctgatagagaggcgctggacatgcctggacgcactttcaggttttagacctaccaacccatgctgcgactgccatcccacgaaatccctcggaggccggcctcatggcgtagactcggggccggacttttgctcctgagatccgagcctaaagacttccccgggggcaacctgtccataggtcccggacctaccctctggcccgaacgtcacgcaccgttgagggctagtccatcgcgaagataccgtttgcgtccttgaccctagtgctaccctcctttgccaccgtccaaaatgggccctgaaagccgcccagtgggtgtggcgcgggctcccattgngccctctgcgtcgaatcttattacactt

SEQ ID NO: 5612 - DNA, 543 bp, Hordeum vulgare
aggacttacttcccagtgcaatcaccccgagatctacacacacagcctcatccttattacctgctaccaagtaccaacacactgccgcctcggctccgggactcgctactacttcaacacagcgcttaggtccctcagtacagttcacacaacttcctcccagtacagaaaactcagctccatcaacacttcgcttaggccccagtcccatatcattactcagcaaggccgtcatcacatcaggaagaacggcgaagggagcaaggggcggaccctccggcgcacgtccaagccgcggaggcgctccaggttcatcacctcggagtggtcggcgaagaggttcacccgtgggccgtatcgtttgacgaaccactcggaggtgttggcattggatgtctcgaacatggtcttctcgagcccgagccggccaacgatcttcgcgatgatgtccgccctgagggaatccgtgcgctggcagacgtcgtctgcgtcgatcatgatcatatctgcacctgcctccaggcatctctcggccctccgtat

SEQ ID NO: 5613 - DNA, 516 bp, Hordeum vulgare
ctgagggctgcctgtgagaaggccaagaaggtgttgagtgcgaatgctgaggcggtggtgaacatagagtgcctcatggaggagaaggatgtgagggggatgatccggagggaagacttcgagaagctctgtgctgagttgctggagagggtcgttgagccgtgcaagagggccatggctgatgcaggtattggattggataagctgcagtctgtggagctcgttgggtcagggtctcgggtacctgctattgctagagttctggccggattcttcagaagggagcctagtcgcacaatcaacgtcagtgagtgcgtggctcgtggttgcgcgttgcagtgtgcaatgcttagtcccacatttcgtgttcgggagtatgaggtgcaagatgtaatccctgcctcaataggattttgcacaaatgaaggcccaatatcaacattgtcaagcaacgcattgttccggagaggacagccccttcctagtgttaagataatcactttgcataagaacagt

SEQ ID NO: 5614 - DNA, 407 bp, Hordeum vulgare
tattcactgtctcaacgatcatggctactgaaaactgcacgtcagcgtactgagatgcaggcacccaatggcgggcagtttggtacagagttggtcgtctggcaaggttagaagaaattcgtacgtccgtatatttctacaaaatgtcaaactttggccatggcaattctgcagggaattctcagcaaggtctaatatctctatctgatttatgcgtttgatctgaacccgctagcatccatcgttgttgtcgtgcccccgtgccctgccagttactattttgctacatgacatgtctagctcctcttcctttttcttgatttcatgagaccaaactacagggtcaacattcttgggcaaggactcctgtagatgtgagctctccctcagccacagctcaactttag

SEQ ID NO: 5615 - DNA, 546 bp, Hordeum vulgare
  UNSURE (31): n stands for any base
gtacccccgggcctgcagggattcggcacgnagggccctttgttgcctgtcgtctcccaggagtaagttcagtcggcttggcaaactcgtgcacaccgtgaagatttggctcttaggtgttctggatatgaattggatggggttcttaatatccttaggaagttcccctgtctcgagaagctctatatcatttttcacaaacaccatgggacagataagaaaatcgagcctcagtatgaccgactatatccaattgaatgccttcaaacccatctcaaaacagtggtgtttgaaacattcgtgggccatgataaacagcttaactttgccaggttcttcgttttgaatgcaaaggtgctaaaaaacattgaatttgaaggagtgtatggtgccaatgacagcgtgtcgctggcttaccaacacacgctgctacgagtggaaaacagagcttctcgagatgcccaatttgaattcaggagtagacatcgcgatactgagaatcatctcctcaagcatatccatgatctgtcagtggctgaccccttc

SEQ ID NO: 5616 - DNA, 522 bp, Hordeum vulgare
cacctgtttttgcatccaaagctctcttgcgtgttaaagggcacttcaagttacttgattgcaaggaaccttagctagaaatagagcaggtctatgcagaacaggatgcgatcttaaggaatcaataccgtctacaaaacaagcacaggacactaagaacagtgcaatcttcaggcaccaaccctgtctatggctgttcgaaggggtcagccactgacagatcatggatatgcttgaggagatgattctcagtatcgcgatgtctactcctgaattcaaattgggcatctcgagaagctctgttttccactcgtagcagcgtgtgttggtaagccagcgacacgctgtcattggcaccatacactccttcaaattcaatgttttttagcacctttgcattcaaaacgaagaacctggcaaagttaagctgtttatcatggcccacgaatgtttcaaacaccactgttttgagatgggtttgaaggcattcaattggatatagtcggtcatactgaggctcga

SEQ ID NO: 5617 - DNA, 438 bp, Hordeum vulgare
ctgccccgcacctctccgacgaactctcctccggttcaagttcttctccatcaggtggcaagagcgccgggcaccgtaccatgtcggccagcttcgtggggctgatgagcctgttcctggtcctgtggtctgcactggcataagaaatcggcgattcggcatgttggacatgttcttctgtcagcttatcctacggtagatgatttgcagctgtggtggttcttggtggtgtcgttgcatttgttttgctgtgcattggttggtgttgccagttcagtagacttcgtgtgaacaagtatctcggcactctattcagacctgtgataaccagagcagagtgggaattgtgtgagacgtatttcggcttcactattttatttcctttttggatttgtgctaataagaggagggcactgacgcctaaaaaaaaaaaaaaaa

SEQ ID NO: 5618 - DNA, 425 bp, Hordeum vulgare
  UNSURE (17),(19): n stands for any base
gggcgtcagtgccctcntncttattagcacaaatccaaaaaggaaataaaatagtgaagccgaaatacgtctcacacaattcccactctgctctggttatcacaggtctgaatagagtgccgagatacttgttcacacgaagtctactgaactggcaacaccaaccaatgcacagcaaaacaaatgcaacgacaccaccaagaaccaccacagctgcaaatcatctaccgtaggataagctgacagaagaacatgtccaacatgccgaatcgccgatttcttatgccagtgcagaccacaggaccaggaacaggctcatcagccccacgaagctggccgacatggtacggtgcccggcgctcttgccacctgatggagaagaacttgaacctggaggagagttcgtcggagaggtgctggggcag

SEQ ID NO: 5619 - DNA, 452 bp, Hordeum vulgare
cggcggcgacttcgcgttcgccggttcgtggcgcgccacctacatcgcggcagtgtctggcggcgcccatcgccctccgcgcgcccttgagatcagtggcttctactctgactacctcttccagagctggctatgtgccaacatggagatgcgggccgagtggctggagcgggacaccattgaccgccgccgcggcttatctgtggagagattcatcgcagagcacgaggagccgaactggccggtgctgcttgaggggtgccttgagtcctggccggcgttgcagaaatggacgagggagtatctgctcgaagtctcagctggcaaggagtttgccgtcggtccggtgagcatgccattggataggtacttcctgtactccgacaacgcggaggaggagaggccattgtacctatttgactccaaatttgctgacaaggttccggagatgg

SEQ ID NO: 5620 - DNA, 550 bp, Hordeum vulgare
acacttgtttactcgatgtgtctatactggtgctaacgcttacaacaacaatggggagcaacggtcttgagattatgttcttccaagttttaggacactcatagccttgtacaatcaaaataatctgcttcagtgcagacagatcagtgcaaaggcccatgaacccaggttctcaaagcaaatcaaacatgattgctcatgtaaacaggataagatcaaatgttaagtccacagacctagctgctgcaagaaaatcagaaggagaatttgaatcctccagtgttagcgtcgacagcagaatcccagaatgcgactttcttcttccgtgcagcagccttctgctgagcttcaacttcaagctgactaatcgtcccggggtaagctgtgtcgatggcgttccggaacttgtcgtgcaggttcaccctgtccttggtccctgacacaagttcacttgcattgggcctcttgagaaagtcaagaacattcaacaggttcctcctgctcacatagttctgagtgatggcaatggactcctcaagattgataacca

SEQ ID NO: 5621 - DNA, 553 bp, Hordeum vulgare
gtctccccgggcctgcaggcaattcggcacgaggccaatccagtcccctctccgatcgaagcgaagccaggctctctcaagatgcagatctttgtgaagacactcaccggcaagaccatcaccctcgaggttgagtcttctgacacgatcgacaacgttaaggccaagatccaggacaaggagggcatccctccggaccagcagcgtctcatcttcgctggcaagcaactggaggatggccgcaccttggctgactacaacatccagaaggagtccaccctccacctggtgctcaggctccggggtggcatgcagatatttgttaagactctcaccggcaagaccatcaccctcgaggttgagtcctcggacaccatcgacaacgtcaaggccaagatccaggacaaggagggcatccctccggaccagcagcgtctgatcttcgccggtaagcagctcgaagatggccgcaccctggcggactacaacatccagaaggagtccaccctccaccttgtgctccggctccgtggtggcatgcagatctttgtca

SEQ ID NO: 5622 - DNA, 556 bp, Hordeum vulgare
ctaggggcaaaaataacacgaattatattataaattcagaaccaacacaattattagaccgtaaacagggctcacttgattcagggctcacttactcatagctcatcgaacatgctgcacgacagcagaagtttcagacccaaccagtaacactgcaccacagtactgtagaaacgaagacaccaacgacagacccagacgacacactagaaaagacacggacgacaactccaactaaggcacgaagacttgtgaacacagaaacagaagcaccatgtacaggagcttactggccaccacggagccggagcaccaagtgaagggtggactccttctggatgttgtagtccgccagggtgcggccatcttcgagctgcttaccagcaaagatcaggcgctgctggtccgggggaatgccctccttgtcctggatcttcgccttgacgttgtcaatggtgtccgaggactcaacctccagtgtgatggtcttgccggtgagggtcttgacaaagatctgcatgccaccacggagcctgagcaccaggtggagggtgga

SEQ ID NO: 5623 - DNA, 293 bp, Hordeum vulgare
gacccccgggtctgcaggcaattcggcacgaggtccagtcccctctccgatcgaagcgaagccaagctctctcgtcctcctccttcaagatgcagatctttgtgaagaccctgaccggcaagaccatcaccctcgaggttgagtcctcggacaccatcgacaacgtcaaggctaagatccaggacaaggagggcatccctccggatcagcagcgtctcatctttgctggcaagcagcttgaggatggccgcaccctggccgactataacatccagaaggagtccacactccac

SEQ ID NO: 5624 - DNA, 539 bp, Hordeum vulgare
ccagtataacaaaaacagcaaacatcagacctagagacagcagaggttcagggctcacttattcatagttcaaagatacaaacgataaaactgcatcacagtacggtacagaaacaaagacacagacgagactccattagaacaccagagacaccgagccttgtgaacctagagacaggagcagctccatcaccaggagcttagtggccaccacgcagacggagcaccaagtgaagggtcgactccttctggatgttgtagtccgccaaggtgcggccatcctcaagctgcttgccggcgaagatgagacgctgctggtccgggggaatgccctccttgtcctggatcttcgccttcacgttgtcgatggtgtcagaggactcgacctccagggtgatggtcttgccggtcagggtcttgacgaagatttgcatgccaccacggagcctgagcaccaggtggagtgtggactccttctggatgttatagtcagccagggtgcggccatcctcaagctgcttgccagcaaagatgagacg

SEQ ID NO: 5625 - DNA, 521 bp, Hordeum vulgare
gccatccaatccagtcccctctccgatcgaagcgaagccaggctctctcaagatgcagatctttgtgaagacactcaccggcaagaccatcaccctcgaggttgagtcttctgacacgatcgacaacgttaaggccaagatccaggacaaggagggcatccctccggaccagcagcgtctcatcttcgctggcaagcaactggaggatggccgcaccttggctgactacaacatccagaaggagtccaccctccacctggtgctcaggctccggggtggcatgcagatatttgttaagactctcaccggcaagaccatcaccctcgaggttgagtcctcggacaccatcgacaacgtcaaggccaagatccaggacaaggagggcatccctccggaccagcagcgtctgatcttcgccggtaagcagctcgaagatggccgcaccctggcggactacaacatccagaaggagtccacccttcacttggtgctccggctccgtggtggccagtaagctcctg

SEQ ID NO: 5626 - DNA, 547 bp, Hordeum vulgare
cgtaagggctacttgattacgggctacttactcatagctcatcgaacatgctgcacgacagcagaagtttcagacccaaccagtaacactgcaccacagtactgtagaaacgaagacaccaacgacagacccagacgacacactagaaaagacacggacgacaactccaactaaggcacgaagacttgtgaacacagaaacagaagcaccatgtacaggagcttactggccaccacggagccggagcaccaagtgaagggtggactccttctggatgttgtagtccgccagggtgcggccatcttcgagctgcttaccggcgaagatcagacgctgctggtccggagggatgccctccttgtcctggatcttggccttgacgttgtcgatggtgtccgaggactcaacctcgagggtgatggtcttgccggtgagagtcttaacaaatatctgcatgccaccccggagcctgagcaccaggtggagggtggactccttctggatgttgtagtcagccaaggtgcggccatcctccagttgcttgcca

SEQ ID NO: 5627 - DNA, 521 bp, Hordeum vulgare
cgtcgccgcgggagcaggaccgcttcctgcccatcgccaacgtcagccggatcatgaagaaggcgctcccggccaacgccaagatcagcaaggacgccaaggagacggtgcaggagtgcgtctccgagttcatctccttcatcaccggcgaggcctccgacaagtgccagcgcgagaagcgcaagaccatcaacggcgacgacctgctctgggcaatgaccaccctcggcttcgaggactacgtcgagccgcttaagtactacctccacaagttccgcgagatcgagggcgagagggcggctccctccaccaccaccaccaccgcatcaaccacgccgccgcacctgcccgagatgccaaggagcaacaatgccggcggttacgccgagtacggcagcggagccaccgtccccgccccgggaggcatgatgatgatgggccttcccacggcacgccgccagctgtaacagtaaagagtgttcagagcttgagcagagcgcttccccggatcccttaggcta

SEQ ID NO: 5628 - DNA, 522 bp, Hordeum vulgare
atatattactctggtattgttatttttacactacaggccggccgtatgtgtatccacctcgtagcaacaatatctagatctttgcatggaaaacagtagaggtgtaccaacgccctcgaaattgtatgcacaaggttagcctaagggatccggggaagcgctctgctcaagctctgaacactctttactgttacagctggcggcgtgccgtgggaaggcccatcatcatcatgcctcccggggcggggacggtggctccgctgccgtactcggcgtaaccgccggcattgttgctccttggcatctcgggcaggtgcggcggcgtggttgatgcggtggtggtggtggtggagggagccgccctctcgccctcgatctcgcggaacttgtggaggtagtacttaagcggctcgacgtagtcctcgaagccgagggtggtcattgcccagagcaggtcgtcgccgttgatggtcttgcgcttctcgcgctggcacttgtcggaggcctcgccggtgatgaagg

SEQ ID NO: 5629 - DNA, 519 bp, Hordeum vulgare
caccgtcccctgaattggtgctggccagccggcgcacgccgccctacccctcgcacgcgccttctccgcccaaactcacgactcctggtcgtcgcctccgcgcagtccaacctctccaaagctattcaaacaacatggagggtcggtaaggaagctgtggatgctggaagtgctcttgtcccaggttcagttccacgcccaattgctaggataggtgtgacatttgttgctgcgtctgtcgccctttttctgctcaagtcggtcatttccaccgcattgtttgtactggcgatgatggggcttatatacttcgccttcctggcgatgaacccgaaagagggctccaggagcgtggatgaaggagacagtcctccgtcagacgaccccgccgaagaagcccggcgcataatggagaaatacaagtgaaaaagagacttattttggtgagtctactctgaagtctgaatgggcatacagagaaataccagctgtggccttggatggatctgcctttagatc

SEQ ID NO: 5630 - DNA, 553 bp, Hordeum vulgare
tttttatacctagccctatattgtataataataacatgtgttgtacaacaactcatcttttttgctgaaaagatcaaaccccaatatgtggccatacgaaagaattcacttctgttgatctaaaggcagatccatccaaggccacagctggtatttctctgtatgcccattcagacttcagagtagactcaccaaaataagtctctttttcacttgtatttctccattatgcgccgggcttcttcggcggggtcgtctgacggaggactgtctccttcatccacgctcctggagccctctttcgggttcatcgccaggaaggcgaagtatataagccccatcatcgccagtacaaacaatgcggtggaaatgaccgacttgagcagaaaaagggcgacagacgcagcaacaaatgtcacacctatcctagcaattgggcgtggaactgaacctgggacaagagcacttccagcatccacagcttccttaccgaccctccatgttgtttgaatagctttggagaggttggactgcgcggaggcgacgaccagga

SEQ ID NO: 5631 - DNA, 1020 bp, Hordeum vulgare
  UNSURE (1)..(5),(14),(15),(17),(21)..(23),(25),(26),(32),(35): n stands for any base
nnnnnttgggaacnncntgtnnncnnagtgtnggncccaccagaacgatgttagcatcccggccaccccgacggtacaagcggttgggttggcgacgagatgatcctaaggttcttgaaggacaggaagttcgccgtcgacgaagccttttccaagctgggggggccatcacccagagtcaggattttcacgtgccggaattatacacagaatctattatagggttgtaccacactggctaggcatccgagcgtcgatcgttggggggggggggtcttctttttttttttttatcgacgacccccacaacctattaattaatgggggggggccgtcccacttctccccctttttcctgctttttcgttatttattcctccgtttccccttttttccaattttctcttcacgtttgttccctttttcgcttatttttctttatatcttcctctcctttccattattcctttctttcctcaccccccatattttcctcgctttcctttcctcttgttccctcttcttttttcccccgttgtcctttttcatctcatttttttcagtcttctttttccaaatccttcttcggccccctcttttcttattctcaaccattcgttcatttcgtttttatttctccccatccttttattttttatgtttttcccatgccccttcctcccttccatttccttcttcttttctttttctttcccccttttcttgccgtttttttcccgttccccttccgctctcttttcttcctcttccttctttttttctttcatccattctactcgtctcgttccccattttgctccgcttttcacgttcggcttttctttcttcttccgttcctacctatctttgttgtttcgctttcgttcctcctttctgctttatgtttgttgcttccgcttctcttctttgtcgctttcgcgtcctcccgtgtcctcccctcaccctatttttcccctcccattctctttccttctcctaccattcccacctcgctcttct

SEQ ID NO: 5632 - DNA, 551 bp, Hordeum vulgare
taccaaagtcagctgactgagaccaattaaatctcagtcagtggaggtccaggcgctccccattttatatcacaaagtcgttacaaaaggttattccgcgtcaataatcttcaaactgtttacacccacgataacttagtactccctcttatatttctttacagagggaatacaagatagctgtccaacatccaatcttcaaacatttcctgaaaacaaacccggagccaagagtttttgagacatatccagcggtggcaccagcaaaggatggccatggcctgccttcacgttctgatgaagatgagtgctctcattaccaccatggttgcaacgctgtagcatcagctaccactccctaatccgtaatccatcggccttgtcatgcattactcatgttccagctcccagtccgtgcctagatttttatactgctggagaaaaatagaccgacaggcgagcaaagaaaggcagaagcaggggaaatcagcactcaactgaccttccacagaatctggccaccagccattaacagtatgacagctcaggat

SEQ ID NO: 5633 - DNA, 521 bp, Hordeum vulgare
gccaaatcatagcccctgcatgaatgaccagaaggataagttgtggcctatgttgaagaagcttggtgtgaccatgaagaatgatgagaaggacttgatgggcaaggctctcatgaagcgtgtgatgcaaacttggctgcctgccagtcgtgctctgcttgagatgatgatctttcaccttccctctccttcaaaggcccagaggtatcgtgtggagaacttatacgagggcccccttgatgacatttatgcaaatgctatcagaaactgtgatcctgatggtcctcttatgctgtatgtgtccaagatgattccagcatctgacaagggtagattctttgccttcggacgtgtttttgccgggagggttgcaactggcatgaaggtccgtatcatgggtcccaactttgttcccggccagaagaaggatctgtatgtgaagagtgtccagcgtactgttatctggatgggaaagaagcaagaatctgttgaggatgttccctgtggtaacactgttgctt

SEQ ID NO: 5634 - DNA, 542 bp, Hordeum vulgare
aaagaattaccagtggacaacagatacataatctaagttaacatccgttacataccagacataaaacatagttctcttcccagtatcaccacaaacaggtcatttaacagcaagatagtaagattgactcatcgatacaaaatagttcaactcaacaagagcaggtaagggataacagcaccaaaaatttagagcttgtcctcgaaatcagatagaggggtcatctgctccttgagacccttcctcttgcggatctccgtgacaagcgtcgccgactgggtgcccgggtccaaaggatcagaagccatgatgtcccagtggtcaaacacacactgggggaaggcctggccggaggtcgcggccctcagggtgcttgagaatccaaaggactcaatgacggggaggtaggccttgatgttgtagagcggggtaccttgcctctgcatctcctcgaacacgtgccctctcttctggttcagaacaccatagatgccaccaagtgcattctccggggcctggatctcaaccaggtagacgggctc

SEQ ID NO: 5635 - DNA, 518 bp, Hordeum vulgare
cttcttcttctctctcttctctcaacccgaatccaaatcccaaatccccaacccggcgacgatggcccgcggcagccgctccgggagtaacggcggcgggtgcgcgcgctgctgcctggggttcctgctcaagttcctcgccttcctccaggccttcgccgccgtctccgccgtcctctacgccgcctccatcctctcccgctggtcgcgacaacacgagctgcgcttcgaccatctcctcccggacctctggttcgcgtgcgccgtcatggccgccggcctcctctactgcgccatcctcctcgcgggctacgtcgccgccgaggtcaacagcgggtgctgcctctgcttctataccatcttggccatgacgatgatgctgctggaagctgccgtggccggccaactcctcctcaacgagcactggatccaggatctgccgtatgaccgcaccggagagctcgagagcctcgtctcctttgtcaagaacaacctcgacctctgtaaatgggctgctg

SEQ ID NO: 5636 - DNA, 551 bp, Hordeum vulgare
atgatggaaattatttactacggcaccctcctggctgtccaatgactaagttgcggattttatccagattgacagaatgattggacatacaaatgtatacagtgtgcattacaccatggcatattacaagatatgacttatgtactgcatatatgatatgtgcttcgtcatcagtcacacagattctcactgtggccgtactgcattttgatccagtgtgttgtaggtgtagtcgcttgtggagttcaatccatacttttgcctcatcgatgagctccataggccaggctgggcacctcttgggtcggccgtggtagggatataggctggagcaccttgggcaagaagcagcggcctccttatgaccacaaaatcttcttcgctatcatagtccgcattggcgggcgaaaccatggctcgtagagtcattgccaagaaaagtgagaacgcctgcgtggcgacggtagcgacagcagcccatttacagaggtcgaggttgttcttgacaaaggagacgaggctctcgagctctccggtgcggtcatacggca

SEQ ID NO: 5637 - DNA, 547 bp, Hordeum vulgare
  UNSURE (16),(53): n stands for any base
gtcccccggctgcagnaattcgcacgggcagcctcgccggccgaacagccggnggacgacgcggcggcggcggcgaaggccgccaaactccgagaactccaggtccaagtcctccacaaccaccatacctgcacgtacaccgaggaggcgcttgggctgagcttcaagctcctcgagataaacccggaggcctacacggcgtggaactacaggaagctcgcgctgcagcacaacctcaaggagctctctgatccagaggccatcaaatcttctgtcgatgccgagctcagagtggtggagcttgccctgaggcagaacccaaagtcctatggagcgtggtatcatcgcaagtggttgttgaaccagaagcttgcccctgtggatttcaagcgcgaatacggcctcttggataaactgttaaaggtggatgcgaggaatttccacggatggaattaccgcaggttccttgcaaaatttatgggggtgccagaagagaaagagcttcagtacacaatggataagatcggtgaaaatttcagtaattact

SEQ ID NO: 5638 - DNA, 546 bp, Hordeum vulgare
  UNSURE (22),(23): n stands for any base
gcacagggaataccttgtatannattgtattagtctctcagagctgcttaactgtaataatacatgaatcagacaatagcagtgtacagtgtttactttccccatcctatcacaatttccactctccgatgaacagctaatggatacatgcgccgtcgagccacttcagagaagggctgagtgtcgtcacgacggtcgcgaagctatccttgtcggcaaccgcatttcccttgatgtcaagctgcaccaggttcacgggtttgaagaagagtatggcgtcccagaactcctccacgttgacgtttttctttcggcactcctcgaaggcttcacaccgttcgactttgtgcgaaaacggagatgagcatatataccgtgttgtgtcgatcgggtgagctccgatctcgttgaaagataaatctaacgctttcaaagaaatcttcgtcaggggttcgagtgacgtgaaactgctgagctggttattgctgatgttcaggcacacaagctgctgcaaggcctccaaaccttcaattgatctgagcttgt

SEQ ID NO: 5639 - DNA, 540 bp, Hordeum vulgare
  UNSURE (4): n stands for any base
gggnctgcaggaattcggtacgaggccgtactcgacttgcagcaaacgctcaaccggccggcgaggcgaaatcgctacgcgcaccaactcccccaacaaccggtcgaggccatggcggcggcgcagaagccggcgaagcggctcggtggtatggcagaggcgctcgccatcgccggggacctcggcttcccggcccctcccgcgcaggaaggtcagaacacctcggacaaaagtgatgacctggtcagggtattaagggagctgactgtcgtgcagcggaacattgccaatttgcaagttgagctacaaggcagaaaggatgataaaaacattgctcatttgactcatgttagtgaaatggaaaagaagtgtgaatccttggccagaattactgctattttgaaagatgttattcaaaacaaggaccgcattattgcccgtctgcagcaaccttactcgcttgattgcattcctgttgaagctgagtaccagaaacaattctcggagctacttctgaaggcagcaagtgactatggggca

SEQ ID NO: 5640 - DNA, 524 bp, Hordeum vulgare
tatctacatctagatgtgttttagcaaaaccttatgtggaacataatgttatttacaacaaacttggatattaacctattggcatgttacttagatacgaacttccataacaacttttgccagcgaccagaagaaaccacagaataaaatcgaaggcaagcctcggcgatcctatttatacagaatgcaaacaggtgggtattagcttggtgggctgtgacctacaggtccctgttaatggaggatggccatgacagcctcctctggttcataccgtcgagtccatcgctttcagggtttacgtcgtccacttgcttccagctattgagcattgagccctctctccactgaggtggcgttaagaactttgaatcagcactggagccacctggggtcactgccagagaagaaggaccaacacgtagtgtttgaagagtagaaaaggattccctcatcgcagacatggcctcgaagaaccgggtgcaggatgcaagcgcagcaggtatcggtcgtagcatttcacc

SEQ ID NO: 5641 - DNA, 519 bp, Hordeum vulgare
ggagaaaggaatgaacctctttcgtgtgccaacgtacgatgtggatctaatgtggcacacccaccaactgaattctgttatctactacagtgacatgctgaatctccttggaagagttctggagcatgatgacacagatgatgaccgagctgaaggaaagaagctcgacaccggtttttcagggaccaccgagcagttcgagaatacctttggtctgagatactggaaggttggtgctatgtaccgtggaagcttgccatgtcctgtgacatccattcctcagatatttagtagtgaggacgatggtgtttttggtgtcgataaagcagagaagcatcttactattcttgaaacaacagttgtggagttatatttacagattgtggacatcaagaatttaccatctgcaattccagagaaaagtgtgtacgtgtggttcaccaagactcaaccagatgtatttataagtgatggtggcaggttagatatttcaacgaaaacagggaagagtattggagc

SEQ ID NO: 5642 - DNA, 543 bp, Hordeum vulgare
atatttacatacatgtcattctattttttatagaattaggcaatgcccggttaccggactgggacaacccagaccttcccacaccacaactgaaccaaccaacaaccgacctcaacattatttacaagcaatgagtggaatcgaagggcatggaactggaaggcaataactactatgaagtgaccatgctgccgcagccaccgccgcagcccgaaccgcatccgcatgacttggcgaagccagtcttggagcttgccattaccatgttgccacaaccaccgccacagcccgaaccacaaccaccaccacagcctgaatcgcaaccgcctgacttggcgaagccagtcttggagctttccatgaccatgccgccacagcctccaccaccacaacctgaaccgcatccacctgacttggtgttcccctcctgggagctttcaataaccatgcttccaccgcaggaaatatggccattctcgccgcctgcaacgacgccacagctcgcatgacctttcttgtagctcatggtgaccacagagacat

SEQ ID NO: 5643 - DNA, 365 bp, Hordeum vulgare
aggtggagatccaggaggaggagccagcggttagctcagacgcagcctcagcctacgaacgaagatcagcatccagggtccgggaataactccgcgagcgagaacagtggtgataggcagcaacaagggcagcctccacaatccggtgtgcacattgtctgatcagccagatgaagacgagcggtgatccgagcgtgtgaatagctagctttgatctgtgcagtagtcgtagctcgccggacctcagaatcacaatggtggcaggaatagatacacgggagcagatcttcctggcctttgcatcggaggcaacatgccgcctagagtttagccatgggttagtctagcagtttgacataaaatac

SEQ ID NO: 5644 - DNA, 144 bp, Hordeum vulgare
ttttttttttttttttttttttttttttatttttttttttttttttttttttttttttttttttttttttttttttttttttttttttttttttttttttttttttttttttttttttttttttttttttttttttttttttta

SEQ ID NO: 5645 - DNA, 111 bp, Hordeum vulgare
ggcctgcaggaaattcggcacgagggagagagagagagagagagagagagagagagagagagagagagagagagagagagagagagagagagagagagagagagagagaga

SEQ ID NO: 5646 - DNA, 559 bp, Hordeum vulgare
gactagtagcacttattgaataacacacaagcagtcatcagtcaaaccttacaccaatgctcatcacgacatgagcagaccaccaccacaagtccacataacgaaaaaataagtctggcaaggcaacacgaccgacgtttagaacgggtaaaagaatagcatctagctatcaccacctgacagcaccacaagcactccaccaacttagcgagcgatataaggcatatcaatgggaagaacgggaggagacgcgcctcagacggcctcctcgtcctcctgctcatcctcatagtcctcttcctcctcgaccgtcgcgtcctggtactgctggtactcggccactaggtcattcatgttgctctcggcctcggtgaactccatctcgtccatgccctcccctgtgtaccagtgcaagaaggccttcctcctgaacatggcggtgaactgctcgctcacgcggcggaacatctcctggatcgacgtggagttgccgacgaacgtggacgacatcttcaggcccgtgggcgggatgtcacacacgcttgacttgacgttgttg

SEQ ID NO: 5647 - DNA, 355 bp, Hordeum vulgare
ggggagcccaccttctcttctgacaccgcacgggaatctccggccatctttgcttatttgcgaggttccttgttgagtgagtgagtgatcggcggcatgggcgtggaggtcgtctccggcggggctgtcgaggcggtggcggcggcgccggctaaggtcgaggtggaggcgggcgcggctgctgtggtggccaagaacatgtcgttcagggaggagagcaaccgcctgggcgatctcaaggaccacgagaggaaggcgctcgctgagctccgcgccatggtcgaggaggccgtggtggacggcaagctgttcgacttggaggacgggagtggcaaggtgaaggtgaaggtggagg

SEQ ID NO: 5648 - DNA, 374 bp, Hordeum vulgare
ttttttttttttttttttttgggtaaaaaaatctccttatatttctcacataaataataataattccacggcaaaacaatggtgcccgccaaacacgacacgatgtaccactagtgactgctctcttgcacaaaagaatggaatgaatgtagaatccacgaatgtagaatccacacacacacaaagatctcagcttccaaagaatctgcccccaaatcttcagcacttcttggcgagggcgctcttggccttgtgccggaagagcacccgcttcctccagcgggtcgcgttctccacggtgatcaccaccttgccggcctccgccgcgcggaacgagttgcgcaccgcctcctccccggcgcccaccttcctgc

SEQ ID NO: 5649 - DNA, 545 bp, Hordeum vulgare
  UNSURE (3),(11): n stands for any base
ggnctgcaggnaattcggcacgagggtttatgctatgctttcattgaattcgaggcaaaggaggcatgcgaacgtgcatatttcaagatggataattgcctgattgatgatcggaggattcatgttgattttagtcaaagtgtttcaaaattgtggggtcagttcagacaaagtaaacggaatggaaataaagatggttgtttcaagtgtggtgctccagatcacatagcccgagattgtgaccaggatggtgagcagaaacctaaagccccaaattatgttctgaaagatgataacactcagcgaggcgggaataaccgtcgaagttatgatttcgtcttcgaggatgatactgctcgtcggaatactgaccgaagaaaggttcaaaaagtagatgaccagagaacgcagctaccgcctcgtggtgaccgcgataggaacggcagcagggagagaagtcagagccacgagaaaggaggcctgcaaagcaaagaagctgttgtgagccgaggaggtcagaggccagacgatcaccacagtcacga

SEQ ID NO: 5650 - DNA, 549 bp, Hordeum vulgare
ttgcaaaaattgcagaaacgggcggaattgttggctgcagatgggatcattagtacagcacacgagatatcagttataaactgttgaaggatgaacccaccggtccgattccacacaacaaaccatcccttttgatctagaaacaacaaacattccgaaaatgaacatgcgatgagaactttccaagctcccatatattatacagtctacagtctacggctagagatttcaagctcaagctacatcacaaactcagcgtaagcagaaaactggcaggggcaaaactggcaggcggtacagcagccaacatctatctatcatcccggtgccgcctctccctgtgcctgcttgcctcgcggtgtccggcatcttcccttctgtgtctatcagcaccagggctccgtgccctgcggtcacgctcgtctttcctgtgacgatcgcccttcccacggtcatcatcatccctgtggcgccgctcgccattgggcttatcatcccggtcgtatcgaccagatcctgatctccgtttatagtcttcttcaccgccgt

SEQ ID NO: 5651 - DNA, 549 bp, Hordeum vulgare
  UNSURE (12): n stands for any base
gttttaccgggnctgcaggcaattcttcacgaggcacaaaaatactttttgaaggttcaaaagaacggtacaggtgaacatttaccaccgcctcgcgctatgccagatttttcccaagtatacaacttccttggaagcgtattcgatccagatacaagtgggcatttgcagaggttaaaggcgatggatccgattgatgtggaaacggtgctactgctgatgcgaaatctatctgtgaacttgattaacccagaatttgaggcacataggcagttgctctcgtcgtatggttctggtggagacgaaaataagcctgagggcatggacaatcttggttcccagagtagccatctcccatcgatggtgacaagtgaatgagcgagcatcagccattcgccacggaagcttcggttgtttccgagagacgcttgtgttctccctgtactggtcctgtcggcgtctagtctgcctatttatggatgttggctggggcagtgacatctgtacagcttccgagatgatgctctaaccctaggctagtgttgctta

SEQ ID NO: 5652 - DNA, 551 bp, Hordeum vulgare
  UNSURE (13),(26),(27),(48),(50),(52),(53): n stands for any base
gcacaatttaagnaacttcacattgnncatagcatcagggtgcacatnantnntacatcgcagtggagaatacacccagctggattattcagcttatttatttgccttggtcgaatactcgcagtatctcaaacgtctacacagtaacacatatgtacatccacaagcacatacataccgatgtatacatacaagaaccatctttctctatgcccaaccctagggaaaagaattgcttgagcacacaaaactggctatctacaccaacttgataagcaacactagcctagggttagagcatcatctcggaagctgtacagatgtcactgccccagccaacatccataaataggcagactagacgccgacaggaccagtacagggagaacacaagcgtctctcggaaacaaccgaagcttccgtggcgaatggctgatgctcgctcattcacttgtcaccatcgatgggagatggctactctgggaaccaagattgtccatgccctcaggcttattttcgtctccaccagaaccatacgacgagagcaactg

SEQ ID NO: 5653 - DNA, 484 bp, Hordeum vulgare
actcaagccgtccaacgagatcagcatctccaagtgttcagccgcccgcaggagagctcgtccaaggccgcggtcgtcggccggcgcgcgctggccgcgtcggcgttcctccggggcgattccttcaccatggaatgcaccatcgaggtcctcaaggagctgcctgatacgccgacggaccctgtcgaagaggtgccggtgccatcctcaaacctcggcctgcacctcgccgagctcttgcagagcgaggccggggcggacgtcacgttcctcgtgtccggcgagtcctttgccgcgcataagagcatactggccgcgaggtctccggttttcatggcccagttctttggagacatgaaggagaaatgctcgcaccgtgtggagatcgaggacatggaggctgtggtgttcaaggcattgcttcacttcatctacaccgataccgtggtggaattcgacgagaagggcgaggaggtgacaatgt

SEQ ID NO: 5654 - DNA, 521 bp, Hordeum vulgare
  UNSURE (3),(21),(64): n stands for any base
tgnacaaggcacaaacagggnactacacatgtatcacctggtagcagtgataaacatacagggnagaagataccaaatcatggaccatttagactaaattacatcgcactgaaagcagcaagttgcacacaagcaatccaggggaacacaagcacaaccagacactaacctccctgcgattccgttcgttgttaagacataccacaagttaactagacacacctgacaagcaggaacagagactagggcatcactgaattctttcagacctctggtagcacccatctatgcatcatctctttatcccacgcgcaggctcgatttgagcaggtcagccagcaccgaagggcagcttgccgccaggtacttgtacccctccgtcgccaacacagcatcaagaacctcacgatttctaatgatgaaccggacgcacttggccttgagccgtggacagtcgtgctgctcggcaagagccagagacgtcgctgcagtgtcgacattgatgccatcagagagcttgc

SEQ ID NO: 5655 - DNA, 518 bp, Hordeum vulgare
agaaagctaacactttcccttcctcgactcaaactccattcccatccacctcacctcgcggctgaaatcaccccatctaccccgaccgatccctggcctggggaggggaaggaatgccgaccaagaggagcgtgggcaccctgggcgacaaggacctcggcgggaagaaggtgctcctccgcgccgacctgaacgtgccgctggacgacggacagaggatcgccgacgacaaccgcatccgcgcctccgtgcccaccatcaagttcctcatggggaaggacgccaaggtcgtcctcgccagccatctgggccgtccaaaaggtgtcaccccgaagtacagcttgaagcctcttgttccacgcctgtctgagcttcttggggttgatgttgtgatggccaatgactgcatcggtgaggaagtagagaatttagctgctgctttaccagatggaggtgttttacttctagaaaatgttagattctacaaggaggaagagaagaatgaccctgagttcgcc

SEQ ID NO: 5656 - DNA, 546 bp, Hordeum vulgare
  UNSURE (16),(17): n stands for any base
agcctgcagtatacanngtgttacatcgaccaataaaggtttgcttgtgtcaaatagtctgacaaaaccttgagagatgtttgctcccattgcgtcggaagtcaagcttattcactactgatcgtctgacaaaaccttcagagaaacctctacttctatttcaggatacactcatctgtacaccaagggtccgaacaatagagtggagtaaagctaggtaaccacgtcttgccaccagcctagcctatgcgtcgttgagagcaaggacgcctgggagagtcttgccttccagcagctctaggcttgcgccaccaccggtcgaaatgtggctcatcttactcgccaacccagccttctcgacggcagcaacagagtcgccgcctccgatgatggttgtcacgccttgtgctgtgatatcagccaactttttcgcgatcgcatcggtgccagcagcaaacttttcaaattcgaaaactcccatcggcccgttccagatgacagtcttggtagtgtccaaagtttcactgaatttcctgatagaatccg

SEQ ID NO: 5657 - DNA, 552 bp, Hordeum vulgare
gtctccccgggcctgcaggaaattcggcacgaggctccctcctccggcgctctccccttctgcggccgcacgggctccgggtctcccgcgacttcgctccccgaagatttgcacgccacattgcttcatcaacaaatgaagaggctgctgccagaacagcggcagcgactgctgatactggaggaccaaccatttttgacaagatcattgcaaaggaaatcccttcaagcattgtctatgaagatgagaaggtgttggcatttagagacattaatccacaagctccggtgcatgtcctagtcatcccaaaactacgagatgggctaactggacttgacaaggctgaaccaaggcatgctgacattctggggcagcttctttacgctgcgaaagtagtggccgagaaggaaggcgtagcagatggattccgcgtcgtcataaacaacggagcagaaggatgtcaatcagtctaccatctgcacgtgcatgtactcggcggaaggcagatgaaatggccgcctggttaagtttaagagcagcgtatgctttttt

SEQ ID NO: 5658 - DNA, 535 bp, Hordeum vulgare
aaccgtcggtggcaagtaacattcacttcacagaaatggtcagacatcaagtaattcaacaatagactatggtcgatcacacagaagcagaaaaaaaagcatacgctgctcttaaacttaaccaggcggccatttcatctgccttccgccgagtacatgcacgtgcagatggtagactgattgacatccttctgctccgttgtttatgacgacgcggaatccatctgctacgccttccttctcggccactactttcgcagcgtaaagaagctgccccagaatgtcagcatgccttggttcagccttgtcaagtccagttagcccatctcgtagttttgggatgactaggacatgcaccggagcttgtggattaatgtctctaaatgccaacaccttctcatcttcatagacaatgcttgaagggatttcctttgcaatgatcttgtcaaaaatggttggtcctccagtatcagcagtcgctgccgctgttctggcagcagcctcttcatttgttgatgaagcaatgtggcgtgca

SEQ ID NO: 5659 - DNA, 550 bp, Hordeum vulgare
  UNSURE (44): n stands for any base
gtcccccgggcctgcaggaattggcacgaggtggctttattgancatgagaacaaaagcacgtgaagtgttgcagagagaggatgatctaaatgaaattgtccagcttgttggtaaagatgcactgggagaatctgacaagattacgttggagacagccaaacttctgagggaagattatttggcacagaacgcttttaccccatacgacaagtattgcccattctacaaatctgtttggatgatgcgcaacattattcatttcaatcaattagcgaatcaggctgtggagcgagcagccaatgctgatggacacaagataacctacgccgtcgtaaagagtcgcatgggtgatctattttaccgccttgtatcccaaaagttcgaagaccccgcagaaggcgaagacgtccttgtcgcgaaattccagaagttatacgacgaccttaccgccgggttccgcaacctagaagacgaggctaggtaaaagaaagaagaaacgttgtgtatggccaccgtgtaaacaataaggagcaccaaatgctgtgaac

SEQ ID NO: 5660 - DNA, 550 bp, Hordeum vulgare
tggcaaaaataatatgaatatagacattattgatgttcaagtagatggacatcgtgcttattccactatgaacatgtccaccggtgttcaatcttcttacaacaaataatggtacacatggggaaaaataatggcttgcatcctggcgctggagaccaaataatgtaaaatcctgaaaaaacaaggctgtctgtctgtcgcaaaaaaaggggatcctgaaacgtaattcgcatctacacaaactctggtgaagcaaaagcaaattgctcgcaagtcgttcacagcatttggtgctccttattgtttacacggtggccatacacaacgtttcttctttcttttacctagcctcgtcttctaggttgcggaacccggcggtaaggtcgtcgtataacttctggaatttcgcgacaaggacgtcttcgccttctgcggggtcttcgaacttttgggatacaaggcggtaaaatagatcacccatgcgactctttacgacggcgtaggttatcttgtgtccatcagcattggctgctcgctccacagcctgatt

SEQ ID NO: 5661 - DNA, 1509 bp, Hordeum vulgare
  UNSURE (1)..(27),(157),(905),(1125),(1381),(1408),(1457),(1509): n stands for any base
nnnnnnnnnnnnnnnnnnnnnnnnnnnaaatgtggcgcagaaaaggagccccggtggggccgccggcgggggtgtgatcctgagatgcgggagggcgggggtggcgccatcgtggtaagaggagtgtgttttttgtgcgtgtggtgtgaggactttntttggcgagggtggggtgtggggcgcggctttgtgggagttgatttagtttataaggacaggaattgctggtgtaggagcggcgggggccgctggtagcatgtttggtttgggtgggcgcgtcggagccagcgggcgtcggtcgccgcggtccacccggggggaggggggtacgcgtcccgtgagttgttactctcgttcataccgttaaaaataattacacattcgcacgcaaccccaaagccaaacccaacccggagcgccacacgccccggggtctctactcaacgacacgcaccctaccacctccggtggagcggcgggcaggcggcgcgcgactccgtaatcgaggaggagacgaagagcgaaaaaatatcataagaaattatcagtatggaaacttttagtatcaaagtcggatccggcggtacggttgtcgggcatggagaagtaaattgtgggtatgatacagggttttgaatgaagctatgacgcagcccggggccggcgcgctgacgtaagttgtaatcgcatctcggactccgctgtaagttgccacaggcatacccgtcgcgaggtggcggtagtaaggcaaggccgtaggagcagccacgagtacgtgagggcgcgatgacggccgaaaattgttgacactcacctcgctgtcccgtccgcgcagatgcctgactcgtcacgtcccggtgcccgagcccgcattaccatcaagtcaacaggagtgttaagaacanacacgtaccaccacacagctcgattgtcgtctggccccgctaattctagcacacgcatccggcttgcgctgccggtacccccgcgccatccggcgcctctacgctcctacattgtcgagggtatcgaggcgttcgagcataagtgaatagtaggaagataacatgcctatggcagcagaacctaggctggtttatgtctcactcacggcacagtctatantgtactgacagccgccaagtagtgcccatctggtcactaaacacgatgcaaccgtcggcacactatcttgtgtgtcctaaatcacgtggagttcggatcatgggcaagcttgtttgtgtcagcacagacatgtatcccgcagccgagcatagtgttactgacaagattactatgacgagacagaaaaggatgtacagacgcgccggactgaagtgcgtgcactttgtccgcactagggcgcacacgtaccgcgtcncgcgcacgctgcggcagtggtcgtgcnagagggaacaatgcgccttagcgtacaccacatgaccaacgatgagaantcaccacaggcagacactaggctaccgagtcgaacgaaatgagcgtagcatn

SEQ ID NO: 5662 - DNA, 511 bp, Hordeum vulgare
tacacaacatagctctactagaaggtggcaaacatttaacggccatctagagttgtgatgcttatcccgttcgcagaattttccatctgttctgtagtttctgcgacttctcgattacctagagcatgatatgcgggtttctttggtgctggaaccagtgcacttccgttctccaacataaatataacggaagacattagggggcgatcatcaggatagttttgaacacacaagagtcctacatgaatgcaccgtaaagcttcttctagaggacacctctctctgactgaacattccaccaattcagcggcctttccgtcttcccatagtctccatgcataagctataaggttggagaagttggtcatgagttctgatgagctgatcttgaaaccacttacaatctccaagagaagtacaccaaagctataggtgtctgattttacagaaaaggcacctcccatcacatattctggtgacatgtaaccatatgtaccaacaactcgcgtag

SEQ ID NO: 5663 - DNA, 527 bp, Hordeum vulgare
ggcacgaggggcggcacagggcccgttgcggtgagcgccggcgtcaacgtcaaggggcataccctgcggctggagcgcgacgacgacggcggccacctgctcgccttctcctacgacgccgacgcccccggaagcataacagtttacttctttgcacaagaaggcgatgactgtatcctgaagggtacaaaggaaaatttgctcaaacctgtcacagtaactttcaaggaaggtcatggtcaggagttcaggcaaccaagtggaaccggaataaagctctcaatgtttgaggagtctgagctaactaaggttggggaggatcatgtatttcctctcgcattcaaagtggaagtgggtatgtcaagcaaccaagaatcagaaacggaacatgatgctgaagacacgaagtctttggttaaatttgctgtgtttgttaagaaagacagtgctgaatatgggatcaacattgtgcagcagatactgtgggtaaatggaactagatatgtcttgcaggagatatacggtat

SEQ ID NO: 5664 - DNA, 548 bp, Hordeum vulgare
gggatgttgacgtttaaattcatgtcgccccaaactgaacatcacggtcaactcagtgtaatacctttcgcgttatggtctttgccgaaatcagggtaatttcattttaacacgcgatatatatatacatccaattacggttgctagcaatcaaacggaacttcctttgagggtttcttagctactgatctcctccttgatgatgcctgggcatgctgtcaaccttaatctcaagaaggctctcaacaggctgcctgcacatggggcatttgttggtctggaaccttaatgtctgagcacactccctgcataggcacatatgcctgcatggaagaacagttgtatctcttggttctgtaagacagaccacacattctttcccagaatcatcctcattaacattcctgtccgctctgttcctgtccccaataccgtatatctcctgcaagacatatctagttccatttacccacagtatctgctgcacaatgttgatcccatattcagcactgtctttcttaacaaacacagcaaatttaaccaaagac

SEQ ID NO: 5665 - DNA, 413 bp, Hordeum vulgare
aacaatcagcaagagcagcctcatctttggttggccgtaactgccgccgtcacaaagatcagatgtatctggtgaaggacatcggcggagccatcgggctgatggcggcggccttggtgctcctcggcacctggccggtcgtcctcgccgtgctggagcgccggggacggctgccgcagcacacgtacctcgactactccatcaccaacttcctggccgccgtgctgatcgccctcacattcggccagatcggcggcgacacgccggagacgcccaatttcctcactcagctcacccagccgcaggactactggccgtccatcatgtttgcgctggcgggcggcgtggtgatcaccctcggcaccgtggccacgcagtacggctgggcatacgtcgggctttcggtcaccgag

SEQ ID NO: 5666 - DNA, 341 bp, Hordeum vulgare
ttttttttttttttttggggggcttataattacggtgcctgaattttctaaccatcggtaagatgtggcatgcatcgcactcgtccaagtttacacaacatccgtcctcatcgaagaacttgctagcctctctgccgtcgctatccaagctcccgatcgccatgccatgcatgagcagcgttggttgcgtcagagcggcttcctgtgcgcggaggaggccatgagcacggacatggcgacgacgaacatgaagagcatgctccccagcagcgtgtacgtcctcctcgacgacctccggtactccccgaacagcaccacgccccagaacgtgctcaccagcg

SEQ ID NO: 5667 - DNA, 374 bp, Hordeum vulgare
atcccaagctagcatagcctacaagcttaattagccacgtaccagcacgaacgatcagtagcaatggcgccctccaagctcgccctcttcctcgccctgaacctggtcctccttgccgctgtgcagggctgcggcccctactgcccaccggtcgtccccaccccgccgatcctcccaccacccgtgccgtcgaccggcggaggcagctgctcgatcaacacgctgaagctgggcgtgtgcaccaacgtgctgaacctgctgaagcttaagattggcgtgccggcgaacgaacagtgctgcccactcctgggcgggctcgccgacctcgacgccgcggtgtgcctctgcaccgccatcagggccaacatcctcgg

SEQ ID NO: 5668 - DNA, 374 bp, Hordeum vulgare; identical to SEQ ID NO: 5667

SEQ ID NO: 5669 - DNA, 381 bp, Hordeum vulgare
atcccaagctagcaaagcccaccaagcttagccacaaaccagtaagagcaatggcgccctccaagctcgccctcttcctcgccctgaacatggtcctcctcgccgccgtgcagggctgcgggccctactgcccaccggtcgtccccaccccgccgatcctcccaccttccgtgccgtcgaccggcaggggcagctgctcgatcaacacgttgaagctgggcgtgtgcgccaacgtgctgaacctgctgaagctcaagatcggcgtgccggcgaacgagcagtgctgcccactcctaggcgggctcgccgacctcgacgccgccgtgtgcctctgcaccgccatcagggccaacatcctcggcatcaagctcaatgtcccca

SEQ ID NO: 5670 - DNA, 329 bp, Hordeum vulgare
tttttttttttttttttttttttttttttggcatatcacgggtcgagttaacccaacttgaacaaactttctgttacagatacgtgtacaagaatgtatatcctttcacaaatatgcaaatcatgcatttagataccatataacgagaaaaaaatgacattgatctcacaagcttatcaagcatgcatgcacaagcgagctagcccatgcaaacgcctgacatatcaactgtagcggataaaacatacatatggtgcgtgtgtatgacgtgcaaaatagtagaacgattatgcatggatggatggatcaaatggggcaggtgaagttgg

SEQ ID NO: 5671 - DNA, 502 bp, Hordeum vulgare
ggacaggcacttcggctgaagctggtggacctgatgggttgaggaagtgcaaatctgattctaaagctatttcaagtgttcttgctcctccgaaagatgtcgaggacctgcaaacagaaggatatggaaatgttaatatcttcacatacaacgaactgcgagcagccacaaagaactttcggcctgatcaaattcttggagagggtgggtttggagttgtttacaaaggtgtcattgatgaaaatgttagaataggttttaaatccacacaggttgctgtgaaagaactaaacccagagggctttcagggagacaaggaatggttggcagaagtcaattatcttgggcaacttagtcatccaaatctagttgaactgattggctattgctgcgagggttcacataggttacttgtctatgagtacatggcttgtggcagtcttgagaagcacctttttcgacgggtttgccttaatatgccatggtcaactcgcatgaagat

SEQ ID NO: 5672 - DNA, 546 bp, Hordeum vulgare
gacgacagaaaatctctcatttcattttgggtgtggatctttcccaccaactgtttcgagtttacagcacgaacaccatcatggaacacacattacatgctttcccatgacgcctctctctctacatacaattcgctaaccacaagaacaagaaccctagcttggtagttctgccatcagaagaaaaacaaaaaacaccagctgactgactgactgatcgatcgatcttgacaacaagatggatggcgacacgagacggacacgggcaacggaggcttgagcctcgtcaaaaagtgctgttattactttatatcttgtacagatcttcgtccacaggaggaggatcatccctgctgctgtttctggaagggggcgatgccagggtttccagccccaactgatgcccgtcagagtcaggcgaagggatgtacagcttgcactccaaaggtggctcgctcttgctcctgccatttgctggccgcgtcctcctgctctggggcactggctttccgttcgtcggtggcacggccacggacacggcatcag

SEQ ID NO: 5673 - DNA, 549 bp, Hordeum vulgare
  UNSURE (12),(26): n stands for any base
gtccttccgggnctgcaggaattcgnacgaggctctaagtactccaattccgacactgtggtttatgtgggttgtggagaaagaggaaatgagatggctgaggtccttatggacttcccgcaattgacaatgacattgcctgatggacgtgaagaatcagtcatgaaaagaacaacgcttgtggctaacacctccaacatgcctgtcgctgctcgtgaagcctccatttatacaggaattactattgctgaatacttccgtgacatgggctataatgttagtatgatggctgattccacgtccaggtgggccgaagcattgcgtgaaatttcaggacgtttggctgaaatgcctgcggatagtggttaccctgcgtatttggcttcacggttggcatccttctatgaacgtgccgggaaggtgcaatgtcttggcagtccagaccggacaggcagtgtcacaattgttggcgccgtctctcctcctggaggagatttttcagatcctgttacctctgcaaccctcagtattgtgcaggtcttctgggga

SEQ ID NO: 5674 - DNA, 554 bp, Hordeum vulgare
  UNSURE (37): n stands for any base
tggcaaaaataatatgaatatagacattattgatgtntaagtagatggacatcgtgcttattccactatgaacatgtccaccggtgttcaatcttcttacaacaaataatggtacacatggggaaaaataatggcttgcatcctggcgctggagaccaaataatgtaaaatcctgaaaaaacaaggctgtctgtctgtcgcaaaaaaaggggatcctgaaacgtaattcgcatctacacaaactccggtgaagcaaaagcaaattgctcgcaagtcgttcacagcatttggtgctccttattgtttacacggtggccatacacaacgtttcttctttcttttacctagcctcgtcttctaggttgcggaacccggcggtaaggtcgtcgtataacttctggaatttcgcgacaaggacgtcttcgccttctgcagggtcttcgaacttttgggatacaaggcggtaaaatagatcacccatgcgactctttacgacggcgtaggttatcttgtgtccatcagcattggctgctcgctccacagcctgattcgct

SEQ ID NO: 5675 - DNA, 546 bp, Hordeum vulgare
gtcccccgggctgcaggagaaactcgagaagcggcttgggcctgagaagatgaagatttgggacgaggcgttcgatgaggcagcagatgaggcactgccacacccgatgaatgatgcgcttctcgacgccattcataccaataacatgattgagtttgagccagagtacaatgtgagctttggtaatcctgatattgaggagaagccgccaatgtcattggaggagatgctgcagaaagtaaagccattcatagttgcttatgaaggcatccagaaccaggaagaatgggaggaagccgtgaaagatgtcatggaaagggcaccccatatgaaagagctgatagatatgtacagtgggcctgatgtcgtaactgcaatacaacaagaaggggagctgcaaagagttgccaacactcttccagaaaacatacccaattcagtaaagcggtttactgataaaactttactctctctcaagaataatcctggctggggttttgacaggaagtgtcaattcatggacaagtttgtccgtgaagtttcaga

SEQ ID NO: 5676 - DNA, 518 bp, Hordeum vulgare
tagacgctccaaagaggtaagggagtttcgattgtcataaacaaatggcgatcgacatttctagaatacagcggcgagaagaaaatctcccaaaagaaatattgatgtttcccagtgattttatttgtctaactaacatctcaatagaaggaagacgtgctgcatgggttgaatataacatcacaccttctctcgaaacaaggaaaatccgctaaatcttcttaggggctaaatgagatcttacaacagtgtataagaaggcttttacttgtactgttctgaaacttcacggacaaacttgtccatgaattgacacttcctgtcaaaaccccagccaggattattcttgagagagagtaaagttttatcagtaaaccgctttactgaattgggtatgttttctggaagagtgttggcaactctttgcagctccccttcttgttgtattgcagttacgacatcaggcccactgtacatatctatcagctctttcatatggggtgccctttccatgacat

SEQ ID NO: 5677 - DNA, 517 bp, Hordeum vulgare
gttatcccatatgtcatccttgctgagaagttgggacgtctcgccgtgcaactagtggctggtggcagtgggatcaaggcagtcaaggttgtctactcatcggctagagacccggatgacttggacacaagaattctccgtgccatggtcacgaaaggcatcgtcgaacccatttcaagtgcatttgttaacatggtgaatgctgactatgttgccaagcaaagagggctccggataatcgaggagcggattctcctcgacggctcccctgaggtccctataaactctatccaggtccagcttgccaatgtggagtccaagttcgccggtgcgttatctgacgacggtgatatcagagtggaggggaaggttaaggatggcacgccgcatctcacacttgtcgggcctttcagtgtcgatgttagccttgagggcaacctgatactctgccggcaagtcgaccagccgggcatcatcggcaaggtgggatcgattctcgggacgatgaacctgaatg

SEQ ID NO: 5678 - DNA, 545 bp, Hordeum vulgare
  UNSURE (16),(32),(51): n stands for any base
gaatggatctgcttgntccaggtgggctgaanagacatcattctacacagnaaactaaataagctttgcaaaaatcactcatcatactagtaaagcaggagatgttacaaacaaatcaacctacatttctctaaagcttaagaaagacaaactcctgcaccgatggcgtttccccgatcaacttgagtgcttccttctcaggctcctcatcaatcccaatggccatgatggcctgcttccctggagcaatccttccaacgctcataaagttgacattcaggttcatcgtcccgagaatcgatcccaccttgccgatgatgcccggctggtcgacttgccggcagagtatcaggttgccctcaaggctaacatcgacactgaaaggcccgacaagtgtgagatgcggcgtgccatccttaaccttcccctccactctgatatcaccgtcgtcagataacgcaccggcgaacttggactccacattggcaagctggacctggatagagtttatagggacctcaggggagccgtcgaggagaatccgc

SEQ ID NO: 5679 - DNA, 414 bp, Hordeum vulgare
  UNSURE (341): n stands for any base
ttgtgcgttgcgtgccgccctccctccctccatccatcccttctgctctgctcgtgctcgtgctcgtgctcgtgctcgcgctcgctagctactcccgccgctggtcttcgcccacccctctcccctccccggcggcgaggccattgcctcgctcgccgtccgcccgccggatccgccccggccgcctcctcctcctcccgcacagtctccgatcgtgctcccgccccgcgcgcgcgcgttccggggagcgggctcgcgacgaaggcggcgcgtcggatggtgtgaactctcgggcggagatgacgaggcgggctccggcgcgcggcgggggcgggggcggngccggccgggtcctgctggtcctgcttctgctggtcgcggccgccgcattggcgcgcgcggtcaccgacgcct

SEQ ID NO: 5680 - DNA, 385 bp, Hordeum vulgare
ttttttttttttttttttttgacgttagatccatccgttcttattttacaggggtatattacaccggtgtattggtcatcaaaccgacgaaccagacggggccttagtagtaacaacatagatagacagaaggatgctagaaactgtatctagaaggccagaacatacagagaatgactacgcctttgagccatcccatgggaattcaagaagctagttcatttgttccagagggctacataggaaattttcctgtagggttctctactccttccgacattcccccaaattccttcacccaagatgatcttggcattgcagtagcagttttacatccagttcctgaacattccccatctctacattttccctgcttcctgcatcc

SEQ ID NO: 5681 - DNA, 520 bp, Hordeum vulgare
ctgccgggttccagcgaaaacccaccgcacccttccccagcgaagcagcagcgtcccatggcccccaaggcggagaagaagccggtggcggagaagactccggcggcggagaagaccacggcggggaagaagcccaaggccgagaagcggccgccgaagtccaaggagggcggcgagaagaagggcaagaagaagtccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgagtcagccaagctggcacgctacaacaagaagcccaccatcacgtccagggagatccagacctccgtccgcctcgtcctccccggggagctcgccaagcacgccgtctccgagggcaccaaggccgtcaccaagttcacctccgcttaggctaggctgttcttgccgctgtgtaacgtgtgctggt

SEQ ID NO: 5682 - DNA, 534 bp, Hordeum vulgare
aacatctttgcaaagttcagagtcgttttctgcagagttttacagaaggggttatcacaacagagcaagaactctgcaaagtgaagcgacaggggtaagaactgaacatcaaagactgaaagaaacaccattactatttcacgagataatgaaacagtgtgttgcgacataaccagcacacgttacacagcggcaagaacagcctagcctaagcggaggtgaacttggtgacggccttggtgccctcggagacggcgtgcttggcgagctccccggggaggacgaggcggacggaggtctggatctccctggacgtgatggtgggcttcttgttgtagcgtgccagcttggctgactcgccggcgagcttctcgaagatgtcgttgatgaaggagttcatgatggacatggccttggaggagatgccgatgtccgggtgcacctgcttcagcaccttgaagatgtagatcttgtacgtctccacgctcttcttggacttcttcttgcccttcttctcgccgccctccttggact

SEQ ID NO: 5683 - DNA, 517 bp, Hordeum vulgare
caggtgtcagctcaacactgtgcacatatcctctggaactgatcaagacccgtctgactatagagaaagatgtatatgacaacttcctccactgtctcgtcaagattgtacgagaggaaggcccctcagagctttaccgtggtctaacaccgagtctgataggagtggtgccatatgccgcaaccaactactatgcctacgacaccctgaggaagctctacaggaagacattcaatcaggaggagatcagcaaccttgcaaccctcctgatcggttcggccgcaggcgccatctcgagcactgccaccttccctctcgaagtagctcgcaagcagatgcaggcaggggcggtgggcggaaggcaggtctacaagaacgtgttccatgccctctactgcatcatggagaaggaagggatcagcggtctgtacaaggggctcgggcccagctgcatcaagctcatgcccgcggcggggatctccttcatgtgctatgaggcctgcaagaagatcctggt

SEQ ID NO: 5684 - DNA, 552 bp, Hordeum vulgare
gcaatattaatccatatatttcaaccacaacagtgacaagaaatcaggatatcgaactgcctgtcgcagaactgcaaagatcggcgagccgttgtctgcaaagattaaccaagatctggtgacataaagggagaaacagggctagcacagaagcaaaagtagcatgacaaaactgcttccgccagtcagaatactgtttaatggacttcaactcgagcacagaactaattagaggccaaaacttcatcatctaacagacatctcaaatgggaaatctttgacctaggcttctgatgagtagttgatcatccaatcttcttttcttgatagaaagaaagacgaggcttaatcctgccgcctcttcttgaaggactcggcgcatgcttcagtctactcctcggcttcgaccaggatcttcttgcaggcctcatagcacatgaaggagatccccgccgcgggcatgagcttgatgcagctgggcccgagccccttgtacagaccgctgatcccttccttctccatgatgcagtagagggcatggaacacgttctt

SEQ ID NO: 5685 - DNA, 516 bp, Hordeum vulgare
cctcaatggtgtcgcggatcagtattccctgccgccacctcgaacttcctcagactcgccgtccgtcgtcaactccaactatttccccatcaccgtcgcccacactttcctctgccttcaacatcgtcggcgtccccgtgaaacccgcctcacgctcccccatcgtcctcgccctgctagtcgtctctagccttcccgatggagaagtcgggatgcctcgttaggactcgtacacacatagacgaaactcctacaatagtagacatcatcacgagggtggctgattacacggatatcatggtcgcctatgccaatagcgctcgagcagccaccgagaccgctggagcatacaccatgagtgcaagagcagccgctgagagcactagtactgccattgagagtgcgggagaagccgttgaatacgcgaggacttccgaagccgagatcacgaagatgttggaaggtgaggagagctcattatggagctgggcttttacttgtgaacaagtagtgcac

SEQ ID NO: 5686 - DNA, 552 bp, Hordeum vulgare
gcatcgtagaaaatacattagaatactcgacgatacaaataacataaaggcgcttcataagttgttcaaaagcaaaatttcagctccatcatagcaacatagaaattaagttcacaagcatcaaccatatagatcacataaagaaagtgcactacttgttcacaagtaaaagcccagctccataatgagctctcctcaccttccaacatcttcgtgatctcggcttcggaagtcctcgcgtattcaacggcttctcccgcactctcaatggcagtactagtgctctcagcggctgctcttgcactcatggtgtatgctccagcggtctcggtggctgctcgagcgctattggcataggcgaccatgatatccgtgtaatcagccaccctcgtgatgatgtctactattgtaggagtttcgtctatgtgtgtacgagtcctaacgaggcatcccgacttctccatcgggaaggctagagacgactagcagggcgaggacgatgggggagcgtgaggcgggtttcacggggacgccgacgatgttgaaggcaga

SEQ ID NO: 5687 - DNA, 421 bp, Hordeum vulgare
gaggtggacctgctgaacaacccggacctggtggcgtcggacccgacggtggcgttcaagacggcgatttggttctggatgacgacgcagtccaacaagccgtcgtgccacgacgtgatcacggtgttgtggaggccgacggccagggacagcgcggccggacgggtacccggatacggcgtgatcaccaacgtcatcaatggcgggatcgaatgcggcaaggggcagaacgacaaggtggccgaccggatcgggttctacaagcgctactgtgacatcttcggcatcggctacgggaataacctcgactgctacaaccaattgtcgttcaacatcgggctcgcggtgcagtgagatcataagattgggtcctcggtttatgcatgtgcgtgtgtggatgtgatgatcacccacaaataaa

SEQ ID NO: 5688 - DNA, 551 bp, Hordeum vulgare
gtcagtcctctgcataaacgaggatatgtttataataaaaggtggcgacacttcctttcctgtccgtgcatcgacatacatgtactatatactccattacagatgtctggaaggtctggacatccatttatttggtcataaaatacttaccaagattatttatttgtgggtgatcatcacatccacacacgcacatgcataaaccgaggacccaatcttatgatctcactgcaccgcgagcccgatgttgaacgacaattggttgtagcagtcgaggttattcccgtagccgatgccgaagatgtcacagtagcgcttgtagaacccgatccggtcggccaccttgtcgttctgccccttgccgcattcgatcccgccattgatgacgttggtgatcacgccgtatccgggtacccgtccggccgcgctgtccctggccgtcggcctccacaaccccgtgatcacgtcgtggcacgacggcttgttggactgcgtcgtcatccagaaccaaatcgccgtcttgaacgccaccgtcgggtccgacgccacca

SEQ ID NO: 5689 - DNA, 520 bp, Hordeum vulgare
  UNSURE (10): n stands for any base
gggataacgntctcctcgacatgataaacaatgccgtcatctctgtctcgatcgggccaccaagttcacgctttctaccttcgaaagacaagaccacttgggctgcaaaagatgtcgctgattgcgttttgtctgacaaatcttccttgaaggtaacggcaagccagcgaaaggcagagagttctgtccttgatgcacacactgcagatgttgatggagagccatactggtattatgaatatattgttcggaaatcaccaacaaaatcggcaccagaaccaaatctgtttcggcacagtgtagcatgtactgctgagcgagacggctttttgtactcgttaaatgcctccactctcagcaagcagtgggaatctatgggacctttgctacaaaaggctgtggcatcctttcacctcctccccccaacagagaaatatgttcctccttaccaggatccgtggaggttttggtgatgtgacccttcttcgcgcatttttggcgatccaatgacttaatgttt

SEQ ID NO: 5690 - DNA, 544 bp, Hordeum vulgare
ctaaaatggttgttgtattgtttattttaatcgggtacgtttgacacttaatactaaaaacaatcaacttgtagtagattggcaaaaaaaactaaagtatctagatttcgtttcttacttccgtagacctgaaagtgctaccgaagcatctattacaagaaacatggtgtaaaacattaagtcattggatcgccaaaaatgcgcgaagaagggtcacatcaccaaaacctccacggatcctggtaaggaggaacatatttctctgttggggggaggaggtgaaaggatgccacagccttttgtagcaaaggtcccatagattcccactgcttgctgagagtggaggcatttaacgagtacaaaaagccgtctcgctcagcagtacatgctacactgtgccgaaacagatttggttctggtgccgattttgttggtgatttccgaacaatatattcataataccagtatggctctccatcaacatctgcagtgtgtgcatcaaggacagaactctctgcctttcgctggcttgccgttaccttca

SEQ ID NO: 5691 - DNA, 519 bp, Hordeum vulgare
gcagcgcaaaatcatcgaagaattgccgcaagcccgcccgtacctttcgccgtctctcttcgtgcgcagcgcattttctccgacggcggtgttcttcaccattgactgtgggaaaggaggggagggcaccttggaagagattgtgcatggtcatcttgcgtcagttgtgaaggggattcttcagatctggcttgatacttgcgccagtgacgcctcagaaatggaagagggcgagcgagagatcatggtcaagagggaccgaactgtaagatcaaaatcgattgaggttgacctgaccgcgaatttgccgaggatgtttggccccgacgtgtccggacgcatcatcgctgaaattcgtaaggcctttggggtacaagaggcctaggattcagaagtacaaatgtgactttagattacaaaccaatgggaatgtaaataattatttggtggaaaacgtttctaatttgcagtacatcttgtcagactcgctgaactgaatgctgtgaaaaaaaaaaaaaa

SEQ ID NO: 5692 - DNA, 500 bp, Hordeum vulgare
gcattcaagttcgcgagtctgacagatgtactgcaaattagaaacgttttccaccaaataattatttacattcccattggtttgtaatctaaagtcacatttgtacttctgaatcctaggcctcttgtaccccaaaggccttacgaatttcagcgatgatgcgtccggacacgtcggggccaaacatcctcggcaaattcgcggtcaggtcaacctcaatcgattttgatcttacagttcggtccctcttgaccatgatctctcgctcgccctcttccatttctgaggcgtcactggcgcaagtatcaagccagatctgaagaatccccttcacaactgacgcaagatgaccatgcacaatctcttccaaggtgccctcccctcctttcccacagtcaatggtgaagaacaccgccgtcggagaaaatgcgctgcgcacgaagagagacggcgaaaggtacgggcgggcttgcggcaattcttcgatgattttgcgctgc

SEQ ID NO: 5693 - DNA, 551 bp, Hordeum vulgare
gtccccccgggtctgcaggcaattcggcacgagggagaactacggcacttggagataaaataaaccagtttactggcatgatagaagggttgatctggtctccgagaggcagtgattcaaatgatagacatgatgattgggcttttgaggagggacctcactctgattttagcgggccaacctgcgggagtacagcctgtgttgcaatggtaaggaatagtcaacttgttgtggcaaacgccggagattcccgctgtgttatctcaaggaatggccaggcatacaatttatcaagagaccacaaaccagagcttgaagcagagagagaacggatactgaaagcaggggggtacatccaaatggggcgagtaaatggaactataaacttgtcaagagcaattggagatatggaatttaaacagaataaattcttgtctcctgataagcaaatgttgacagcaaaccctgacgtaaacactgtcgagctttgtgatgatgatgattttcttgttttagcatgtgatggcatttgggactgcatgtcgagccaa

SEQ ID NO: 5694 - DNA, 536 bp, Hordeum vulgare
gtacatcacaccatgattcagaagtcattgtttagtacacaggtttaccaggttacgtcatgacatcacatcacgagttcttctcctcgttcgcgctggtcacagaagtacaggttagtgtaggaaggctgacaacgaggaaaaatgatgacaacaacagagttgagtggaatagaaaaagagatgacaaagaaaaaaaatggcaactaaagcagactcacgactgttctatgtcaccaggcgattgtccaccagcactagaattcttgtccttgagagctgattgttcactagaactggcactcttatcggcagtagctgattgttcaccagcactggcatccttatcctccacagccaatttttcaccagcactggcatttttgccatggtcaattggcttcttgaactgcacaaggatcatcgtcatgttgtcgcatccttctccacctaatgttgatggagccaggcatctatcgagcaccttttcacacactgcagaaaggctactctctgtctttaagtgttcatggatg

SEQ ID NO: 5695 - DNA, 445 bp, Hordeum vulgare
cggagttacaccactagacccaatctaaaccaataggggagctctcgttgcctgatcgctgacccatcgtccaattgaccgcagcggcagttccacaccgtcaaggtgctgccagccaccgccgttttattgcctttgattcggctgtgcgcgtgggctgggaaccgtgctctgttgtctgatgcgtcgttggagcgggaggtttggtcggtcgaggccaggtatgagcagctcctgagctggctggatggatggatgcaggtcatgtgtcgtgaaccaacaccaggacacctcttttggaacggagggagtatattttggaacggagggagtatgtatgtacgtatggatatcatggtcatgttgcttgggggttcaacctcttttttggataaagaagaggggcgatgcccataattatgactggctgaaataatcatgtctt

SEQ ID NO: 5696 - DNA, 532 bp, Hordeum vulgare
ctcttaattgagggctcagttttgcctttcatcttaaagcccaacactcaatagcttgctgcataatctacccatcgcgatgtaagaggactgtcctggttatcattcatcagaatgaccgtccaaggcacagaacatccaacattagctatgaattgaattgctgcaagagaggtaagggtgcgctctaatttagtagccacaggccacagctgtcttaattgctcaagacatgcttatttcagccagggtcatcatcatcgcccctggtaagaactccatctcttcatcacacagtagcatccatccatctatccatcagactggtcatagtggtgagtaacttagacaatctcaggagctgctcatgcccggcgtcagctgaccaaacctccggctcgtatgacacatcagacaacactgtacggttcccagcccacgccacaaccaaatccaaggcacaatggaatggcggtggctggcagcaccgtagattcgaggaactgatgttgcagccccccagacagacgac

SEQ ID NO: 5697 - DNA, 484 bp, Hordeum vulgare
atacttctatggtgcgttggcagcagcccacaagcgtaatggggtgccagcattgatcgctgaggtcaagaaggcatcaccaagtcggggcgtactaagggagaacttcgatcctgttgaaattgctcaggcttatgaaaagcatggagctgcgtgcttgagcatcttgactgatgagaaatacttccagggaagtttcgagaatcttcagaaggtgcgcaaagcaggagtgaagtgcccccttctgtgcaaagagttcgtcgttgataaatggcagatctattatgcccgtgtgatgggtgctgatgcagttctgttaattgccgctgtgctaactgatcttgacataaaatactttctacggatatgcaaggagttgggattgacagctcttattgaggttcatgatgaaagagagatggagcgtgtcctcgcaataaatggtgttcagcttattggcatcaacaaccgtagccttgagaca

SEQ ID NO: 5698 - DNA, 543 bp, Hordeum vulgare
tggtagaatttattcccataaataaagaataaacatatatcgtttattatcccgcataaccaaaagaaaacaagagaccattattattcaaaattcaaatcatgcggtggtctcgcaactactactactagtctaccacaaacaagtctgatctagttgtttcagtgcaccagttctttcccgaagagtccggcgatggcgagccctgggtctgcttgcttcaccaaggattctcctaccaagacagcagaaactccggcattctgcacataagcaacatcatctgggttgaatagcccagattcaccgacaaccaatattcctttctccctgatggcatcgccatgcttctccagcaacgtcttcgtgttcgaagtatccactataaatgtctcaaggctacggttgttgatgccaataagctgaacaccatttattgcgaggacacgctccatctctctttcatcatgaacctcaataagagctgtcaatcccaactccttgcatatccgtagaaagtattttatgtcaagatcagttagc

SEQ ID NO: 5699 - DNA, 552 bp, Hordeum vulgare
gtcctcccgggcctgcaggcaattcggcacgaggatagacacagcaccttttgcaacctcctcggcaaatgttgaaccccagtatgcgcctaccccagaacctgctttgccaccgcaggctgcagtgcctggagatgctgctgatccatctgggtttgccctgccattatttggaaattcatggtcagatccatgcatcgagttcgcattcaagaccctcacaggcgacatccctgttctgaatccaactgtcgcggactactttcctcttcagcaagacctgaataaagtcgcaccaccagattactctgatccctctgtcgacgatactagaaaccatacacatgtcaatcaaagcagccaccactcggccccaaggccatcaaatgagttctacaatggtggctggttccctcctcagtgacgccctggaaggctgaatggacgaaccgcttgtgctcgcaaaaaggctgatgttccgctcgtacttgcaaaaaggctgatgttccgcttgtacttgcaaaaaggctgatgttcagagaggaatgccca

SEQ ID NO: 5700 - DNA, 549 bp, Hordeum vulgare
  UNSURE (8),(23),(25),(38),(46): n stands for any base
acaccaanattggtattccaagnanaccatttattatnccacatantcggaaacacttgcaaagatagttaaactatggtgcttgcaacggtgtgttagcgagtccgccctgatgatacatcaaatgagatttaccgggcgaactacacagaaaggaagaaaaataaaacagaaaacaaaaaacacagctagatcatctacaacggcattcacgtctacgaagccatcctgatcctatggcaagaggcatccggtgggatgtacacactgtctaacaaagttagagaaagctacaggcctttgcaaaatatatcgcagaaggatcacaaaaacgcaagagcgcaagcaagactactgcttcgagctcgatcacttgggcattcctctctgaacatcagcctttttgcaagtacaagcggaacatcagcctttttgcaagtacgagcggaacatcagcctttttgcgagcacaagcggttcgtccattcagccttccagggcgtcactgaggagggaaccagccaccattgtagaactcatttgatggcc

SEQ ID NO: 5701 - DNA, 537 bp, Hordeum vulgare
ccgggcctgcaggcaattcggcacgagggttctcagagttgttttatggtcgtcacttcaatgttatcgggcataaattctgtgttctatttctcatcaactgtgttcagaagtgtgggggtgccctctagccttgctaatatatgcatggggattgcaaatttatcaggttctattgttgctatgcttctaatggacaaactaggcagaaaaatgcttcttgcaggaagcttctttttcatggccttctcaatgggacttcaggctattggagcgaatcgtcaccttggttctgcaagtgtgtatctttcagttggtggcatactgctgtttgtcttggcattttcgttgggagcaggcccagttccaggacttcttttgcctgagattttcccgaacaaaattcgagccaaagccatggctctgtgtatgtcagtgcattggggcgttaacttcttcgttagtttgttattcttgcgacttttggagcaacttggcccacaagtcctgtacacaatgttctcatcagcgtgcgtg

SEQ ID NO: 5702 - DNA, 560 bp, Hordeum vulgare
  UNSURE (64): n stands for any base
gtgtaacctgtttcgacagtggttcgttgatcagtatccaaaaatccagtctgcgccttactgntctgaccaacagttaagcacaagacaacacaatatagtacatagggccaactatcagcctatacagaccaaaaaacctccacaccagtctgtcatgtatgtgtgtatgtattcctaggatagtatgccgctgctctggcggtcacgcaccggcagcaggaacttgcaccgagcgttagggccattctgtccgcaaaagatgatcagatcacttgatctgggaatagacggcccgcgcagctggtgttcagcaacaaaacgtcgctcatcccttctcatcgtgcagaacaaggcactgcctcggtggaacctttattgtgtctgtaacagtgaaacttctatctcctgcaaagtttttccctttgtttcgacaacatgtcgccgcacaaatattgctcctaccacgcacgctgatgagaacattgtgtacaggacttgtgggccaagttgctccaaaagtcgcaagaataacaaactaacgaagaagttaacgcccc

SEQ ID NO: 5703 - DNA, 984 bp, Hordeum vulgare
  UNSURE (45),(73),(82),(93),(100),(149),(152),(159),(162),(205),(257),(984): n stands for any base
tagtgcccccggaatcgtgcaggcattccggacacgtgggcttgnattgctgggccgcctcgtgctcggtggnatggcaggncgatacgacgnatgcggnagcgccgctaggaaggagggaacaccgccggctggtaggaacatgcacnctnggtaggnatnctgggtaacccttcgcccagggaagaaagaaaggcaggtttgnagggattgccccaaaccggtttaaaaaacgggtcggcctggggaggaacagnaagaaagcccaccgaaaacttggattggcttaccttggcagggaaaatggtttttggaaaggatacttcttttttttaaaggggaaaaaaaaaggggaaaggggttttccttgggaaaatccccattttgggggccccttttggggggacacggctttaattttggggaaaccaccccctttgggaattcgggggcccccgttggcccaagccttttaccccacgagggtttttttaccacccccccttttttttagggccccccttgtttcgggggggggagaaaaccactgggggatttttttcgcgggggatataaaaaaaaaccctttgggggggggggggtggaaaaaaatttgttttggggagacactctttttttataaaaaaaaaataagaaatcctcccctccccgcgcgggagaaaaaacaccgcccgggggggttgtttattttttttttggtggggggggggggatatttttattcccccccccctttttaattatataataggggttttttttttttgtggacccccgaaaaaaaaacatatgttttcccccaaacacgcctcttcttttttttttttttttttttgggggaagagagagggagggaggggtgccccccttttttttttttttttatccccccccccttttcctttttggtgtaagaaataaaaaaaaaaattttttttttctataaacaaaaataacaccccn

SEQ ID NO: 5704 - DNA, 540 bp, Hordeum vulgare
tagtatatatttgctatattcgtatattgttcggtcctctcatcgtataaagaaaaaaggcaaaaatatatgtctatgtgtcacttcgtcggtatgccgagcgtcttcagagtaggggtcaggtcgtcggtgctgcagccctcgaccccgatgatgttcgagcaatcgagcgcgatgacgtcttgcagcgggtaccgcctgaccgtgtggattctgtttgcgggtgtgttgaactcgcccttcaggacgatcgtcttgtgaaggcctccaaacagctcttcgtaatctgaatcgccgctttcaccgacaagaatcacgacgtttcgcaactctatgccccaacgaacagacaggtaccttagagcctggtagcgtgatgcatgaattggaattacagatagcctggtagcactgtggttataaagagcatgacagcgtagtgactggattctcatcaacttctgcagctccttcaaaggaggtaaataatttggattgaccactctaaacgcaaggcaagatgttgaggagtgttctgca

SEQ ID NO: 5705 - DNA, 548 bp, Hordeum vulgare
gtcccccggctgcagcattcggcaccaggccttcccccactccaatctaacccggcgaccccgcgactccggccggccatgtcgatcttcgagtacaacggctccgccgtggtggcgatggtggggaagaactgcttcgccatcgccagcgaccgccgcctcggcgtgcagctgcagaccgtcgccaccgacttccagcgggtcttcaagatccacggcaagctctacatcggcctctccggcctcgcctccgacgcccagacgctgtaccagcggctcgtgttcaagcacaagctgtaccagctgcgggaggagcgcgacatgaagcccgagaccttcgccagcctcgtctcctccatgctctacgagaagagatttgggccgtacttctgccagcctattattgctggacttggacaggatgacgagccatttatttgtaccatggactgcattggtgcaaaggaacttgctaaggattttgttgtctcagggacagcatcagagtctctatatggtgcctgtgaatccatgtacaaaccgaacat

SEQ ID NO: 5706 - DNA, 551 bp, Hordeum vulgare
ggtaatgatgatttgatatgtctcaccacgatggagatgtctcaccattcacttcatcatataaaaaggatataaagtaaaagaaaacaaatgtctcttctacggataaatatcatcgatttttgacagtacaaggttgcttcggaactggggcacaacagggatgtcgaaacagcaagcgtagaagcatatccggaagcggctcaagaactctaggccatacataatctagtccatcctgcccttgagcactcgctcttgaacttcggtcgctgtcacaatcagaacatagcctccccacccactgaggcagtcgcgatcaactgatgacaacagagcttgtgatatggtctcaaagagttcctcaggttccatgttcggtttgtacatggattcacaggcaccatatagagactctgatgctgtccctgagacaacaaaatccttagcaagttcctttgcaccaatgcagtccatggtacaaataaatggctcgtcatcctgtccaagtccagcaataataggctggcagaagtacggcccaaatctct

SEQ ID NO: 5707 - DNA, 519 bp, Hordeum vulgare
caacaccaacctgccgcagatagccatcagccaagtaacagtggccctgaatgggtcgatctttttgtgagagagatgtcaaatgcttctgacatggacgatgcacgggcccgtgcatcaagagctctggaagccttgacgaagtccatactggagggtgcaggagctgaagcagcgcagagcttgcatcaggagaacatgatgctcaaggagcagatgacggccgtcctgtcgcagaacgcggtcctgaagcgcgcggtggcaatccagcatgagcgacagaaggagttcgacgagcgcagccacgaggtgcagggcctgaagcagctcgtcctgcagtaccaggagcagctgaggactcttgagatcaacaactacgcgctgcagatgcatctgaagcaggcccagcagagcagctccatgcccgggcgctacaacccggacgtcttctagtttggcttcaggctgatgttgatgagccctggcccttggggattgagagttgagactagtggtact

SEQ ID NO: 5708 - DNA, 518 bp, Hordeum vulgare
aaagaatctggattgttttgtgtatatattaaatacgaaaacgtttaaacgcaacaggtttgaaccaacatatcatctacatgggagccttgcgccccatcccacggccaacaggtggtcagcaaaccaacatccacccaactagtctgaatcccaggcaacaacattttctagtcatcttcaccatcatacggcagagtaccactagtctcaactctcaatccccaagggccagggctcatcaacatcagcctgaagccaaactagaagacgtccgggttgtagcgcccgggcatggagctgctctgctgggcctgcttcagatgcatctgcagcgcgtagttgttgatctcaagagtcctcagctgctcctggtactgcaggacgagctgcttcaggccctgcacctcgtggctgcgctcgtcgaactccttctgtcgctcatgctggattgccaccgcgcgcttcaggaccgcgttctgcgacaggacggccgtcatctgctccttgagcatcat

SEQ ID NO: 5709 - DNA, 406 bp, Hordeum vulgare
ccggcgtcgtgccggccgtgcacgccgccgccgtcaactggcacgagccgcgccggaacgtcacgctggcatacgagggcgccatggccgcctcctacctcgtcggcaccgccttctacctcacccgcgtgcccgagcggtggaggcccgggatgttcgacctctgcgggcagagccaccagatcttccacctgcttgtcatcgccggcgcgctcgcgcactacggcgccgccatcgtgttcctccgggtccgcgacgagatgggctgcccggccaactgataccgatgcgcatgcatgccgtcgttcacagtaccatcagattcttagtagttaatggagaccctctgcatccatccggggatggacacaacccgattattgccatcgaaatggcattttaccgt

SEQ ID NO: 5710 - DNA, 396 bp, Hordeum vulgare
tgccatttcgatggcataatcgggttgtgtccatccccggatggatgcagagggtctccattaactactaagaatctgatggtactgtgaacgacggcatgcatgcgcatcggtatcagttggccgggcagcccatctcgtcgcggacccggaggaacacgatggcggcgccgtagtgcgcgagcgcgccggcgatgacaagcaggtggaagatctggtggctctgcccgcagaggtcgaacatcccgggcctccaccgctcgggcacgcgggtgaggtagaaggcggtgccgacgaggtaggaggcggccatggcgccctcgtatgccagcgtgacgttccggcgcggctcgtgccagttgacggcggcggcgtgcacggccggcacgacgccgg

SEQ ID NO: 5711 - DNA, 424 bp, Hordeum vulgare
gacggcacagcaggcggaggagaagagaaagctctcgtgctcgcgcgacgacgacgacggcgacctcggccgcggcgacgatgagccccatccgcgccctcatcgtcctcgccgccgtcctggcggcgtgcctcggccccgcggcagcggcggaccagcccggatccggcgagggacacaccatcgccggccgcatcaggatcgaagctgcaaggggctttggtcttccagccaagacatcaaacacgaaagtgatacttaatggtggtcagaaagttacgttcgccaggccagacggctactttgcttttcacaacgtgcctgctgggactcatttgatcgaagtttcctcacttggctacttcttctcaccagttcgagtggacatcagtgccaggaatcctgggcatattcaagcagcatt

SEQ ID NO: 5712 - DNA, 392 bp, Hordeum vulgare
tttttttttttttttttttgacacactgacctcgatgtaagctataaatactggttgacttcttcagccaggtgtttcagaaggttctccattacaaacctattacatcttacaacacattaaaagtgggtaaaagagtttacaccttgtcccagtctcccagagaaaaaaataatctgactcgagcatgaagcagtttatagtacacttaaacaacatattgttcccatgttctacatctagctgtttgccctggctagcaagccagaaaaggatgcaggtgagttcctcatttgttcttgagcttgctttatctcctccggatctatgatctccatcatcttgggcataacaaagaccattacgaccataaaaccgaccatcatacccat

SEQ ID NO: 5713 - DNA, 548 bp, Hordeum vulgare
ccgggctgaggaattcgtacgagggccggggttgtctgcgtcacctccggcggcaccacggtgcccctggagcagcgctgcgtgcgctacatcgacaacttcagctccggccagcgcggggccgcgtccaccgagtatttcctcaaggctggttacgccgtcgtcttcgtccatcgccgcgggagcaagcagccttactgcaggtttctcccggaggactcgtttctcgaccttttcgagctcggcgaaggatcagagatccaagtcccagagtctcacacagcagtggtcaagacagcgattagcagttatcgcaaggcaattgacgaaggtctacttctgaaacttcctttcactacgatttttgagtaccttcagttactgcagcttgtatccactgctatgaattgcttggagcgccatggaatgttttattttgctgctgcagtgtctgacttctatgttccatgggagagtatggctaaacataaaatccagtcagcaggtggccctttaaacatgcagctcaatcaagttcctaagatgct

SEQ ID NO: 5714 - DNA, 552 bp, Hordeum vulgare
gtaacatttactatagaattggttggacactaatggtgatgatccctgtgtgcatttgaaggtgctgtatgcagtcccggcaaaggagccttggatttcgttggtcgaatttggttcactcactcacaatagtacatttcagatttggagtttgaattggcgagacttgtccaatccaaaccaccgcccacgccgataaaggcaggcatctcatctggcgtagcataacataagtgataagggaggtgatcgcacgtgcgattctcaaaaggaaatgctactctgcttgccggtacgttaactaaaccaggagaccaatgagctcaataacttgtagcagctccttattcgtcatcattaagacaacagctcaagtttcctggtccggattggactgcttagcgtgatctgaatgcatcttaaccaggagaccgatgagctgctcttctaggtcgtcttccttgctccgcctgctcacggttgtcttcccgctgcttgtgaccatgacaactacgtccttgtagttcgctagctcgttcgccaccaccacat

SEQ ID NO: 5715 - DNA, 95 bp, Hordeum vulgare
tctctctctctctctctctctctctctctctctctcctcgcgccgaattcgatatcaagcttatcgataccgtcgacctcgagtttttttttttt

SEQ ID NO: 5716 - DNA, 522 bp, Hordeum vulgare
cctcccatatatccagctcactatattatcctcccatggatttttatgccaacaaacaataatacaacaccatgacagtgccgcctccacgacgccgaaaccagagggggcaggaggacagtgtgagacctctcctcctgctgttactctggcagtatactcatcataccaactctcatcaggccgcatataactagggggagctaattcacaagggtatatacaccggtgcttctatctgtccagcagccagttgaggaccgtctttttcgggacgactccatcggcgtcctctttctccggcttcgcggaggtatttacagcgctgcggatgaccgagttgaggcgcatcctcagctgcgcattgtcgatgagcaggtcggacagcatcttcgttgtctcttcgtcggtgaggctcacgtcttcgctgcccatggtaattgaggatttaccatcggaattttcgccatcatcagaagagcccccctgttcgtcgtccagtgctagatgctgagcctgagc

SEQ ID NO: 5717 - DNA, 522 bp, Hordeum vulgare
accgggttttgtcaagtcacgatcgagctatagccactactcccaccgtacgctggtcacctggagatgtggaggctgaaggtgtcggagggcggcagcccgtggctgcgttccccgagtagcttcctcggtagagcggtgtgggagtttgatcctgagctcggtacgccggaggaacgcgcagaggttgagaggttgcgccgagactacacgcggtgccgtttcgagaagagggagtcacaggatcttcttatgcgcatgcagtatgcaaaattaaacccccttccggcaattgtcccaaaagtgcatctcgacgataatgcagaagtcacagaagaaataatatcagcatccctgaggcaggccctaaatcagtattgcacgctacaagcgcatgatggtcattggcctggtgacaatagtggaattatgttccttatgcctatgtttatattctctttatatgttaccgaaaatcttcacagcgtcatatcatcagaccatcaacgtgagatatgccgt

SEQ ID NO: 5718 - DNA, 545 bp, Hordeum vulgare
ttcttaacaattgatttattggacacataatatactttgaaacattccaaaaccatagagtcatcaacaaaatagatagctatgtttatcttcatcgactttgattttcaataagacgacgacgaaactctcctagagccattatagggaaaatattgcggtagttgggatagttaaagaaaaaggcggagttagcacatcccatgtgttcctgttggggaaactctcccgagtctagctgcatattcatcaatagttttgccgcacgatatagtggcactggatatatttcagcctggccagcataaatcaatgcaagcattgcccatgcagtggccactgcatgagaactaccgctgtccacatactcctcggtttcaatggaaagatagctttcgccccatccacctgtactctgttgtttggacaataaaaattcacatgatttcctcatacaatcactattatcataagtccttcccgaagcagctaaacctttcaccgcaaagaaggccccgtaagtgaaacaaataccccaagtgcca

SEQ ID NO: 5719 - DNA, 517 bp, Hordeum vulgare
atccttttgtcctcaaccagcagcagcgaaagtcgctttcgtctccgcctccagtcgtcgccgccgccgacgacgacgattcaaccctcccccccgccccgcgccgcccgcccatgtcgatccagggcctgctcctcgaggtcagagtgacggggtgcaggaagctgcgggacaccgagttcttctcgcgccaggacccctacgtcatcatcgactacgccaacaccaagctgcgcaccaggacatgcaccgatggaggaaggaacccgtcctttgatgagaagtttcatataccactcattgaggggctccgtgagctgagtatcaatgtgtggaacagcaacacaatcaacaccgatgacttcattggcagctgcaaggtgccactgaacaaggtgctcacgagtggcttcgatgacgcctcatggcccctccagacacgccatatgaagtctgctggggaagtgatgctcattatgcactttgatgtctcagcaatgaagaacaagatggcagg

SEQ ID NO: 5720 - DNA, 520 bp, Hordeum vulgare
aacctcatttctcaattgaccactcatcacgagtatatatcgaacaaagcaaatttattgagcaccaaaaaacacttaacacaggtttcaggtgctgcgaccttgcagccgccagtgcattcgctggcgttcaagcaggcggcactataagtctataattagacttaaaggcagaacagtcaatacggatttcaaaatagaaataaggcatctgaccatcttggcaaacccgcaatatagaactgacttcgtcacagctgtccgcaagctacttatatagtgcataccagcgagaataaacgtttctgatggttgctagctaggctgttcgcaacactagaccaaaggagacgatttttttttacatgctgtttcagttatctgacacaccttcagtaggctttgtgtgatccatttgaaacaactcaacggccagacctgatcatcattccttcgtttcgatgccgccacgtcaggtcactgaagctgtgggtatatcaatatggccgtggtggataag

SEQ ID NO: 5721 - DNA, 1043 bp, Hordeum vulgare
  UNSURE (13),(14),(23),(29),(67),(86),(237),(277),(797): n stands for any base
gttacctcgatcnngaggcactnaaatancgagggaagaaaaaaccgtaccaatcttggataacgtnctgtttgggccatactttngaacaaaataaccaaaagtcgttttcgaccctgaatgctactgttagttatagtcgacgaagacgacgacgacgactacgatttaaaacccttttctaccgtgccgacaagaaatgtatattcaggacaacttctctaagtaatatagacngagtgcttgaaggtgtgggacacagagttatttttgtgtnaagacctctacgttatcatctattatgctaacaaccaattgtgtatcatgacatgcacccatggagaaaggaacccgtcctttggctatgaatttgttttatcaatttaagaagggtttcgttgcgccgtatcattatctttttgtacaataacaaaaaggacaaccgagccccttgtcttgtaaattatatagtggtaattaacaatcgtcgtcccgaccgggccaaaaataactgccgtatgggccccctcagttacgctatttttaaggtctatcctggcaatcgcctatccccatattccccttttccaccctttttctttttattaccaccttttccataattaaaatccagtaggccacaaatttatatctactccccaaacgggcggtattcccacatgggaatatccgtcacttccccccgtcccgttaaatcccgcgcccggaatattgccgcgactctgtccgcgtcgcccaccgtttatttccccccggttctcataacattccacccntatttccgtcctattccactaagtttttctcatagacgttttccttccatgatttcggaatattcttttacattccacccccctcatatccaatttatttatcacattcaccccaaaccctatatccccacgtatttcccccccctttttcgtttcccacaaacaaattgcgctgccaccgcagctcgttattttcaccccccccgccacaacctgttctccaccttcttatctagcaggtccacg

SEQ ID NO: 5722 - DNA, 495 bp, Hordeum vulgare
  UNSURE (19): n stands for any base
catatagaactgacttggntcacagaagtctgcaagctacttatatagtgcataccagagagaataaacgtttctgatggttgctaggctgttcgcaacactagcgcaaaggagacgatttacatgttgtttgagttatctaactgatcttcagtaggcttggtgtgatccatttgaaacaactcagcggccagaactgatcatcatctatgccgccacgtcagtcaccgaagctgggtatatcaatatggccgcggtggataagctccggggtacggcgcaggtggataaggggactgtgctgctgaaggtggtggatacggctgcccatatggctgtggcgggtacggctgctgcccatatggctgctgcggtgggtacggttgcccgtacagctgctgcagcgggtacggttgtccataaggctgtggtggttgacttgtaggaggacatgcctggtgcgggtacggctgctgaggaggtggggttgagtat

SEQ ID NO: 5723 - DNA, 40 bp, Hordeum vulgare
gagaactagtctcgagtttttttttttttttttttttttt

SEQ ID NO: 5724 - DNA, 554 bp, Hordeum vulgare
ggtgaaaactaggtccaacttgaatactcagatattacacccgtgtcgaatcagatttaacattacacattacatcagaacaacatcagattatgtctgcttagatgtaccatcaatatatacattcagcgacgactaccgcaggaaccaaaaaagaaaggcagttgaccatcagctttcgacgcgaaatccttctatctagcttattcccctttctactatgtggtgtacaacaatgcttgcctactaccctaacactacagggcaactcactcactctacaatgcctcctttaacacgctcctgcttaaccgacaaccacccccacgtcttcatcagcatgccggttgttacccctgaacctcagcccaatgtcgtcgtcgtcctcatgatctagagggatcagcgcaaggtcgtcgtctcctgatcctggagtctcatcagtaggctcgttcgaccgacgggagtcctcgccaaagttgtgcagcctccggccaatgagatagcgatcgtctctgattgaattgtggaggttggtgaaccagacatggaac

SEQ ID NO: 5725 - DNA, 353 bp, Hordeum vulgare
ctcgaggccgaggtggccaggctccgctgcctgcttgttgacatcagagggaggatcgaaggggagattggcactttcccttaccagcggtcggtgaaaagcaatgagtttgtcgaccaggggagctttcttggtggtgcgcaggttatgaattcctgcgacttcagatgcaacgatcagttgtactgcaatccaggaatgcagcaggccaggacaatggacgacgatggtgttatgagtgctggacaggttttggggcaaggtgccggtgacactatgggttgtgtaaaaccaggttctttaaaccccccaggctgccgtgggggccaaatgctgtaaacagcgtgaggact

SEQ ID NO: 5726 - DNA, 275 bp, Hordeum vulgare
ttttttttttttttttttttttttttttttgacacagaacctggatgctgaaatctaaattattcaagatgtcttcgaacgctgtctgttctgctaattatcggcgagcatctaggactaggagcaaaggatgtccaactccaagaacattaccgaggctggaactaagcaacagtaaaggggatgtcactatagcatcctagctaacgaacttgcggcgcccggggcaccttaaaaggcatcttcgacaagagagccacaaacacgacaatttg

SEQ ID NO: 5727 - DNA, 393 bp, Hordeum vulgare
gacgaacactcaccagttttggttgcagcaggcagagtgaagcggccggcgacgatgcgcaagtgggcgctctcctgcgcgctcctcctcgtcctcctcctcaccaccctccccgatccagctaagaagctccaagtcaatgccgaggagagcagcgacgaggttggcgattttcccaaggtagaggagaagcttggggccgtgccccatggcttgtccaccgactccgaggttgtccagagggagtccgagtcgatctcgaggaagaccctcaggaactcggccgagaagtttgagttccaggccgaggtgtccaggctcatggacatcatcatcaactcactctacagcaacaaggacatcttcctgagggagctcatttccaatgcatct

SEQ ID NO: 5728 - DNA, 271 bp, Hordeum vulgare
tttttttttttttttttttttttttttaaattccaactagctagggtatcgtcattaaacaagaaactaggtacagtagtacattacacggacaaaaccccccgtatcacgatcgatgattaatcgtcttccgcgcggtaaaaatggacgtccctcaaaaccatcacatttccagtccaacatttctttctaatgaaatgaaagctaaatgggcgatatgagcaactacagctcgtccttgtcgtactgctcgtgttccggctcctccgcc

SEQ ID NO: 5729 - DNA, 518 bp, Hordeum vulgare
cactcaccagttttggttgcagcaggcagagtgaagcggccggcgacgatgcgcaagtgggcgctctcctgcgcgctcctcctcgtcctcctcctcaccaccctccccgatccagctaagaagctccaagtcaatgccgaggagagcagcgacgaggttggcgattttcccaaggtagaggagaagcttggggccgtgccccatggcttgtctaccgactccgaggttgtccagagggagtctgagtcgatctcgaggaagaccctcaggaactcggccgagaagtttgagttccaggccgaggtgtccaggctcatggacatcatcatcaactcactctacagcaacaaggacatcttcctgagggagctcatttccaatgcatctgatgctttggacaagattaggttccttgccctcaccgataaggaggttatgggtgaaggtgacactgctaagcttgaaatccagattaagttggataaggagaacaagattctctctattcgcgatagggg

SEQ ID NO: 5730 - DNA, 555 bp, Hordeum vulgare
ctagcagggtatcatcattaaacaagaaactaggtacagtagtacattacacggacaaaaccccgtatcacgatcgatgattaatcgtcttccgcgcggtaaaaatggacgtccctcaaaaccatcacatttccagtccaacacttctttctaatgagagctaaatgggcggggcgacatgagcaaactacagctcgtccttgtcgtactgctcgtgctcaggctcctccgcctcctgcttggtcgactccttctcctccacctcgggctcctccacctcctcttcctcctccacggccgcgtccgggctcaggtccaggctcttctgcaccgaccggtagatgctcgacgcaaagtccttggggtcaggcaggttgaacccgctctccatcagcgccgtctggtacaccagcctcgccgtctgcttcaggccctcgctatcgctgtcctgggcaaccttgtcacggagctccttgatgatggggtgccgggggttgatctccaggaccctcttgccgcgcatgtacgcctgcttgctcgcgtccgacagggtct

SEQ ID NO: 5731 - DNA, 522 bp, Hordeum vulgare
gacaagagctactgtttatagcaccccgattggggatttaccagtagacctggaagttatcgaggaactcaaagctacaggaaaatttgaatttatggaccttaatgtggatgaggctgaacatagcatggaaatgcatttgccttacctttctaaagtatttcaaggacataatgtaaaagttgtacctatccttgttggtgctgtcaactcccaaagtgaagccatgtatgggcagttgctcgctaaatatgtggatgatccaaagaactttttttctgtctcctcagacttttgccactggggatctcggtttagttatacatactatgacaagaaccatggtgccattcacaaatcaatcgaggcattggaccgcatgggcatggagatcatagagactggtgaccccgacgcgttcaaacagtatcttcaggagtatgagaacaccatatgtggacgccatcccatcagtgtccttcttcatatgttgaaacactgcttgacgaagattaaggtcgg

SEQ ID NO: 5732 - DNA, 554 bp, Hordeum vulgare
tttagaacatattgttattttgccctttatttctcctgtctataatcctggtgccgccagagcaacaatgactgaacttcaaccagagcttgttattattacaaagtttgaccggcagctccggtaaatgcaagccacagccatcttatggcatgttacaccagggtgtaccgagcaaaccacattttgctcaacctctaccctcttctgcaggtgagtccaccttggccgctgcagatgcgtagctgacgctgctgtccctcatgctcttgcattggctcgactgctcgtaccgaacaaacccgaccttaatcttcgtcaagcagtgtttcaacatatgaagaaggacactgatgggatggcgtccacatatggtgttctcatactcctgaagatactgtttgaacgcgtcggggtcaccagtctctatgatctccatgcccatgcggtccaatgcctcgattgatttgtgaatggcaccatggttcttgtcatagtatgtataactaaaccgagatccccagtggcaaaagtctgaggagacagaaaaaaag

SEQ ID NO: 5733 - DNA, 493 bp, Hordeum vulgare
acgtcgccgactccatcccgttctccgccgagcacctctcagacatcatcacaatgttcgcaccggcgtccctcgccatgaccagagagatacggtggacgctggacacctgcgagcacccacggacgctccccggccagaaagcaggctgcgccacctccctcgagtccctcgccgagctgccggcgtccctccttgggaggcgtaacatccgtgcgttctccgccatggatctacccatggatgccccagggacaccggcgcttaggggtaagtacaacgtgacggctgcacggaagctctccgggtcatcatctgaggtcgtgacctgccatgacctgacctacccttacgcggtgtactactgccacacatccagccctacggccgcctacatggtgacactgacgagcgtggaggaggatacctcgccggcgacgatggaggtcatggccgtgtgccaccttgacacgtcattgtggagcccgaagaa

SEQ ID NO: 5734 - DNA, 552 bp, Hordeum vulgare
aattaagtggtattggcaagcaccccacttatttataccacatatatcttgatacatgtatgtctagctcacataaaaagacacatttgggccagaaccttcccttctacagtgcgtcgacatgcccgtcaactgacacccagatgatgctcagcttagtgagaaagtggcacacggccacatcacctggcccaactttgtgcagctcaaagaacggattcttcgggctccacaatgacgtgtcaaggtggcacacggccatgacctccatcgtcgccggcgaggtatcctcctccacgctcgtcagtgtcaccatgtaggcggccgtagggctggatgtgtggcagtagtacaccgcgtaagggtaggtcaggtcatggcaggtcacgacctcagatgatgacccggagagcttccgtgcagccgtcacgttgtacttacccctaagcgccggtgtccctggggcatccatgggtagatccatggcggagaacgcacggatgttacgcctcccaaggagggacgccggcagctcggcgagggactcgaggg

SEQ ID NO: 5735 - DNA, 496 bp, Hordeum vulgare
tctttccctctccccagcaaaggattcatctcctttccctctccccagcaaggacccctcgaccattcccctcaagctcaccacaaatggccaccggaagtacagcccaagagagccccgagctgccgaagcagctgcccttcgactttctgaagaaaatcaccaacgatttcgcccaggaccggaagataagcggaagccccttcggaacgctctacaaggggattgtgccggacgatgggagagtgattgccgtgaagaaacttcaggagaacgcgccaatgccgcctgacaagcagttcaacaaggaggtccagaacgtcatgtctctcaagcatgacaacattgtggaggtcgtcgggttctgcagcgagacgcagaagaaacttgtgcagtttgacaagagatacatccaggctgacatcaccgaaagcttaatctgctatgagtatttgcctaatgggagccttcaggagaatctttttgagcccaaaga

SEQ ID NO: 5736 - DNA, 534 bp, Hordeum vulgare
tcttatattaagtctgacataaacagagataacactgaaagtaccgttgcatctacagtagttgactaataatgctaaaggacatactactcatactaaaattacactcaaatgcttccaaaatgacaaggcaacaaagggtcttatttccaaatgaaagttacagccttccggtaataaaagagcgtgcatatttcatttcttatgaccaaagaaagagtccattagcttcttgccagtcgtaggcggacgggagacctggaagttcatttgaaatacatatagcgtgttagaatcatttgaaatatccagactaaactatatatgcccatccagatgtttgatttatttagaaaatatatgtttatttaatacagtaagatatgtattaaatgagtaaaaagaggtaaatagtgcatttagttgacactggtattatgaactattttgtgcagataacggccaagttgcatatatattattaaaaccattttatgctatacacgtgaagatacaaaaatatgttttcctaag

SEQ ID NO: 5737 - DNA, 518 bp, Hordeum vulgare
gacaagcggacttcttgttgtagctaaggatgagcattcacatgctcaattagcagaacaattcaagctgcatacaataaatagggtatacatcagtcttacttgtggtttacctagcccaaattctgccagaattgaagttcccatatctcgtgatcctaacaaccggatacgcatggttgctgctcctggatcaggccacagatatgcaaagcatgctgctagtaggtataaagtaagagaggtcttctgtggtggtggatctgcactggtagagtggagattggagacagggcgcactcaccagatccgagcacatgcaaaatatctagggaatcccctacttggtgatgaaacatatggaggtaccaaaagcatggcattgtcacttttgagacccagaactccttcaaaatatcatggcgatctttcaaatctggtatcaaagatagacaggccatgtctccatgctgcattgcttggattcaagcatcctcattcaggaaaggcacttgaat

SEQ ID NO: 5738 - DNA, 542 bp, Hordeum vulgare
  UNSURE (3),(13),(14),(20),(21): n stands for any base
cgnagccattgtnngttccnngtgtattttacattctctatacagtacatcacacatcaaattgtgctaaaatggttttaacatgcatttttttttctaggttacttaaacatagaaaagagcactaaaaatatgtctccaagtcttgtcaaaatgtctgaagcttctttcttggtgcagcgctgatctctcgctgaacatgccgaaaagcttgacagacactccatcagtttggccactcactcagagatgccacaagtccaaacaccttcaggtcaaacatcacatatccgaagcagcattttatgtattctccatttgcattaatcacacttgagcaacattgtcattatcttggccttcatttgtcggtgtaacacgacgcagttcatcaagtacctcagtaaaatcatctggaggggggcatgagaattcaagtgcctttcctgaatgaggatgcttgaatccaagcaatgcagcatggagacatggcctgtctatctttgataccagatttgaaagatcgccatgatattttgaag

SEQ ID NO: 5739 - DNA, 542 bp, Hordeum vulgare
  UNSURE (3): n stands for any base
ggnctgcaggcaattcggcacgagggctcaatcccatcatgctcaccccgttcctcgggatcggcgactggttcaagtacgggcagccagacccgagcctcttcgagcagacgcacggcgagggcctgtggaagatggcccaccgcgacgccaccttcgacgcgctgatcaatgacgggatggtctcggacagccgcttcatcatggacatcgccgtcaaggagtgcggcgaggtcttccaggggataacctcgttggtagacgtcggcggtggcctcggcgcggcatctcaggcaatctccaaggcgttcccgcatctcgagtgcaccgtcatggatctcggtcacgtcatcgccaatgctccaactggtactgacgtgaagttcgtcgccggcgacatgttcgagagcgttccagcggcaaatgctgtgttcctaaaggtacgtacgtcctcatggatctcggtcgttttcgttgctagtgagtttgacctagatcggtattcacaaagtgatggcattattagcatacacggacgagat

SEQ ID NO: 5740 - DNA, 501 bp, Hordeum vulgare
gtgattaaacatacagtccgcagcagccgacagttctggcaggatgctgtgtccgtcaaaaaatagtaatggtacagcccttagcaggagtatctcgtccgtgtatgctaataatgccatcactttgtgaataccgatctaggtcaaactcactagcaacgaaaacgaccgagatccatgaggacgtacgtacctttaggaacacagcatttgccgctggaacgctctcttacatgtcgccggcgacgaacttcacgtcagtaccagttggagcattggcgatgacgtgaccgagatccatgacggtgcactcgagatgcgggaacgccttggagattgcctgagatgccgcgccgaggccaccgccgacgtctaccaacgaggttatcccctggaagacctcgccgcactccttgacggcgatgtccatgatgaagcggctgtccgagaccatcccgtcattgatcagcgcgtcgaaggtggcgtcgcggtgggccatct

SEQ ID NO: 5741 - DNA, 517 bp, Hordeum vulgare
ggaaagagcatggccgcccaggtaccggcgatcgaggttcccactgatgccgagctgctgcaggctcaggccgacctgtggcgccacaccctctactacctcacgtccatggggctccgctgcgccgtcaagctcggcatcccgacggcgatgcacaacctcggcggggtcacctcgctgcccgacctggcggccgtgctgtccatcccggcaagcaagcagccgttcctcggccgcctgatgcgcgcgctggtcacctcaggcgtcttcgccgccggcggcaccaacaactccggggcggagctcttccgcctcaacccactctcccgtgtcctggtggatggtgtcgatgcggaagaacaccacagccagacgtccttcgtgctcgccgggacgtcgccgcactacatggaagccgcgctggggatggccgagtggttcaagaaggacgtcaccgggccggtgccatcggtgttcgaggacgtgcatagcgcgtcgctcttcgacgagagcaccg

SEQ ID NO: 5742 - DNA, 557 bp, Hordeum vulgare
gagaaagaacacacccattaattattatcatatacatacacaaacaaacttattgtttaatacttaaaaaaatacaaattaaagacgataggaattacaagcttgtcgctgaagctgttacatgataatatccttgcaaacataaggaaccccctttatttttctttatcggagcacaccatccatacataaacaaagcacactgcaagggtacttcagagtatcccttgttagataaacttttgagaaaggctttacttgtagacctcgatgacacctcgtgcacccattttcttgataattttgtagtcggtgaaccctgctttcatgaagaggtctcgccagtcattttcgctacgttgacggcccctcgtgaacacaagcatgagcatgtccatgagagtctgggcctcaaacatgacaggtcctaatgatggttcgaccacgatatcaatgacaatcaccttccctccctcctcacgggaaggaatggcattcttacactgggttaggatcttcacacaatcgtcgtcactccagtggtgcagcacaagctt

SEQ ID NO: 5743 - DNA, 516 bp, Hordeum vulgare
  UNSURE (29): n stands for any base
ggcaagctctgcattttgctctgttcganaagaaagggagcacgcgtacaccaccgagagaatagaaccaggaggctagcttcaaagatggcggccgaggcgctggtgagcgtttccactggggtgatgaactctgtcttagagaagctagccactttaatgggggaggagtacaccaagcataagagcatgcagcgagaggtggcgtttctcaaggatgagctcggcagcatggacgctgtcctcaagaagctcgagagcatagaagaggagctggatccacagaccagggagtggaagaaccaggtgatggaaatggcattccacatcgaggactgcatcgacaactttatgcacgaatctggtgaggattctaacagaggaggtgttggctttgttggcaaaattgctcagtacatcaacgcattgagaacgcgtcaccaatttgccaaccaaatccagcagctgaagacgttggtcaaagatgtgagcgaacgtcggaaaaggtataagctc

SEQ ID NO: 5744 - DNA, 533 bp, Hordeum vulgare
  UNSURE (7),(15): n stands for any base
attcttnacactagnactgtagtaattttacatgggtaccaagtccagtacaattcttccaaatagctatagtaaactggcattagcggtgcaattttacccaatgctctgttaataaccaaattaagccgacacggtgctgttacccaatgctctgttatcttcttcagtttcgtcaggcggcaggccactgctcgcgcatctctccaccactgctggttgaaatagagcatcaggaagacggcacaacaccagtctctatgctttgatccaaatggtcaacacttggaatgactcattggatgtatagtgtgaaaactgtagagccatggatcttgactattgtaccaatcatgttggttgtgtgcggcttccccgccctaccatgaatttcttgtaatcatgtttatccatcagtggtggttgatccatcgactgcatcgttcggttgccttgccacctcttcgcccccctctgaactgccactggaaattttaaaatagtgttccatgttactttgaagcctgatcttg

SEQ ID NO: 5745 - DNA, 548 bp, Hordeum vulgare
gtcccccgggctgcaggctgcaactgcaaggtttctcatacctgcaagcaactggagattgctatccaaagtggtcccctgtcggcggtgtaaccattccgtatattcggcgttctatgtatctcaagtttcctaagacattccaggtctcggattcctcaattcctcactcgcaaccttttggttctaggtatgttcctaactgtagtgcaaagagcgaatatttcactgtagattttctggatcaaccgaagaatactcagagtggattaaaatcacagtacttgtacttattgtatggattcttgttagcgatattttgtgtggaggtaatatttgtggcactagggtgctggtttatgttgagaagggagagcaagcagttaacaggagtatggccagctgaggttggctatgaaatgataaccaaccatttccgcagatacacttacaaggagttgcaaagagcgactcaaaagttcaaggatcaaattgggtgtggcgcatctggtcatgtatacaaggggggtcttgaaagacaagagggc

SEQ ID NO: 5746 - DNA, 551 bp, Hordeum vulgare
gaacatgctaatgtgtactgctactcggacgaacctatgatacatgacatgcatgcttattgttacattacatgatacacatcacacatatgtcttgttttggaccaagaagaacaagcataaatatacatgcatgctgcatatacaatatcaaatggaaaactctttatgttacgccaatagcttcatcaagcaaccgaaagaagcatcggcacaacattttccatggtgggcctttgtctaccatcttcttctacacatgaaacagccaacttgaacatcgcccttgcttgcaagctgtcgaactggccgttcaaccttaagtcaatgaagtcggctatccataactgttggccaccctccagcattagattttctgcaagcatcctgatgacccttccaaagaccatttccacttcctcgtccgcatttgatgcccagtctgaaacacgagcccccttcagcagttccagaagaaccacgccgaagctgtagacatcaaccttcgccgttattggctggctagaaacccactcaggagctatgtaacc

SEQ ID NO: 5747 - DNA, 602 bp, Hordeum vulgare
gtctctgctgtagtactctgttctgccaactaaggaaaattcagctcacagtgaacttgcatgtaaaagagagtacgccgcaaccggcataatttcagaacgcatctctgcatccaagtaacatctgatggtgagttctcctgctgcttgtgtagaacggagggtgagttcgccggcgggcatccggcgggagcggtgaacgtgccctacatgtacagcaccggctcaggtaattcgtcaaacccaattcacagctcttcacctaagccttcagtatttttcctattgcaatataagtctttcaacagattgtgctagggactacatatgaatgtatataaacaactttaaaatattgatgcatatattttgtttcatatgtaatcctttaataaaaataaaaaatatatatttaggaacggatgaagtaatatataatatcgcttcgatttctaaaatggcgaaggactcgcactttgttgagcaagtgttgcttctccgctgctctgatccagtgtcatctattgtatgcaaaaactttactttgtttctctttcaatcgataggaatggcgaagaactcgcacttcgtcaagcaagtgt

SEQ ID NO: 5748 - DNA, 641 bp, Hordeum vulgare
gcgttgttgtgttgtggtgtcttgaatctgaattcagtactaccacactggctatatacaaccttgcagactatgacagatcattatttttcagcaacattcagagaagccaacgatgtcaccggccattgactggcagcccattctccctccaagtcgagaatcctccggcgatgtcggtcacggcagtgaagccctgaaagaagaagatagaattaccatcacgtgtctatgagccggcaggtgaaacatagctaccagttgatagacagatagatagataaatgtagtggtgatagtatttatacttacagcggaacagagttcgactgctgccatgagagacctctttccactttggcatccctgaaatcgatgagtggaattttttgaacttaagaaacacccaactaaaaaagaagaaaaatgagaatgttcaggaatcaatggcagatcgtacgatgatgatctcgtcgtccttgccgaagatagccgacacttgcttgacgaagtgcgagttcttcgccattcctatcgattgaaagagaaacaaagtaaagtttttgcatacaatagatgacactggatcagagcagcggagaagcaacacttgctcaacaaagtgcgagtccttcgccatt

SEQ ID NO: 5749 - DNA, 982 bp, Hordeum vulgare
  UNSURE (1),(13),(20),(21),(25),(31)..(34),(52),(53),(71)..(76),(78),(79),(103),(104),(107)..(135),(137)..(139),(146)..(149),(161),(163),(164),(178)..(257),(284)..(305),(307),(309),(324)..(329),(340)..(381),(398)..(460),(467),(477),(496),(500),(504),(511),(513),(521),(548),(587),(596),(608)..(612),(617),(618),(623),(632),(638)..(641),(643),(644),(659),(661),(662),(665),(666),(671),(674),(683),(684),(688),(703),(707),(716),(722)..(724),(726),(733),(742),(744)..(746),(756),(758),(759),(769),(778),(791),(801),(809),(812)..(815),(819),(823),(829),(835)..(838),(844),(853),(859),(866),(868),(873)..(876),(879),(885),(886),(902),(903),(907),(910),(919),(924),(927)..(933),(938),(943),(945)..(948),(951),(952),(958),(959),(962),(964),(965): n stands for any base
naaccatgcaaangctggannctanctggtnnnncacatgggtctgatgggnnttttgggaggacaaaaannnnnntnntggggtggggggggggcacaaaannacnnnnnnnnnnnnnnnnnnnnnnnnnnnnntnnnttttttnnnnggggggggggcncnncccaaaaaaaaaannnnnnnnnnnnnnnnnnnnnnnnnnnnnnnnnnnnnnnnnnnnnnnnnnnnnnnnnnnnnnnnnnnnnnnnnnnnnnnnggggggagaaaaaaatttttttttaannnnnnnnnnnnnnnnnnnnnnananggggggggggggggnnnnnnccccccccccnnnnnnnnnnnnnnnnnnnnnnnnnnnnnnnnnnnnnnnnnnaaaaaaaaaaaaaaaannnnnnnnnnnnnnnnnnnnnnnnnnnnnnnnnnnnnnnnnnnnnnnnnnnnnnnnnnnnnnnggggggngggggggggnggggggggggggggggggngggngggnggggggngngggggggnggggggggggggggggggggggggggnggggggggggggggggggggggggggggggggggggggnggggggggngggggggggggnnnnnggggnnggggnggggggggngggggnnnngnnggggggggggggggngnnggnnggggnggnggggggggnngggnggggggggggggggngggnggggggggngggggnnngnggggggnggggggggngnnngggggggggngnngggggggggnggggggggnggggggggggggngggggggggngggggggnggnnnngggngggngggggngggggnnnngggggnggggggggngggggnggggggngnggggnnnnggngggggnngggggggggggggggnngggnggnggggggggnggggnggnnnnnnnggggnggggngnnnnggnnggggannggngnnggggagaagggggaaag

SEQ ID NO: 5750 - DNA, 550 bp, Hordeum vulgare
tgtaggtatgcctctgatgttggaagcaatcgtcggtcaaataacagtaaaagacaggtaagatttacactctcttgcagaagaaagaacgttgggacaatcagcagcctttcacatgtgcgtctatatatggatcattacatacaaaaagggtttgcatagccgtggttttttccgctacttcagccaacgtatcggagcaagacaccgtcgttcccgagcacaaaaccttggttgtccccaatgaactttacggagtagaggttcccagggatgttatcggcagccctgtcgcgcacccaggtcttgccgccattggttgttttcagcaggacgccgctcccaccggctgcccacgcctcatcctttgagcggtagcccacgtccagaattccaaacccccggctttgtaccgacgcttcctcaaagtcttcaactatccccgttccagagagagaactagaggtcaggaaaggtgtctcttgttgaacgaaggcataaagattatagcaccgaacgtactccttctgtgaaggactcatgcagatta

SEQ ID NO: 5751 - DNA, 494 bp, Hordeum vulgare
taacatgctttaaatctgtgtcatggttctttgtgatttgatatgactgcttgttatgttttgtggccttaactctacgctcctgttacattagcaatactgtcatcagctttcacattaactaccttcttagcatgataacttattatgtgtaccaaacaagtgatagtgtagcttctgaattatcctgttttggcacgatatgttattgtgccatgctggtttctgcattgcatttcttttaatataccctaccattgatctgttttttcatcacctattatttccttaataatacaccgaattgctgaagactaccataaaacgagcagctgatgatcatttagtggacgttttgttaactgcatactaaacctgatgtttaactaaatagtaaatattccggtgattactattgtaggtggcacttaactgtatattcccatttgcatctacagtttagttcttctaatattcacatgtttttgttgttc

SEQ ID NO: 5752 - DNA, 548 bp, Hordeum vulgare
gtaaaatgcatgcctctacccggagaaatttaattagggtggtgtacattgtaaaaactgctcaatacaacttttgaatgatatagctcctttcattcccaaaagtgggtctgtgaggattagctcagcaccaaaagccttcaggatgattctcctctccatactcatggaggcgggcatcgtgagtacaagtctgtaacccttgacagcagccatgaaggccagcccaatgtctgtgttgccactggttggctcaatcagcacactcatggcacgcatggcgagagcgcggccgcgccctacaccgatggccgaccccttgccccttatcctggcctctaggagcttgaccatgggcgcgttcttgagcatgtcggagatgatcatgaaccggaccctgctgcccatgatgaagacgtgctccagctgcgacaccttgctaggcatccacgagatggagatgagggggaggaggagatgaagagagggattggtacctttgctgtgaatgtgatgttctcgatctggcagttccagttgtcctcgca

SEQ ID NO: 5753 - DNA, 372 bp, Hordeum vulgare
gaagcgctgcaccggcaccgagaggctcctatggcaacagcgcagggcatctttaggaacaccgtcgcggcgctggtggccattagggagctccgtagcgggagctcaacgtacgggcacttctcgctgccaccattggaaacggaggccgccttgactgagcagggccagctgctgtccatccaggttgccgatacatgagtttaaatgttgctatatatatatactagcaaaaaaacggaagagaaaataacacacgctttgaacgtaatatattagcacatttgtgttgtcgacgatggcctcagtgctcacacaacgaaaacgcgtttgaatgtacaatcactcggaataagatgagaaatatgttgt

SEQ ID NO: 5754 - DNA, 391 bp, Hordeum vulgare
gagacacatatttctatcttattccgagtgattgtacattcaaacgcgttttcgttgtgtgagcactgaggccatcgtcgacaacacaaatgtgctaatatattacgttcaaagcgtgtgttattttctcttccgtttttttgctagtatatatatatagcaacatttaaactcatgtatcggcaacctggatggacagcagctggccctgctcagtcaaggcggcctccgtttccaatggtggcagcgagaagtgcccgtacgttgagctcccgctacggagctccctaatggccaccagcgccgcgacggtgttcctaaagatgccctgcgctgttgccataggagccatctcggtgccggtgcagcgcttcctcgtccaccagtcacc

SEQ ID NO: 5755 - DNA, 518 bp, Hordeum vulgare
gtcgagatcatcgccaacgaccagggcaaccgcaccacgccctcgtacgtcgccttcaccgactcggagcgcctcatcggcgatgccgccaagaaccaggtcgccatgaaccccatcaacaccgtcttcgatgcgaagcgtcttattggcagaaggtttgctgatgcccctgtccagagtgacattaagatgtggccgtacaaggttattcctggccctgcagacaagcctatgatcgtagtgcagtacaagggtgaggacaagcagttttctgctgaagaaatttcttccatggtcctcatcaagatgcgtgagatcgccgaggcttacctaggagtaactattaagaatgccgttgtcactgtgcctgcttacttcaatgattcccagaggcaggcaaccaaggatgctggtgttattgctggtcttaatgtgatgcgtatcatcaacgagccaacagcagctgcaattgcctatggtcttgacaagaaggctaccagtgtcggtgagaagaatgt

SEQ ID NO: 5756 - DNA, 517 bp, Hordeum vulgare
tacatgctgccgttcgacggcaaggatgattctgccgatgggttggaggatgcagggttcaggtctgagagcgggcaggaagacgacgaccggctggagaggctggtgtccaagcacaggcacggccgtggcggcagggcgcgaaatgatggcccctttcaagaaggcggcaggttcgccgccgccgagtcctctttgctggagaggaccctcgagatccgggacaggtcgtacagggtgaagatcgagcgccgcgacggcggtgagagccaagtaggtggagcacgggggatgtcggctgatgaatttgtgggcagcgctgctgccagtgttgatgagcaaccacttacagatgatgatgaggttggtgctgccgtgggttcagatgctgaagagttcggccgaaacgtcaaggaggctgcagagatcttgaggaaggcgagggaatgcatgatggccagggacgacgaagaggccgcggacgcgttgctgtataggtcagcaaggcttctgtcca

SEQ ID NO: 5757 - DNA, 1014 bp, Hordeum vulgare
  UNSURE (1),(2),(20),(21),(23),(24),(33),(37),(41),(42),(46),(78),(81),(87),(95): n stands for any base
nnaatgaccatagaacaagnntnncgaagctgntggnatcnntacncgtttgttttggttaccgcccatacacatcancantttgtnattctgcnctgggattgaatggatgatccaactgattaatagagaagatgacacgtacgattctagtgttattgaggcggggtcatgcctggttcacgatcaacaaacatgtttgctcctagtaaaaattattgagatttgtggtggacgaaccgttgcttcatctttcctgctacacacggggggtggctcccgctttttttttttttcgcccccccccacccgcagccctcaaacggggggggggggggacttacctcccccccttcgtttttttttttttttttttcgtctccgctcccatcccgtttctttccaataatatatatttcctcttctcaccttttctcgcctccccttccctctttattttttatttctctttctctctctatccaccccttttcgtccctttcctttctttttcttgttcttgtctctctttttcctattctgtttcattctctatccccttcctaactttttcttattctttttttttcttccccctttgtttgctttttctgtttgttactctctttcctttttttcgtatccgttgttttttcttctccttctgtctgctcttctctcttttctctcgtttctctttctgtttcttctttttctttttcgatttgtttcccttgtttttttttccttcttctcttttctctcttttctctcttttttttcttttcttccctctctttctcttttccctcgtctgctttcttatcttcatcttctttttcccctcccttcttcgtttttgtctatcacatccttctgttcccgtcctttccttccatttgtcttttgtgttgcctcgtttcgtcttactcccttgtaattctcagttttgtttttctctcctcactcctattcttcctttctctctcgttccctactcccttcacctctgat

SEQ ID NO: 5758 - DNA, 546 bp, Hordeum vulgare
  UNSURE (10),(11): n stands for any base
aacttatagnngtccttccttttcactagtattccttgcagcattcttttctatgtacatacagatcccatccctaccactgcacggtaatttcttttttctttcaaaacacatgttcaaaaataaccttcgagacatgtctatcgaatatgtggggagggcagtacgcagcaaagtaactgcttctcacgacgctcatcaaggtctgcttcgtctcgctgctcgtcccatcatcatgagtccggagaaagttctgggtgagttcctgcatgctcgcctcgattttctcttccatgcggctcatcgccgcctcatccttttcggtgtcctgagaaagtaacatcttgtggtgaaggttgtcacaaataaaggacgcaagttgaataaagcaagcaccaccaatggtgtttatcatcgatgatgcttcaccggttcgtccaccacaaatctcaataatttttactaggagcaaacatgtttgtttatcgtgaaccatgcatgaccctgcttgaataacacttgaatcgtacgtgtcatcttctctat

SEQ ID NO: 5759 - DNA, 454 bp, Hordeum vulgare
gaacagtgactaaatgccgacagatgcctgaccgcccctatcactatctatctcaaggcacagtcggagccgagcgcacatgttccgatctggtctcatgtcccctgctcccgccactccggcgagctgattccgagcccctccgccgccgccggcccttcttctcctgcgcctaccacgctagccccctcgctcaaggctgtgcgcacgtcctccagctcccggcccctactcttgtcatcggcgatgtggcctcttctactactgcttctgttgccttacgcattccaaccggcatcatcaacaccactcaacgataagtccgacggcgatgccttgctggccttcaaggcaagcctgagcgaccagcgacgtgcactggctgcgtggaacacaaccactgctttctgctcgtggccaggtatcacctgcagcctgaagcacaagcgcaggg

SEQ ID NO: 5760 - DNA, 449 bp, Hordeum vulgare
ttttttttttttttttttttttttttttatttacatgacaatacatctcattgcgggttaccagttcttaatagggagcttgacacataaggtggaaaggacagatcgataagctggacaaacatgacaagccagaaacgaacaagccaaaaccaagcttggaacgccaaacataaccaccatataaaagccaattaagtgtacatgacctggatgtttcagcatactgctgaccttgtcactccttttgccttagtctaacatagctatcccttatgccgtgaatcgcagcagctgcatctcctatgcacattctctcggtgggtgcgtgcttgctgcatgatagggcaacctttatgacagaggatatggcattgctggtatgttccattgtgttgttgcttccgtccagcaaacaacccgcgctagcttcttcaatggacagcagc

SEQ ID NO: 5761 - DNA, 519 bp, Hordeum vulgare
  UNSURE (12): n stands for any base
cctcgtgccganattcggcacgaggggaaaccagccatgaagggggccaaatccaagggcgccgccaaggccgacaccaagttggcggtgaagagcaagggggcggagaaaccggccgccaaggggaagaagggaaaggcaggcaaggaccccaacaagcccaagagggcgcccagcgccttcttcgtcttcatgggcgagttccgcgaggagttcaagcagaagaaccccaagaacaagtccgtcgccgccgtcggcaaagcggccggtgagaggtggaagagcttgagcgaatccgaaaaggccccctttgttgccaaggccaacaagctcaagggcgagtacaacaaggccattgctgcctacaacaagggcgagagcactgctgctgccccaaagaaggccgctgccaaggaggtagaggaggaagatgaggaggaatccgacaagtccaagtcggagatcaatgacgacgatgacgatgagggtagcgatgaggacgaggatgacgacgagtaa

SEQ ID NO: 5762 - DNA, 529 bp, Hordeum vulgare
atgttagccgatgacaatggacggaaagagtgaccatctaggtaggtacaggcaggggcacacccgcggcggaggacatacaccctaacaccgcaaggagcaccccgccggcgggggcgccaacagggagcgctatccgttatagcaggacggatggacggacgacatgaaaaaggtaaaacaacatgacggtgtgaagtgaaacttgggataattctagtggagatggataggctccttatgacaaccaccacccacagctcaggggcctcgcgcagcagctcccgccttgtccgccggagcaaagatgcttcttctttactcgtcgtcatcctcgtcctcatcgctaccctcatcgtcatcgtcgtcattgatctccgacttggacttgtcggattcctcctcatcttcctcctctacctccttggcagcggccttctttggggcagcagcagtgctctcgcccttgttgtaggcagcaatggccttgttgtactcgcccttgagcttgttggccttggcaacaaag

SEQ ID NO: 5763 - DNA, 515 bp, Hordeum vulgare
cttagtctaactttcaagctggaggagccccttgttcacaagacaggagagcagagcctggtagtgattgaggtgaagaagcagttgtaccttgccggtcctctaatcgtcggaagcctcttgcaagatgtggtccaaatgatatccgtcatgtttgtgggtcatctcggcgaactcgctctctcgagtgcctccatcgcaacctccttcgccggtgtaactggcttcagcttgttgtcgggcatgtcgagcagcttggacacgctgtgtgggcaagcctttggagcaaagcagcaccatcttcttggcatatacatgcagagggcaatccttgtgctcactccggtgagcgccgtggttgccataatctggggatacaccggtcagatccttttgttgtttgggcaagaccctgaaattgccatggaagcagggagctacatccgatggatgattccgtcgctttttgtctacggcccgctgcagtgccatgtccgatttctgcagacgcagaa

SEQ ID NO: 5764 - DNA, 464 bp, Hordeum vulgare
tgaattcttggttgtttccttctttccctgcacatctcactggtagagaaaactgtgcactttgtgtgtatcatcatgtcgctaagtctaggggtaggggagtaatggaaaccctttccctggccttgaaagcttctttgtcccagttggtgcgcagagtaatggacatgaacaacaccgtctgaacgacaagcgcgcaggttattcccatccatagccccactccaccaagatggtacacaaatgcaaaacatagagccgccgggatgccgacgaggtagtacgcactaagattgacataggagccaatcttttgaaagccgcagcccctaacaatacctgaaagaacacactgcatgtcatcaaacaagaatgccacgccaataattggcataattcttgaaatgtactccaccacttccttgtcgttgctgtatgcatacccccatagattgcgcaccaaa

SEQ ID NO: 5765 - DNA, 520 bp, Hordeum vulgare
gcttcacattcctctaacaaaggaacatcacaagccccactggctgtagagattccaacacatacaaagggagaacaaatctcacaatcctctaacaaggcaacatcacaagccccattggctgtagaggttccgacgtatacaaagggagagcaaatctcacaattctctaacaaggcaacttcacaagccccactggctgtagaaattccagcatttgctgcgccgccaagtgggtgggttcttccgtacaattcgttccctctacattttggggaatcggcggaagccagaatcacccctttacacatgtggtggccatactatgggttccctatcagccaccctggagggctgagtgtagtgccgcacaacgaagctactgatgagagcgaagctgcaaagagccctctggttgaatcaagctcgaagagccttcctgttgaatcaagctcggactccgatgacaatgctgagacaacagccaacaaggagtggaaagtgctcgagtcgctcggga

SEQ ID NO: 5766 - DNA, 549 bp, Hordeum vulgare
gtgcacaaaaattctttggcttttacatcaacaacatgagacagacagagaattggcatccctacaaaacctcctgcttttatcctacagcacttacaacaaccacctgtgccctgctcattacaaggcccaagcaggaaacaacgtgcatttcctgggccagaccaccgccaatctctgtgtgcgagtaaaacctaagaatacaccggagcaaaggaatatgtggaacaggctcctcctagggttcatagttaaattagacacggggaagaagatccccggtttcgtcattcaactctacatcttttgtatggcacaaaccccctcgccggctcttctccgctgcctatgatcggcttcactctcacaaaagccgagttctcgcttggttttagctgaaaacttgaagctgaccgagggacctgtgccgtcccgagcgactcgagcactttccactccttgttggctgttgtctcagcattgtcatcggagtccgagcttgattcaacaggaaggctcttcgagcttgattcaaccagagggctcttt

SEQ ID NO: 5767 - DNA, 518 bp, Hordeum vulgare
atcttgacaactgcatgtcatgcaccactctgcctgcgcttggccgcctgaaccagctcaagtccctgcaaatctcaaatgcagactcagttgtcaccattggttctgaattccttggtaccactgtgatgtcgcaagccatctcattccccaagcttgaggttttgaagctaagaaacatgaagagtctggaagactggtccttaagtgtggaagagagccagacattgctgccttgtcttaagtcactgcacatacagttctgccctaaactcaaagctctgccagaaggtctgaaggacgctgctctgtgtgaccttcgtgtcgagggtgcgcattgccttacagagataaaggacctgccaaaactatctgatgaactctatctgaaggacaacagggcgcttcagaagatctccaacctgcccgtgctcaagtccctcaccatcgacgattgctccaagctgaagcacgtgtcgggcctcgacacgctgcagcatctcaggcttgtgttcccc

SEQ ID NO: 5768 - DNA, 546 bp, Hordeum vulgare
caagtggcatacttacactcataaaatccataagctcaatctttacaatttacaaatcgccagaaccaggaaacggaaaagaatacacattgagtactggtgaaggatttaagccaagttcagtactgggaaagggagaaaaatggtcatctgctgaccgattcaccaaaaataccctactcattccacgggcctcatcaaaccatttctagtaacaacacgacgactccctgatgtaaaacacgacatctcctggagcagtcgggacgggcggaccaaaacatgtctaccaaacagctgccaaatactccaagatttttaggtagacttctcttcacactgagcattcgtctcgtagatgcgacgggccttgttgtaccttatgtacttcttgccgtcagtgcttgtgatgcgcacctcagggatctgctgtacaacgtgccagttcttcccgccctccaggcagctcctgagtaaagggagtgtgcactgcagctcgaaccgacgcagaccattggcctgcaaacggatcagcagctccagcca

SEQ ID NO: 5769 - DNA, 959 bp, Hordeum vulgare
  UNSURE (1),(11),(772),(858),(878),(885),(930),(956): n stands for any base
ngtcccccggngctgcaggaattcggcacgagggttagggtcagtcttcaagggggggatcgatgagaagaccctggccccaactaaaccgggcaccgggatggtcattgctgagaagaagcttaaccaggaaagctatcagggccatagggaatggctggctgaagtgaattaccttggacaactatgcgacccgaatcttgtaaagcttgacgggtactgcgtcgaagacgaacagaggcttctcgaatatgagtacatgcctcgagggagtatagagaatcatctcttcaggaggagtacacattatcagccgctctcctggaacctccggatgaaaattgcccatggagcagcaaaagggctggcgtttctccacagtgacaaggccgaagacatctaccgagatttcaaaacctctaatatcctcctagatgcgaactacgacgcacagctctcagatttcgggctggcgaaagacagaccaaccgctgaccagagccatgtgtacacaaagctgatggagacatatgggtatgctgcaccagaataccttgcagcaggccacctgaccacgaacagcgacgtgtacagcttcggcgtggtccttctggagatgctgtctgggcggagagcggtggacatagaccatacaaccggcgagcacaacctggcagagagctcgcgaccatacctgtacatgcagcggcgcatcttacgcgtgcatgactcaccagatggcggacagtactaactcgccaaggaccagagnacagcgtgactggcgcttcaatgcctctcagcagactctaggcaaggatctacatgtacaggttacgtcatggcgctagagctgtncgctacatccagatggaggnaacagtnctgacgctctactgtgagaagtcacgctgcgtcgtacatgaccgntcgataccgtgtcaacgaagtacacnaca

SEQ ID NO: 5770 - DNA, 535 bp, Hordeum vulgare
caacatgtttataagcaccattcatccagccaaacatgtgcaattgaacgaacatccgaccgatccgatccgacccgaccctaggtataaacagaacaaacgcaaagcaaacacacaagcaagctccctctcctcccaagcaaaaatgtcttgcccttccttgtacgtgtatatatatatgcagtaaggtgcacaaacacacacaacatgacctctatataatacaggtgcctgtcaaaaggcgctccacttgtcggtcccatgtctcgtagggctggaggtctccgtcgacggcttggacggcttgaagggcccggtgccgaaagggtcgtcgtcgtcgaaggagtagccccggtcgtgggagtcggtgctcttcatcgagtcgaacctcgcaaacgtgttgcttctgtcatggtcggcgttgctgctcatggagtcatacctcatgaagctgctgctgttgttgttgctgccgccttggtcggcgttgctgctcatcgagtcgtacctcatgaagctgttgttgttgccacca

SEQ ID NO: 5771 - DNA, 431 bp, Hordeum vulgare
cgggatctctcaacacaaaacaaacaaacctagcttggtaaccaagagaggtagcaacaacaaaaggagaaaatggatggcaagaggatgctcactggcactaccactttgaaggtgatcatgtgcctgctcatattgagcatcgctattcactcgaccaccgcagcacagtgtggctgctgcgtaagcgcccgggcaaaagcatgttgttttgcttgcataaccgcaggtggctccgacataatatgcaagaacacttgttgtttcccctgtattcttaccgattcagttgttgctaagatgcaagaaatgggagccaatgtcgcgatggaaggagaagaataaaatgatatgcgtgcactgctactagtatggatgccattcacatgcatatgtcgtattgcttcaagctatggtcaagttatgttaat

SEQ ID NO: 5772 - DNA, 30 bp, Hordeum vulgare
tttttttttttttttttttttttttttttc

SEQ ID NO: 5773 - DNA, 288 bp, Hordeum vulgare
gcttgctatcttatctgcctttggcctcgcctgactgcttgctatcttatctgcctttggcctcgcctgactgcttgccatgtcatgtgcttaactacactcttgttcttgttcttgtttgatttcagcttaagcttgagacatgtcgcattccaaccaagtgaggtacacggcgcgctccatcacgcccccggccgacagggacagcggctccaagtcgcccccgcccaggaggcgcgcagcttccaagtcccctcccctgccacctcctcccccttttcctcccaa

SEQ ID NO: 5774 - DNA, 436 bp, Hordeum vulgare
agggagggattgctcttattttcttgttagagggagtacaaaatagatgagtacgtttcgttttcgtttcgataacgggaaagaccaaagtacaacttagacataaccacacaagataacgctacacaagctagaaaacgttaggcgaatcctctctggcaggcaagacaaatcggctcatccccatagtccagcagaaatacagaccaaggtgcatcatgcatacatagtctttcttcatctcaaacattcaccaacaatccaagacaccttcatactcgacaactccaggcgatacatagtctttctgtttcagtcgcgcttcctgtccctgctatttctgtctctgtctctgtctctgtctctgtccctccttccagccggggacctcgagcggtcccttgacgacctgctagagcgacgagatggagaacgg

SEQ ID NO: 5775 - DNA, 242 bp, Hordeum vulgare
agacagcctagactaggtagaagccatttcatctacattacttggcattcttctcgatctcacagatcgacccatgggcgatcaccccaatttccgttgtactccattcgatgggggtgtggagaacaccgaatttgagttcagtagcttgtacttgcaccacatttattctggaccatgtcaaacccaatcaaacatcataggtgcagatgctaccactgggtggggctcgactgaagtta

SEQ ID NO: 5776 - DNA, 298 bp, Hordeum vulgare
tttttttttttttttttttttttttttttggggacaattttgagtgtgctgatagcctcaccatttgaatgtgtgccaaatgttccagacacttttgtcaccatctccccatggcctagcccaatctctgcgcgattggggttcctactaccccaaggacctgcggtgcgattgttaccgttttggtcaatgtaagagtattcaatcgaaccaattattccttcatgcagaatggtgatactctctatcttcaagggtctttctgaatcaacagcaaaccccctatccccaccccatg

SEQ ID NO: 5777 - DNA, 543 bp, Hordeum vulgare
taagcattaagctgaaataacaatggaccaaacatgcatcattgcaatgtttaagacagatacactagtctcacgattaaacaaaattttcaacccaggtgatatgattggcacccagggccgaaacaaatggcgtatagtgtatttctcactatgaaagagaactaacttagtcgacctcctcaatcttgggcccagcaccgccgctggcagccggcacatcatcgtccatgcctccgggcatgtcagcaccagcaccctggtacatcttggcaatgatggggttgcagaggccctccagctccttcatcttgtcctcgaactcatcaacctcgccgagctggttggcatcgagccactggatggcggcgtcgacggcgtcctcgatcttcttcttgtcatcagcaggcagcttggaggcaatcttctcgtcctggatggtgttcctcatgttgtaggcgtagttctccagggagttcttggcgtcaaccttcttcttgtgctcctcgtcctcagacttgtacttctctgcatcctggacca

SEQ ID NO: 5778 - DNA, 557 bp, Hordeum vulgare
  UNSURE (15),(20): n stands for any base
tgtggaaggttcttnccttncctggttgaaatggccaagcctttaactcaaattgtacaggagcgacttcctggtcggtcgtcgcagtaaaagatttctgtaaccttcatacatacagctggctttatcttatttcactcatctatatcttcaacccaaatacaacacacgactaatggcactcccatgccaattcattgtagccatcgtccatggtagttaagctccgatatgcacgacgacagcgcttcccgtaccatcttgttattgccctctacatataaaacatcttcaaacagactctttgcctgctccagaagccttatcttctccttgttgttccgagagcgcagctgggaccgctgctgcagcgcgctgccccatctgtagagagcttctggagcataagtgttgcttttggataacatggcatcaaacttatcgatcgcagccaaatacacccgatcagcatcaactgccgcttccggtccgatgtcggaaagcagttggccacgaaagataagagccagtccccaattgtacagcgccttgacatc

SEQ ID NO: 5779 - DNA, 969 bp, Hordeum vulgare
  UNSURE (1),(12),(14),(23),(227)..(229),(297),(318)..(320),(329)..(331),(364),(372),(388),(392),(395)..(398),(428)..(433),(458),(469),(471),(472),(476),(478),(479): n stands for any base
ntgcagatcggncngtgctcggnctgcagaatctcgcacgaggggcgaaccctcgacacaaactggaggttgatcgcaattttggggtttttgcacgggggggggagaagaacccccaacccccgggggaagacccacccccctcttccttttttaaaggaaaaaaaaaaaaaaagcggcgccggcgggccaaactctcttttattcctttcccccccacctccccnnnggggggggaaggatgttttttttttttccccccccccctttccgccgggggttaaattgggggggtgnaaaaagaggcccggcgggggnnnttttttcannnatttattattactataaaaaagtattatggttntgtgtctncacgacgggggggggncccnttnnnncacgggaggtaagcagcggccccccgcccnnnnnnaggcccgcgcgtcacgatcgggccnacgatccactntnntctntnntttttctttctttgttcttcgccgtctctttattctctctaatattttttttttgtttttataacatttatgttatgtggttgttgaatagttactctataagtatatgtcattatacataaagcaaaatccttaatctcgtctcattcctgacttttctgtattagattctgcccgctaactgtattcgtcttcagtattgtctcctcttcccgtctacctgctaaattctctcggagttcatttttatagcaaacaagaacactggggatgtattacacgtcgcgttaaaaagagtacactacctcagaaaccatgataagataggtggagttacaggagttattgctatttgttttagtcgttcgttaagtaccaggttactctttgcgatcagtgtatcatatgagtagaaagatggatgattagcgtaagaatttatagtcgttggatactacgtcgtagttgatcacaatcaccacttaagtat

SEQ ID NO: 5780 - DNA, 542 bp, Hordeum vulgare
acacgtaatctatttccataaaattggcaaggggcgcagacaatatgtaaatgtattataacatacgtgcacgctacttatcattgtggacactctctatggccttattacaatcagcaagagcaaataaataggcttgtgagctcacacacatgcacaaatgcataacatatatgtaattcagacaaacacatggttcaaccagagttgtccccaaacattcaacaacttattgtaggtacacattaacataacttgaccatagcttgaagcaatgcatcatatgcatgtgaatggcatccatactagtagcagtgcaggcgtatcattttattcttctccttccatggcgacattggctcccatttcttccatcttagcaacaaccgaatcggcaagaatacaggggaaacaacaagtgttcttgcatattgtgtcggagccacctgcggcaatacaagcaaagcaacatgcttttgcccgggcgcttacgcagcagccacactgtgctgcggtggtcgagtgaacagcgatgctcaata

SEQ ID NO: 5781 - DNA, 20 bp, Artificial Sequence
  Artificially Synthesized Primer Sequence
aggctgtttctttgctggaa

SEQ ID NO: 5782 - DNA, 20 bp, Artificial Sequence
  Artificially Synthesized Primer Sequence
gtgtccacacctgccttttt

SEQ ID NO: 5783 - DNA, 20 bp, Artificial Sequence
  Artificially Synthesized Primer Sequence
tttccgggataagagtgtgc

SEQ ID NO: 5784 - DNA, 20 bp, Artificial Sequence
  Artificially Synthesized Primer Sequence
cgactcggttgtttgctaca

SEQ ID NO: 5785 - DNA, 20 bp, Artificial Sequence
  Artificially Synthesized Primer Sequence
gagggcacgacatggatagt

SEQ ID NO: 5786 - DNA, 20 bp, Artificial Sequence
  Artificially Synthesized Primer Sequence
atagtagcacaacaccgccc

SEQ ID NO: 5787 - DNA, 20 bp, Artificial Sequence
  Artificially Synthesized Primer Sequence
atagtagcacaacaccgccc

SEQ ID NO: 5788 - DNA, 20 bp, Artificial Sequence
  Artificially Synthesized Primer Sequence
gtgtggtggctacattggtg

SEQ ID NO: 5789 - DNA, 20 bp, Artificial Sequence
  Artificially Synthesized Primer Sequence
gattcggcacgagggtagta

SEQ ID NO: 5790 - DNA, 20 bp, Artificial Sequence
  Artificially Synthesized Primer Sequence
atttttgcaccgtgtcttcc

SEQ ID NO: 5791 - DNA, 20 bp, Artificial Sequence
  Artificially Synthesized Primer Sequence
cggacaatttggttgtttcc

SEQ ID NO: 5792 - DNA, 20 bp, Artificial Sequence
  Artificially Synthesized Primer Sequence
ggaagacacggtgcaaaaat

SEQ ID NO: 5793 - DNA, 20 bp, Artificial Sequence
  Artificially Synthesized Primer Sequence
tagtgaggtgcaggtgaacg

SEQ ID NO: 5794 - DNA, 20 bp, Artificial Sequence
  Artificially Synthesized Primer Sequence
ctatagggcgaattggggac

SEQ ID NO: 5795 - DNA, 20 bp, Artificial Sequence
  Artificially Synthesized Primer Sequence
tgtaccaggatccggcttat

SEQ ID NO: 5796 - DNA, 20 bp, Artificial Sequence
  Artificially Synthesized Primer Sequence
catccgtcaacagaattccc

SEQ ID NO: 5797 - DNA, 20 bp, Artificial Sequence
  Artificially Synthesized Primer Sequence
agtggatatcatgaagcccg

SEQ ID NO: 5798 - DNA, 20 bp, Artificial Sequence
  Artificially Synthesized Primer Sequence
gcttattgctttgctcagcc

SEQ ID NO: 5799 - DNA, 20 bp, Artificial Sequence
  Artificially Synthesized Primer Sequence
ctggtgccacaacacaatct

SEQ ID NO: 5800 - DNA, 20 bp, Artificial Sequence
  Artificially Synthesized Primer Sequence
agtggatatcatgaagcccg

SEQ ID NO: 5801 - DNA, 20 bp, Artificial Sequence
  Artificially Synthesized Primer Sequence
gcaaggctactactgccgac

SEQ ID NO: 5802 - DNA, 20 bp, Artificial Sequence
  Artificially Synthesized Primer Sequence
ccaagtgtgcccaactcttt

SEQ ID NO: 5803 - DNA, 20 bp, Artificial Sequence
  Artificially Synthesized Primer Sequence
acttatgcgccgtacaatcc

SEQ ID NO: 5804 - DNA, 20 bp, Artificial Sequence
  Artificially Synthesized Primer Sequence
gaggcaaatgccaaaggata

SEQ ID NO: 5805 - DNA, 20 bp, Artificial Sequence
  Artificially Synthesized Primer Sequence
aggaaaggaacaaatggcct

SEQ ID NO: 5806 - DNA, 20 bp, Artificial Sequence
  Artificially Synthesized Primer Sequence
gacgggatcctgctacgata

SEQ ID NO: 5807 - DNA, 20 bp, Artificial Sequence
  Artificially Synthesized Primer Sequence
caacggctttgaagaccact

SEQ ID NO: 5808 - DNA, 20 bp, Artificial Sequence
  Artificially Synthesized Primer Sequence
gatacaccctacccatcgga

SEQ ID NO: 5809 - DNA, 20 bp, Artificial Sequence
  Artificially Synthesized Primer Sequence
actcaagcaccaagcattcc

SEQ ID NO: 5810 - DNA, 20 bp, Artificial Sequence
  Artificially Synthesized Primer Sequence
cagggtgaagtaggggatga

SEQ ID NO: 5811 - DNA, 20 bp, Artificial Sequence
  Artificially Synthesized Primer Sequence
atcttcttcctcaccatcgc

SEQ ID NO: 5812 - DNA, 20 bp, Artificial Sequence
  Artificially Synthesized Primer Sequence
caccatgaagaatgtggtcg

SEQ ID NO: 5813 - DNA, 20 bp, Artificial Sequence
  Artificially Synthesized Primer Sequence
gcagatcaagaagaccaggc

SEQ ID NO: 5814 - DNA, 20 bp, Artificial Sequence
  Artificially Synthesized Primer Sequence
catatcggcttccaaagcat

SEQ ID NO: 5815 - DNA, 20 bp, Artificial Sequence
  Artificially Synthesized Primer Sequence
acaatgcggaggagacattc

SEQ ID NO: 5816 - DNA, 20 bp, Artificial Sequence
  Artificially Synthesized Primer Sequence
agatgacatcgacgaggagg

SEQ ID NO: 5817 - DNA, 20 bp, Artificial Sequence
  Artificially Synthesized Primer Sequence
tactgcatggactttttgcg

SEQ ID NO: 5818 - DNA, 20 bp, Artificial Sequence
  Artificially Synthesized Primer Sequence
aggggaatcaagggaagaga

SEQ ID NO: 5819 - DNA, 20 bp, Artificial Sequence
  Artificially Synthesized Primer Sequence
tacacatttccagcagcgac

SEQ ID NO: 5820 - DNA, 20 bp, Artificial Sequence
  Artificially Synthesized Primer Sequence
ccgtatgaggaacaggagga

SEQ ID NO: 5821 - DNA, 20 bp, Artificial Sequence
  Artificially Synthesized Primer Sequence
caacggtactggagggaaaa

SEQ ID NO: 5822 - DNA, 20 bp, Artificial Sequence
  Artificially Synthesized Primer Sequence
ccttacgatgtccatgcctt

SEQ ID NO: 5823 - DNA, 20 bp, Artificial Sequence
  Artificially Synthesized Primer Sequence
ccagagcaaaatccagatgc

SEQ ID NO: 5824 - DNA, 20 bp, Artificial Sequence
  Artificially Synthesized Primer Sequence
caacggtactggagggaaaa

SEQ ID NO: 5825 - DNA, 20 bp, Artificial Sequence
  Artificially Synthesized Primer Sequence
ggaaggtaaagggtgcttcc

SEQ ID NO: 5826 - DNA, 20 bp, Artificial Sequence
  Artificially Synthesized Primer Sequence
tacttggcagctcttccgtt

SEQ ID NO: 5827 - DNA, 20 bp, Artificial Sequence
  Artificially Synthesized Primer Sequence
tgccaagtgctcatcagttc

SEQ ID NO: 5828 - DNA, 20 bp, Artificial Sequence
  Artificially Synthesized Primer Sequence
ggatgggcttactggtcgta

SEQ ID NO: 5829 - DNA, 20 bp, Artificial Sequence
  Artificially Synthesized Primer Sequence
ccctcatcgctctctttgtc

SEQ ID NO: 5830 - DNA, 20 bp, Artificial Sequence
  Artificially Synthesized Primer Sequence
atctcccatagggggaattg

SEQ ID NO: 5831 - DNA, 20 bp, Artificial Sequence
  Artificially Synthesized Primer Sequence
aattacgcagggcaacaaag

SEQ ID NO: 5832 - DNA, 20 bp, Artificial Sequence
  Artificially Synthesized Primer Sequence
aagagggtgagggaggatgt

SEQ ID NO: 5833 - DNA, 20 bp, Artificial Sequence
  Artificially Synthesized Primer Sequence
gccattttcaccataccacc

SEQ ID NO: 5834 - DNA, 20 bp, Artificial Sequence
  Artificially Synthesized Primer Sequence
atgcatctgaatgcaggaca

SEQ ID NO: 5835 - DNA, 20 bp, Artificial Sequence
  Artificially Synthesized Primer Sequence
actgaccacacccatggact

SEQ ID NO: 5836 - DNA, 20 bp, Artificial Sequence
  Artificially Synthesized Primer Sequence
gccattttcaccataccacc

SEQ ID NO: 5837 - DNA, 20 bp, Artificial Sequence
  Artificially Synthesized Primer Sequence
acaagaggagcctcaggaca

SEQ ID NO: 5838 - DNA, 20 bp, Artificial Sequence
  Artificially Synthesized Primer Sequence
cagcttctccagcaccttct

SEQ ID NO: 5839 - DNA, 20 bp, Artificial Sequence
  Artificially Synthesized Primer Sequence
catcccgacagaagcaaaat

SEQ ID NO: 5840 - DNA, 20 bp, Artificial Sequence
  Artificially Synthesized Primer Sequence
tacctaccagtgacccctgc

SEQ ID NO: 5841 - DNA, 20 bp, Artificial Sequence
  Artificially Synthesized Primer Sequence
gatatttgatggtccgggtg

SEQ ID NO: 5842 - DNA, 20 bp, Artificial Sequence
  Artificially Synthesized Primer Sequence
agaggggccagttgattttt

SEQ ID NO: 5843 - DNA, 20 bp, Artificial Sequence
  Artificially Synthesized Primer Sequence
gaaaagccttctccatctgc

SEQ ID NO: 5844 - DNA, 20 bp, Artificial Sequence
  Artificially Synthesized Primer Sequence
ccttggtcagcagcattaca

SEQ ID NO: 5845 - DNA, 20 bp, Artificial Sequence
  Artificially Synthesized Primer Sequence
ggccatttttggtaagcaga

SEQ ID NO: 5846 - DNA, 20 bp, Artificial Sequence
  Artificially Synthesized Primer Sequence
tcggccttcaaagttctcat

SEQ ID NO: 5847 - DNA, 20 bp, Artificial Sequence
  Artificially Synthesized Primer Sequence
agctgaatccaacccaacac

SEQ ID NO: 5848 - DNA, 20 bp, Artificial Sequence
  Artificially Synthesized Primer Sequence
agtcgcagagccacaagttc

SEQ ID NO: 5849 - DNA, 20 bp, Artificial Sequence
  Artificially Synthesized Primer Sequence
cgtagctgcttcttgtgtcg

SEQ ID NO: 5850 - DNA, 20 bp, Artificial Sequence
  Artificially Synthesized Primer Sequence
gtttggcgattctggttgat

SEQ ID NO: 5851 - DNA, 20 bp, Artificial Sequence
  Artificially Synthesized Primer Sequence
gtttggcgattctggttgat

SEQ ID NO: 5852 - DNA, 19 bp, Artificial Sequence
  Artificially Synthesized Primer Sequence
agccatggagcctgctagt

SEQ ID NO: 5853 - DNA, 20 bp, Artificial Sequence
  Artificially Synthesized Primer Sequence
gccagtggaatttggaaaga

SEQ ID NO: 5854 - DNA, 20 bp, Artificial Sequence
  Artificially Synthesized Primer Sequence
tgagcgatttgccaatgtag

SEQ ID NO: 5855 - DNA, 20 bp, Artificial Sequence
  Artificially Synthesized Primer Sequence
tttcttcacccacttgaccc

SEQ ID NO: 5856 - DNA, 20 bp, Artificial Sequence
  Artificially Synthesized Primer Sequence
tcaggaagctgttgggtctt

SEQ ID NO: 5857 - DNA, 20 bp, Artificial Sequence
  Artificially Synthesized Primer Sequence
accagtagcaaggctgcaat

SEQ ID NO: 5858 - DNA, 20 bp, Artificial Sequence
  Artificially Synthesized Primer Sequence
ataacgaaagccaggtggtg

SEQ ID NO: 5859 - DNA, 20 bp, Artificial Sequence
  Artificially Synthesized Primer Sequence
atttgatgaagttgctccgc

SEQ ID NO: 5860 - DNA, 20 bp, Artificial Sequence
  Artificially Synthesized Primer Sequence
agatgaggtctcgtgatcgg

SEQ ID NO: 5861 - DNA, 20 bp, Artificial Sequence
  Artificially Synthesized Primer Sequence
tcgatgctgttgtgaaggag

SEQ ID NO: 5862 - DNA, 20 bp, Artificial Sequence
  Artificially Synthesized Primer Sequence
gtgtatccaacgatggggtc

SEQ ID NO: 5863 - DNA, 20 bp, Artificial Sequence
  Artificially Synthesized Primer Sequence
cctgcgatagtcgaaggaag

SEQ ID NO: 5864 - DNA, 20 bp, Artificial Sequence
  Artificially Synthesized Primer Sequence
tgtccacaaagctcaacgac

SEQ ID NO: 5865 - DNA, 20 bp, Artificial Sequence
  Artificially Synthesized Primer Sequence
ggcacgaggaagaagatgag

SEQ ID NO: 5866 - DNA, 20 bp, Artificial Sequence
  Artificially Synthesized Primer Sequence
acagggttgacaaacaagcc

SEQ ID NO: 5867 - DNA, 20 bp, Artificial Sequence
  Artificially Synthesized Primer Sequence
agtcgctaaacccagcttca

SEQ ID NO: 5868 - DNA, 20 bp, Artificial Sequence
  Artificially Synthesized Primer Sequence
gacatgttcgagtccatccc

SEQ ID NO: 5869 - DNA, 20 bp, Artificial Sequence
  Artificially Synthesized Primer Sequence
catggctatgagaggcaaca

SEQ ID NO: 5870 - DNA, 20 bp, Artificial Sequence
  Artificially Synthesized Primer Sequence
gcaatttccacaccgttctt

SEQ ID NO: 5871 - DNA, 20 bp, Artificial Sequence
  Artificially Synthesized Primer Sequence
tactggtcttggatgcgaca

SEQ ID NO: 5872 - DNA, 20 bp, Artificial Sequence
  Artificially Synthesized Primer Sequence
gcgccaaatctgatagcact

SEQ ID NO: 5873 - DNA, 20 bp, Artificial Sequence
  Artificially Synthesized Primer Sequence
caatgttcctgccatgtacg

SEQ ID NO: 5874 - DNA, 20 bp, Artificial Sequence
  Artificially Synthesized Primer Sequence
gtgaattccagaagacccca

SEQ ID NO: 5875 - DNA, 20 bp, Artificial Sequence
  Artificially Synthesized Primer Sequence
acaaatcaagccaacccaag

SEQ ID NO: 5876 - DNA, 20 bp, Artificial Sequence
  Artificially Synthesized Primer Sequence
ccaggtatcgctgaccgtat

SEQ ID NO: 5877 - DNA, 20 bp, Artificial Sequence
  Artificially Synthesized Primer Sequence
acatccaggctgtggtaagg

SEQ ID NO: 5878 - DNA, 20 bp, Artificial Sequence
  Artificially Synthesized Primer Sequence
tgtgcttggtttgtctgctc

SEQ ID NO: 5879 - DNA, 20 bp, Artificial Sequence
  Artificially Synthesized Primer Sequence
atcatcggcgttctggttac

SEQ ID NO: 5880 - DNA, 20 bp, Artificial Sequence
  Artificially Synthesized Primer Sequence
ctgtgggaaagcctacatcc

SEQ ID NO: 5881 - DNA, 20 bp, Artificial Sequence
  Artificially Synthesized Primer Sequence
tgcatgcatcatacagggtt

SEQ ID NO: 5882 - DNA, 20 bp, Artificial Sequence
  Artificially Synthesized Primer Sequence
gaggatgaggatcattccga

SEQ ID NO: 5883 - DNA, 20 bp, Artificial Sequence
  Artificially Synthesized Primer Sequence
aattacagatggagggcgtg

SEQ ID NO: 5884 - DNA, 20 bp, Artificial Sequence
  Artificially Synthesized Primer Sequence
tcggaatgatcctcatcctc

SEQ ID NO: 5885 - DNA, 20 bp, Artificial Sequence
  Artificially Synthesized Primer Sequence
ctgaacgaggtgagggagag

SEQ ID NO: 5886 - DNA, 20 bp, Artificial Sequence
  Artificially Synthesized Primer Sequence
cgaagagatgcctgaccttc

SEQ ID NO: 5887 - DNA, 20 bp, Artificial Sequence
  Artificially Synthesized Primer Sequence
attgcagttttggcaactcc

SEQ ID NO: 5888 - DNA, 20 bp, Artificial Sequence
  Artificially Synthesized Primer Sequence
cagacaactgcacaccacct

SEQ ID NO: 5889 - DNA, 20 bp, Artificial Sequence
  Artificially Synthesized Primer Sequence
tatcttttcaaccgatcccg

SEQ ID NO: 5890 - DNA, 20 bp, Artificial Sequence
  Artificially Synthesized Primer Sequence
ttgcagtcgcattcttatcg

SEQ ID NO: 5891 - DNA, 20 bp, Artificial Sequence
  Artificially Synthesized Primer Sequence
tgcagtcgcattctttatcg

SEQ ID NO: 5892 - DNA, 20 bp, Artificial Sequence
  Artificially Synthesized Primer Sequence
ggttatattgcggtccgaga

SEQ ID NO: 5893 - DNA, 20 bp, Artificial Sequence
  Artificially Synthesized Primer Sequence
agtgcccctgagttgctaga

SEQ ID NO: 5894 - DNA, 20 bp, Artificial Sequence
  Artificially Synthesized Primer Sequence
tttgtacatgctgctcctgc

SEQ ID NO: 5895 - DNA, 20 bp, Artificial Sequence
  Artificially Synthesized Primer Sequence
gaacgacaaagatgatggca

SEQ ID NO: 5896 - DNA, 20 bp, Artificial Sequence
  Artificially Synthesized Primer Sequence
cattgattgacaccaccagc

SEQ ID NO: 5897 - DNA, 20 bp, Artificial Sequence
  Artificially Synthesized Primer Sequence
cacctacaggttctgcgaca

SEQ ID NO: 5898 - DNA, 20 bp, Artificial Sequence
  Artificially Synthesized Primer Sequence
ttcccagcaaagttcaggtc

SEQ ID NO: 5899 - DNA, 20 bp, Artificial Sequence
  Artificially Synthesized Primer Sequence
cgaaacaaggatgggagaag

SEQ ID NO: 5900 - DNA, 20 bp, Artificial Sequence
  Artificially Synthesized Primer Sequence
acaagtctatgacggaggcg

SEQ ID NO: 5901 - DNA, 20 bp, Artificial Sequence
  Artificially Synthesized Primer Sequence
tcactatagggcgaattggg

SEQ ID NO: 5902 - DNA, 20 bp, Artificial Sequence
  Artificially Synthesized Primer Sequence
tcagcagcaggatgaatgag

SEQ ID NO: 5903 - DNA, 20 bp, Artificial Sequence
  Artificially Synthesized Primer Sequence
tacaacttcaagatccccgc

SEQ ID NO: 5904 - DNA, 20 bp, Artificial Sequence
  Artificially Synthesized Primer Sequence
ggatggctatgtcgcttgat

SEQ ID NO: 5905 - DNA, 20 bp, Artificial Sequence
  Artificially Synthesized Primer Sequence
cccctaaaaatgtggaaccc

SEQ ID NO: 5906 - DNA, 20 bp, Artificial Sequence
  Artificially Synthesized Primer Sequence
ttatacccacctccacaccc

SEQ ID NO: 5907 - DNA, 20 bp, Artificial Sequence
  Artificially Synthesized Primer Sequence
catagggctgtccgtttgtt

SEQ ID NO: 5908 - DNA, 20 bp, Artificial Sequence
  Artificially Synthesized Primer Sequence
caagtttgatatcgagcgca

SEQ ID NO: 5909 - DNA, 20 bp, Artificial Sequence
  Artificially Synthesized Primer Sequence
tccaccgtgattcttccttc

SEQ ID NO: 5910 - DNA, 20 bp, Artificial Sequence
  Artificially Synthesized Primer Sequence
cagcatcgcaatagtggcta

SEQ ID NO: 5911 - DNA, 20 bp, Artificial Sequence
  Artificially Synthesized Primer Sequence
ggcacacatttaccaagtgc

SEQ ID NO: 5912 - DNA, 20 bp, Artificial Sequence
  Artificially Synthesized Primer Sequence
catccatcaacgtcctcctc

SEQ ID NO: 5913 - DNA, 20 bp, Artificial Sequence
  Artificially Synthesized Primer Sequence
atctatgacattggcctcgg

SEQ ID NO: 5914 - DNA, 20 bp, Artificial Sequence
  Artificially Synthesized Primer Sequence
acagcgaaagcaagaatcgt

SEQ ID NO: 5915 - DNA, 20 bp, Artificial Sequence
  Artificially Synthesized Primer Sequence
caagcaaatcctcactgcaa

SEQ ID NO: 5916 - DNA, 20 bp, Artificial Sequence
  Artificially Synthesized Primer Sequence
gacctcaagtcgtacctggc

SEQ ID NO: 5917 - DNA, 20 bp, Artificial Sequence
  Artificially Synthesized Primer Sequence
ccttcgcgttggtaattgtt

SEQ ID NO: 5918 - DNA, 20 bp, Artificial Sequence
  Artificially Synthesized Primer Sequence
ttttgcctttgcatagggtc

SEQ ID NO: 5919 - DNA, 20 bp, Artificial Sequence
  Artificially Synthesized Primer Sequence
gggaattttctccgtttggt

SEQ ID NO: 5920 - DNA, 20 bp, Artificial Sequence
  Artificially Synthesized Primer Sequence
aggtgctagacggtttccct

SEQ ID NO: 5921 - DNA, 20 bp, Artificial Sequence
  Artificially Synthesized Primer Sequence
aatgttgttcctgaatcccg

SEQ ID NO: 5922 - DNA, 20 bp, Artificial Sequence
  Artificially Synthesized Primer Sequence
gagagaaggaggggagagga

SEQ ID NO: 5923 - DNA, 21 bp, Artificial Sequence
  Artificially Synthesized Primer Sequence
tcatgctgaattgacctaccc

SEQ ID NO: 5924 - DNA, 20 bp, Artificial Sequence
  Artificially Synthesized Primer Sequence
gccatttcctctggcataat

SEQ ID NO: 5925 - DNA, 20 bp, Artificial Sequence
  Artificially Synthesized Primer Sequence
ggcacatctcctgggaacta

SEQ ID NO: 5926 - DNA, 20 bp, Artificial Sequence
  Artificially Synthesized Primer Sequence
cccatcctcatgctcattct

SEQ ID NO: 5927 - DNA, 20 bp, Artificial Sequence
  Artificially Synthesized Primer Sequence
tgtgagcactaaagccatcg

SEQ ID NO: 5928 - DNA, 20 bp, Artificial Sequence
  Artificially Synthesized Primer Sequence
atcaaggatcacaagtcggc

SEQ ID NO: 5929 - DNA, 20 bp, Artificial Sequence
  Artificially Synthesized Primer Sequence
tttctggtcccgagcttcta

SEQ ID NO: 5930 - DNA, 20 bp, Artificial Sequence
  Artificially Synthesized Primer Sequence
taggatgtccctgcttcacc

SEQ ID NO: 5931 - DNA, 20 bp, Artificial Sequence
  Artificially Synthesized Primer Sequence
ggatgtccttgcttcaccat

SEQ ID NO: 5932 - DNA, 20 bp, Artificial Sequence
  Artificially Synthesized Primer Sequence
tttctggtcccgagcttcta

SEQ ID NO: 5933 - DNA, 20 bp, Artificial Sequence
  Artificially Synthesized Primer Sequence
gatggagaccaccatgacct

SEQ ID NO: 5934 - DNA, 20 bp, Artificial Sequence
  Artificially Synthesized Primer Sequence
ggaggtggacatcgtcaaat

SEQ ID NO: 5935 - DNA, 20 bp, Artificial Sequence
  Artificially Synthesized Primer Sequence
ggtgacatcatcgtccacac

SEQ ID NO: 5936 - DNA, 20 bp, Artificial Sequence
  Artificially Synthesized Primer Sequence
ccgtgctgcagaactacaaa

SEQ ID NO: 5937 - DNA, 20 bp, Artificial Sequence
  Artificially Synthesized Primer Sequence
acaactatgcgacccgaatc

SEQ ID NO: 5938 - DNA, 20 bp, Artificial Sequence
  Artificially Synthesized Primer Sequence
ctgtacacgtcgctgttcgt

SEQ ID NO: 5939 - DNA, 20 bp, Artificial Sequence
  Artificially Synthesized Primer Sequence
tcgcagatcgcctctaaaac

SEQ ID NO: 5940 - DNA, 20 bp, Artificial Sequence
  Artificially Synthesized Primer Sequence
gaccgtacctgacgagcaag

SEQ ID NO: 5941 - DNA, 20 bp, Artificial Sequence
  Artificially Synthesized Primer Sequence
gcagaaggagagatggcaac

SEQ ID NO: 5942 - DNA, 20 bp, Artificial Sequence
  Artificially Synthesized Primer Sequence
cccagctttcaggagacaag

SEQ ID NO: 5943 - DNA, 20 bp, Artificial Sequence
  Artificially Synthesized Primer Sequence
tgacaaaaggctacgcactg

SEQ ID NO: 5944 - DNA, 20 bp, Artificial Sequence
  Artificially Synthesized Primer Sequence
aaccataatcctgcaaacgc

SEQ ID NO: 5945 - DNA, 20 bp, Artificial Sequence
  Artificially Synthesized Primer Sequence
tttacccaacaaaaatgggg

SEQ ID NO: 5946 - DNA, 20 bp, Artificial Sequence
  Artificially Synthesized Primer Sequence
ctaaggtggggaccaaaacc

SEQ ID NO: 5947 - DNA, 20 bp, Artificial Sequence
  Artificially Synthesized Primer Sequence
ctagcatttctcgtcgggat

SEQ ID NO: 5948 - DNA, 20 bp, Artificial Sequence
  Artificially Synthesized Primer Sequence
tcaccgtgttcatgctgatt

SEQ ID NO: 5949 - DNA, 20 bp, Artificial Sequence
  Artificially Synthesized Primer Sequence
gtgcaaggagggtgcatatt

SEQ ID NO: 5950 - DNA, 20 bp, Artificial Sequence
  Artificially Synthesized Primer Sequence
ccagttgcaatgcctcctat

SEQ ID NO: 5951 - DNA, 20 bp, Artificial Sequence
  Artificially Synthesized Primer Sequence
tgtccgataaaaacatcgcc

SEQ ID NO: 5952 - DNA, 20 bp, Artificial Sequence
  Artificially Synthesized Primer Sequence
gtgcaaggagggtgcatatt

SEQ ID NO: 5953 - DNA, 20 bp, Artificial Sequence
  Artificially Synthesized Primer Sequence
tggccaacagtcatgtcatt

SEQ ID NO: 5954 - DNA, 20 bp, Artificial Sequence
  Artificially Synthesized Primer Sequence
caagggaaacatcggagaaa

SEQ ID NO: 5955 - DNA, 20 bp, Artificial Sequence
  Artificially Synthesized Primer Sequence
aagagcacaaatgaaacggc

SEQ ID NO: 5956 - DNA, 20 bp, Artificial Sequence
  Artificially Synthesized Primer Sequence
cacctcgatgaagaaggagc

SEQ ID NO: 5957 - DNA, 20 bp, Artificial Sequence
  Artificially Synthesized Primer Sequence
tgtgaaccgtggacctgata

SEQ ID NO: 5958 - DNA, 20 bp, Artificial Sequence
  Artificially Synthesized Primer Sequence
aggctgtttgacaagggaaa

SEQ ID NO: 5959 - DNA, 20 bp, Artificial Sequence
  Artificially Synthesized Primer Sequence
aacatgcatggtgacaagga

SEQ ID NO: 5960 - DNA, 20 bp, Artificial Sequence
  Artificially Synthesized Primer Sequence
aagggcttcgtcaatgtttg

SEQ ID NO: 5961 - DNA, 20 bp, Artificial Sequence
  Artificially Synthesized Primer Sequence
acgagggctcctcttctttc

SEQ ID NO: 5962 - DNA, 20 bp, Artificial Sequence
  Artificially Synthesized Primer Sequence
tactgagggtgaggactggc

SEQ ID NO: 5963 - DNA, 20 bp, Artificial Sequence
  Artificially Synthesized Primer Sequence
aaggtgcagaaccgaaacag

SEQ ID NO: 5964 - DNA, 20 bp, Artificial Sequence
  Artificially Synthesized Primer Sequence
catcatcaccaagatcaccg

SEQ ID NO: 5965 - DNA, 20 bp, Artificial Sequence
  Artificially Synthesized Primer Sequence
cgtcattggaggatggagac

SEQ ID NO: 5966 - DNA, 20 bp, Artificial Sequence
  Artificially Synthesized Primer Sequence
ttgctatgcaagacatcacg

SEQ ID NO: 5967 - DNA, 21 bp, Artificial Sequence
  Artificially Synthesized Primer Sequence
gcaagacatcacgtgtgctac

SEQ ID NO: 5968 - DNA, 20 bp, Artificial Sequence
  Artificially Synthesized Primer Sequence
cattggaggatggagaccag

SEQ ID NO: 5969 - DNA, 20 bp, Artificial Sequence
  Artificially Synthesized Primer Sequence
agagcagagcaggaagcaag

SEQ ID NO: 5970 - DNA, 20 bp, Artificial Sequence
  Artificially Synthesized Primer Sequence
catcgagctccctcttgaac

SEQ ID NO: 5971 - DNA, 20 bp, Artificial Sequence
  Artificially Synthesized Primer Sequence
agagcgctaaatcctcatcg

SEQ ID NO: 5972 - DNA, 20 bp, Artificial Sequence
  Artificially Synthesized Primer Sequence
ccaccgcttcatcatctaca

SEQ ID NO: 5973 - DNA, 20 bp, Artificial Sequence
  Artificially Synthesized Primer Sequence
gtgactaccccaaatgcgac

SEQ ID NO: 5974 - DNA, 20 bp, Artificial Sequence
  Artificially Synthesized Primer Sequence
taaccagctcgctattgcct

SEQ ID NO: 5975 - DNA, 20 bp, Artificial Sequence
  Artificially Synthesized Primer Sequence
tttctgtcacggacccattt

SEQ ID NO: 5976 - DNA, 20 bp, Artificial Sequence
  Artificially Synthesized Primer Sequence
catcgtcaggctccgtaaac

SEQ ID NO: 5977 - DNA, 20 bp, Artificial Sequence
  Artificially Synthesized Primer Sequence
ggtggttgtccctttgaaga

SEQ ID NO: 5978 - DNA, 20 bp, Artificial Sequence
  Artificially Synthesized Primer Sequence
aaacgggggatatccagaac

SEQ ID NO: 5979 - DNA, 20 bp, Artificial Sequence
  Artificially Synthesized Primer Sequence
actgcaccaccagaacacac

SEQ ID NO: 5980 - DNA, 20 bp, Artificial Sequence
  Artificially Synthesized Primer Sequence
tggcagtagtaaggcctcgt

SEQ ID NO: 5981 - DNA, 20 bp, Artificial Sequence
  Artificially Synthesized Primer Sequence
ccacgtcgtcgtgtcaatac

SEQ ID NO: 5982 - DNA, 20 bp, Artificial Sequence
  Artificially Synthesized Primer Sequence
ttaaccctacaccccttccc

SEQ ID NO: 5983 - DNA, 20 bp, Artificial Sequence
  Artificially Synthesized Primer Sequence
ccacgtcgtcgtgtcaatac

SEQ ID NO: 5984 - DNA, 20 bp, Artificial Sequence
  Artificially Synthesized Primer Sequence
ccaccacaccagacattgaa

SEQ ID NO: 5985 - DNA, 20 bp, Artificial Sequence
  Artificially Synthesized Primer Sequence
tacgtcctgcagatcgtttg

SEQ ID NO: 5986 - DNA, 20 bp, Artificial Sequence
  Artificially Synthesized Primer Sequence
tgtcgctgttctctttgcac

SEQ ID NO: 5987 - DNA, 20 bp, Artificial Sequence
  Artificially Synthesized Primer Sequence
tgtcgctgttctctttgcac

SEQ ID NO: 5988 - DNA, 20 bp, Artificial Sequence
  Artificially Synthesized Primer Sequence
tacgtcctgcagatcgtttg

SEQ ID NO: 5989 - DNA, 20 bp, Artificial Sequence
  Artificially Synthesized Primer Sequence
agcctgcatcaataaggtgg

SEQ ID NO: 5990 - DNA, 20 bp, Artificial Sequence
  Artificially Synthesized Primer Sequence
tgtacccgtacctcgtgaca

SEQ ID NO: 5991 - DNA, 20 bp, Artificial Sequence
  Artificially Synthesized Primer Sequence
tctggcctacgttgagaagg

SEQ ID NO: 5992 - DNA, 20 bp, Artificial Sequence
  Artificially Synthesized Primer Sequence
gcaaaaggtccagagatcca

SEQ ID NO: 5993 - DNA, 20 bp, Artificial Sequence
  Artificially Synthesized Primer Sequence
aaggctggtgactggaagaa

SEQ ID NO: 5994 - DNA, 20 bp, Artificial Sequence
  Artificially Synthesized Primer Sequence
cgaagggctgtcaccattat

SEQ ID NO: 5995 - DNA, 20 bp, Artificial Sequence
  Artificially Synthesized Primer Sequence
aaggcatcgagcaacaaaat

SEQ ID NO: 5996 - DNA, 20 bp, Artificial Sequence
  Artificially Synthesized Primer Sequence
gataatggtgacagccctcg

SEQ ID NO: 5997 - DNA, 20 bp, Artificial Sequence
  Artificially Synthesized Primer Sequence
tcctcagcatggataccctc

SEQ ID NO: 5998 - DNA, 20 bp, Artificial Sequence
  Artificially Synthesized Primer Sequence
tgttggtgatccagccacta

SEQ ID NO: 5999 - DNA, 20 bp, Artificial Sequence
  Artificially Synthesized Primer Sequence
catctcaaaggctttccctg

SEQ ID NO: 6000 - DNA, 20 bp, Artificial Sequence
  Artificially Synthesized Primer Sequence
ctaccctggctcatctggtc

SEQ ID NO: 6001 - DNA, 20 bp, Artificial Sequence
  Artificially Synthesized Primer Sequence
aattcctcgagcactgttgg

SEQ ID NO: 6002 - DNA, 20 bp, Artificial Sequence
  Artificially Synthesized Primer Sequence
gaggaagtcgatgatgaggc

SEQ ID NO: 6003 - DNA, 20 bp, Artificial Sequence
  Artificially Synthesized Primer Sequence
atctgctatcagccccaaaa

SEQ ID NO: 6004 - DNA, 19 bp, Artificial Sequence
  Artificially Synthesized Primer Sequence
gagctgccagtctccgaat

SEQ ID NO: 6005 - DNA, 20 bp, Artificial Sequence
  Artificially Synthesized Primer Sequence
ccacacagccaagccttaat

SEQ ID NO: 6006 - DNA, 20 bp, Artificial Sequence
  Artificially Synthesized Primer Sequence
atactcagttgcaccccagc

SEQ ID NO: 6007 - DNA, 20 bp, Artificial Sequence
  Artificially Synthesized Primer Sequence
gcgctgagaggaagaagaag

SEQ ID NO: 6008 - DNA, 20 bp, Artificial Sequence
  Artificially Synthesized Primer Sequence
tgaagtgaggcctggagaac

SEQ ID NO: 6009 - DNA, 20 bp, Artificial Sequence
  Artificially Synthesized Primer Sequence
ctctttccctcgtgtcgaag

SEQ ID NO: 6010 - DNA, 20 bp, Artificial Sequence
  Artificially Synthesized Primer Sequence
aagctaaacaagcaagccca

SEQ ID NO: 6011 - DNA, 20 bp, Artificial Sequence
  Artificially Synthesized Primer Sequence
aaaacagggaatattggggc

SEQ ID NO: 6012 - DNA, 20 bp, Artificial Sequence
  Artificially Synthesized Primer Sequence
gaactgaggcgtgcacataa

SEQ ID NO: 6013 - DNA, 20 bp, Artificial Sequence
  Artificially Synthesized Primer Sequence
aacacgcacgctgtcattag

SEQ ID NO: 6014 - DNA, 20 bp, Artificial Sequence
  Artificially Synthesized Primer Sequence
tggtgctaggggataaatcg

SEQ ID NO: 6015 - DNA, 20 bp, Artificial Sequence
  Artificially Synthesized Primer Sequence
aagtaggcgtgaaaccaacg

SEQ ID NO: 6016 - DNA, 20 bp, Artificial Sequence
  Artificially Synthesized Primer Sequence
gctcacgtttggaggatgat

SEQ ID NO: 6017 - DNA, 20 bp, Artificial Sequence
  Artificially Synthesized Primer Sequence
agtcgcaaaagcccaaatta

SEQ ID NO: 6018 - DNA, 20 bp, Artificial Sequence
  Artificially Synthesized Primer Sequence
ctcctttccccctttttgtc

SEQ ID NO: 6019 - DNA, 20 bp, Artificial Sequence
  Artificially Synthesized Primer Sequence
cttggccttgatcttctgct

SEQ ID NO: 6020 - DNA, 20 bp, Artificial Sequence
  Artificially Synthesized Primer Sequence
gaccgtgtcaggaaagcaat

SEQ ID NO: 6021 - DNA, 20 bp, Artificial Sequence
  Artificially Synthesized Primer Sequence
atgaggatgcagccagagat

SEQ ID NO: 6022 - DNA, 20 bp, Artificial Sequence
  Artificially Synthesized Primer Sequence
ggcagcatgggaaatacagt

SEQ ID NO: 6023 - DNA, 20 bp, Artificial Sequence
  Artificially Synthesized Primer Sequence
ggcagcatgggaaatacagt

SEQ ID NO: 6024 - DNA, 20 bp, Artificial Sequence
  Artificially Synthesized Primer Sequence
ggccaatcatatcccctctt

SEQ ID NO: 6025 - DNA, 20 bp, Artificial Sequence
  Artificially Synthesized Primer Sequence
gacgctccatacatgcacac

SEQ ID NO: 6026 - DNA, 20 bp, Artificial Sequence
  Artificially Synthesized Primer Sequence
ctactcgacacgctttcacg

SEQ ID NO: 6027 - DNA, 20 bp, Artificial Sequence
  Artificially Synthesized Primer Sequence
ggaggagatcgtcagttcgt

SEQ ID NO: 6028 - DNA, 20 bp, Artificial Sequence
  Artificially Synthesized Primer Sequence
aggtggaggtgggtaagctc

SEQ ID NO: 6029 - DNA, 20 bp, Artificial Sequence
  Artificially Synthesized Primer Sequence
tgtggtggctttatcatgga

SEQ ID NO: 6030 - DNA, 20 bp, Artificial Sequence
  Artificially Synthesized Primer Sequence
catcatggccaactcaactg

SEQ ID NO: 6031 - DNA, 20 bp, Artificial Sequence
  Artificially Synthesized Primer Sequence
ttgggtcttctcaaccttgg

SEQ ID NO: 6032 - DNA, 20 bp, Artificial Sequence
  Artificially Synthesized Primer Sequence
atcacccaagaactgaagcg

SEQ ID NO: 6033 - DNA, 20 bp, Artificial Sequence
  Artificially Synthesized Primer Sequence
ggatatcgccaccaaagaga

SEQ ID NO: 6034 - DNA, 20 bp, Artificial Sequence
  Artificially Synthesized Primer Sequence
tttatccgcgaaagcaaact

SEQ ID NO: 6035 - DNA, 20 bp, Artificial Sequence
  Artificially Synthesized Primer Sequence
tggttgcatccctaagcatt

SEQ ID NO: 6036 - DNA, 19 bp, Artificial Sequence
  Artificially Synthesized Primer Sequence
gacatggtcgacatccacg

SEQ ID NO: 6037 - DNA, 20 bp, Artificial Sequence
  Artificially Synthesized Primer Sequence
agggtcatgtcctacaacgc

SEQ ID NO: 6038 - DNA, 20 bp, Artificial Sequence
  Artificially Synthesized Primer Sequence
ttgtagctgacggtgtttgg

SEQ ID NO: 6039 - DNA, 20 bp, Artificial Sequence
  Artificially Synthesized Primer Sequence
ccgcatcgaataagacatca

SEQ ID NO: 6040 - DNA, 20 bp, Artificial Sequence
  Artificially Synthesized Primer Sequence
aaaggcgcgagacacatagt

SEQ ID NO: 6041 - DNA, 20 bp, Artificial Sequence
  Artificially Synthesized Primer Sequence
ctccaaacagcatgaaacga

SEQ ID NO: 6042 - DNA, 20 bp, Artificial Sequence
  Artificially Synthesized Primer Sequence
agcacacgaaatgatgtcca

SEQ ID NO: 6043 - DNA, 20 bp, Artificial Sequence
  Artificially Synthesized Primer Sequence
agcgacgaaattcatcaagg

SEQ ID NO: 6044 - DNA, 20 bp, Artificial Sequence
  Artificially Synthesized Primer Sequence
aacagcatggagcgaaaagt

SEQ ID NO: 6045 - DNA, 20 bp, Artificial Sequence
  Artificially Synthesized Primer Sequence
cagaacttgaagcaatggca

SEQ ID NO: 6046 - DNA, 20 bp, Artificial Sequence
  Artificially Synthesized Primer Sequence
tcaccaaggatcctcctgac

SEQ ID NO: 6047 - DNA, 20 bp, Artificial Sequence
  Artificially Synthesized Primer Sequence
tggtgttttacatttcggca

SEQ ID NO: 6048 - DNA, 20 bp, Artificial Sequence
  Artificially Synthesized Primer Sequence
gaagccatcattggaggaaa

SEQ ID NO: 6049 - DNA, 20 bp, Artificial Sequence
  Artificially Synthesized Primer Sequence
gacagcaaggctcaggtttc

SEQ ID NO: 6050 - DNA, 20 bp, Artificial Sequence
  Artificially Synthesized Primer Sequence
acataaccacaaccgccatt

SEQ ID NO: 6051 - DNA, 20 bp, Artificial Sequence
  Artificially Synthesized Primer Sequence
tttacacacgccaccaacat

SEQ ID NO: 6052 - DNA, 20 bp, Artificial Sequence
  Artificially Synthesized Primer Sequence
caagggtgggtatagcagga

SEQ ID NO: 6053 - DNA, 20 bp, Artificial Sequence
  Artificially Synthesized Primer Sequence
cctagctgggacaaaggaca

SEQ ID NO: 6054 - DNA, 20 bp, Artificial Sequence
  Artificially Synthesized Primer Sequence
gatacggtggagcttgttgg

SEQ ID NO: 6055 - DNA, 20 bp, Artificial Sequence
  Artificially Synthesized Primer Sequence
tctttcctgggttggtgaac

SEQ ID NO: 6056 - DNA, 20 bp, Artificial Sequence
  Artificially Synthesized Primer Sequence
gcagcttttgagttcgttcc

SEQ ID NO: 6057 - DNA, 20 bp, Artificial Sequence
  Artificially Synthesized Primer Sequence
caaggtgatcgggaacaagt

SEQ ID NO: 6058 - DNA, 20 bp, Artificial Sequence
  Artificially Synthesized Primer Sequence
gaggatcatggcaaaccact

SEQ ID NO: 6059 - DNA, 20 bp, Artificial Sequence
  Artificially Synthesized Primer Sequence
catgttcaacacttggagcg

SEQ ID NO: 6060 - DNA, 20 bp, Artificial Sequence
  Artificially Synthesized Primer Sequence
ggaggtgcaaagtgtcaggt

SEQ ID NO: 6061 - DNA, 20 bp, Artificial Sequence
  Artificially Synthesized Primer Sequence
acctctccccgattcagtct

SEQ ID NO: 6062 - DNA, 20 bp, Artificial Sequence
  Artificially Synthesized Primer Sequence
gactcatcgttgtcgtccct

SEQ ID NO: 6063 - DNA, 20 bp, Artificial Sequence
  Artificially Synthesized Primer Sequence
caacccagctacagggtgat

SEQ ID NO: 6064 - DNA, 20 bp, Artificial Sequence
  Artificially Synthesized Primer Sequence
cgtcatgtgcgttcacctac

SEQ ID NO: 6065 - DNA, 20 bp, Artificial Sequence
  Artificially Synthesized Primer Sequence
ccgtcagtcccaagctacat

SEQ ID NO: 6066 - DNA, 20 bp, Artificial Sequence
  Artificially Synthesized Primer Sequence
catggaccgacagatgacac

SEQ ID NO: 6067 - DNA, 20 bp, Artificial Sequence
  Artificially Synthesized Primer Sequence
catggaccgacagatgacac

SEQ ID NO: 6068 - DNA, 20 bp, Artificial Sequence
  Artificially Synthesized Primer Sequence
agtgcagagacgacaccaga

SEQ ID NO: 6069 - DNA, 20 bp, Artificial Sequence
  Artificially Synthesized Primer Sequence
tgagaaagtagatggcggct

SEQ ID NO: 6070 - DNA, 20 bp, Artificial Sequence
  Artificially Synthesized Primer Sequence
gtctgccattttcccctgta

SEQ ID NO: 6071 - DNA, 20 bp, Artificial Sequence
  Artificially Synthesized Primer Sequence
aaatcctgctcacctcctcc

SEQ ID NO: 6072 - DNA, 20 bp, Artificial Sequence
  Artificially Synthesized Primer Sequence
tacaggggaaaatggcagac

SEQ ID NO: 6073 - DNA, 20 bp, Artificial Sequence
  Artificially Synthesized Primer Sequence
aaacattgcgccctataacg

SEQ ID NO: 6074 - DNA, 20 bp, Artificial Sequence
  Artificially Synthesized Primer Sequence
cacgtgcggaacatcatatc

SEQ ID NO: 6075 - DNA, 20 bp, Artificial Sequence
  Artificially Synthesized Primer Sequence
catcaggggaaggtgaaaaa

SEQ ID NO: 6076 - DNA, 20 bp, Artificial Sequence
  Artificially Synthesized Primer Sequence
caaggaggttggtttcctga

SEQ ID NO: 6077 - DNA, 20 bp, Artificial Sequence
  Artificially Synthesized Primer Sequence
aagtggaacaagtgggcaac

SEQ ID NO: 6078 - DNA, 20 bp, Artificial Sequence
  Artificially Synthesized Primer Sequence
tgtgtagcctgctttcatgc

SEQ ID NO: 6079 - DNA, 20 bp, Artificial Sequence
  Artificially Synthesized Primer Sequence
actccggcatgtgacctaac

SEQ ID NO: 6080 - DNA, 20 bp, Artificial Sequence
  Artificially Synthesized Primer Sequence
aggggagtatgtcgcagttg

SEQ ID NO: 6081 - DNA, 20 bp, Artificial Sequence
  Artificially Synthesized Primer Sequence
ctgtgtcttttgctgccgta

SEQ ID NO: 6082 - DNA, 20 bp, Artificial Sequence
  Artificially Synthesized Primer Sequence
ccgccagaaaatattggaaa

SEQ ID NO: 6083 - DNA, 20 bp, Artificial Sequence
  Artificially Synthesized Primer Sequence
ctaaagcacttgagcgagcc

SEQ ID NO: 6084 - DNA, 20 bp, Artificial Sequence
  Artificially Synthesized Primer Sequence
cggtagctccttgaagatgg

SEQ ID NO: 6085 - DNA, 20 bp, Artificial Sequence
  Artificially Synthesized Primer Sequence
cagaggtgcagcaatcaaaa

SEQ ID NO: 6086 - DNA, 20 bp, Artificial Sequence
  Artificially Synthesized Primer Sequence
tcatggcatatcaggtgcat

SEQ ID NO: 6087 - DNA, 20 bp, Artificial Sequence
  Artificially Synthesized Primer Sequence
tgtacaaaaaccgcctgtca

SEQ ID NO: 6088 - DNA, 20 bp, Artificial Sequence
  Artificially Synthesized Primer Sequence
cgaccatacattaccgaggg

SEQ ID NO: 6089 - DNA, 20 bp, Artificial Sequence
  Artificially Synthesized Primer Sequence
acagtctccagccttccaga

SEQ ID NO: 6090 - DNA, 20 bp, Artificial Sequence
  Artificially Synthesized Primer Sequence
tggtgcgacgagcagtatag

SEQ ID NO: 6091 - DNA, 20 bp, Artificial Sequence
  Artificially Synthesized Primer Sequence
aatgtacaaaaaccgcctgc

SEQ ID NO: 6092 - DNA, 20 bp, Artificial Sequence
  Artificially Synthesized Primer Sequence
tgactgggaggaaacctgtc

SEQ ID NO: 6093 - DNA, 20 bp, Artificial Sequence
  Artificially Synthesized Primer Sequence
aagtttgatggcatccttgg

SEQ ID NO: 6094 - DNA, 20 bp, Artificial Sequence
  Artificially Synthesized Primer Sequence
tgggccaaaaaccagtagag

SEQ ID NO: 6095 - DNA, 20 bp, Artificial Sequence
  Artificially Synthesized Primer Sequence
atcaacggtttacagcaggg

SEQ ID NO: 6096 - DNA, 20 bp, Artificial Sequence
  Artificially Synthesized Primer Sequence
gctgtgtgagcgtctaccaa

SEQ ID NO: 6097 - DNA, 20 bp, Artificial Sequence
  Artificially Synthesized Primer Sequence
gttggcctactcatcccaaa

SEQ ID NO: 6098 - DNA, 20 bp, Artificial Sequence
  Artificially Synthesized Primer Sequence
gccataaacaattccgtgct

SEQ ID NO: 6099 - DNA, 20 bp, Artificial Sequence
  Artificially Synthesized Primer Sequence
aggaacgcagacaagcatct

SEQ ID NO: 6100 - DNA, 20 bp, Artificial Sequence
  Artificially Synthesized Primer Sequence
atgactccaagagcaaagcg

SEQ ID NO: 6101 - DNA, 20 bp, Artificial Sequence
  Artificially Synthesized Primer Sequence
aagtcatccgtggacctctg

SEQ ID NO: 6102 - DNA, 20 bp, Artificial Sequence
  Artificially Synthesized Primer Sequence
tcccctacactcttgccatc

SEQ ID NO: 6103 - DNA, 20 bp, Artificial Sequence
  Artificially Synthesized Primer Sequence
gcagctcacagtttcaccaa

SEQ ID NO: 6104 - DNA, 20 bp, Artificial Sequence
  Artificially Synthesized Primer Sequence
aggatgagagcagctggaaa

SEQ ID NO: 6105 - DNA, 20 bp, Artificial Sequence
  Artificially Synthesized Primer Sequence
ctccaaaactggaacttggg

SEQ ID NO: 6106 - DNA, 20 bp, Artificial Sequence
  Artificially Synthesized Primer Sequence
agtcgatctcctcgctcgta

SEQ ID NO: 6107 - DNA, 20 bp, Artificial Sequence
  Artificially Synthesized Primer Sequence
actcaattcttgctgggctg

SEQ ID NO: 6108 - DNA, 20 bp, Artificial Sequence
  Artificially Synthesized Primer Sequence
cagctctccatcaaccacct

SEQ ID NO: 6109 - DNA, 20 bp, Artificial Sequence
  Artificially Synthesized Primer Sequence
cccataaagctctgggtcaa

SEQ ID NO: 6110 - DNA, 20 bp, Artificial Sequence
  Artificially Synthesized Primer Sequence
ccacgaatccaacacttcct

SEQ ID NO: 6111 - DNA, 20 bp, Artificial Sequence
  Artificially Synthesized Primer Sequence
actagaacaggcaggcctca

SEQ ID NO: 6112 - DNA, 20 bp, Artificial Sequence
  Artificially Synthesized Primer Sequence
aatcaggctcaggacaggaa

SEQ ID NO: 6113 - DNA, 10 bp, Artificial Sequence
  Artificially Synthesized Primer Sequence
  MISC_FEATURE (1)..(10): n stands for any base
nnnnnnnnnn

SEQ ID NO: 6114 - DNA, 10 bp, Artificial Sequence
  Artificially Synthesized Primer Sequence
  MISC_FEATURE (1)..(10): n stands for any base
nnnnnnnnnn

SEQ ID NO: 6115 - DNA, 20 bp, Artificial Sequence
  Artificially Synthesized Primer Sequence
cgggaaagtccaagtaagga

SEQ ID NO: 6116 - DNA, 20 bp, Artificial Sequence
  Artificially Synthesized Primer Sequence
gatgctggagtacagggagc

SEQ ID NO: 6117 - DNA, 20 bp, Artificial Sequence
  Artificially Synthesized Primer Sequence
agcgcctacaaagaccagaa

SEQ ID NO: 6118 - DNA, 20 bp, Artificial Sequence
  Artificially Synthesized Primer Sequence
ccacctgcagtcactctgaa

SEQ ID NO: 6119 - DNA, 20 bp, Artificial Sequence
  Artificially Synthesized Primer Sequence
acaagaaacgcacacgacac

SEQ ID NO: 6120 - DNA, 20 bp, Artificial Sequence
  Artificially Synthesized Primer Sequence
agcgcctacaaagaccagaa

SEQ ID NO: 6121 - DNA, 20 bp, Artificial Sequence
  Artificially Synthesized Primer Sequence
taaacggcactagcaaggct

SEQ ID NO: 6122 - DNA, 20 bp, Artificial Sequence
  Artificially Synthesized Primer Sequence
ccagacttgcctggaagaag

SEQ ID NO: 6123 - DNA, 20 bp, Artificial Sequence
  Artificially Synthesized Primer Sequence
gtcgagagaattcagccagg

SEQ ID NO: 6124 - DNA, 20 bp, Artificial Sequence
  Artificially Synthesized Primer Sequence
taaacggcactagcaaggct

SEQ ID NO: 6125 - DNA, 20 bp, Artificial Sequence
  Artificially Synthesized Primer Sequence
agtgtctttcttcgaaggcg

SEQ ID NO: 6126 - DNA, 20 bp, Artificial Sequence
  Artificially Synthesized Primer Sequence
tcccaaagcacttacccatc

SEQ ID NO: 6127 - DNA, 20 bp, Artificial Sequence
  Artificially Synthesized Primer Sequence
tgctgttgctgtatgcctgt

SEQ ID NO: 6128 - DNA, 20 bp, Artificial Sequence
  Artificially Synthesized Primer Sequence
cgttggctctgagcatagtg

SEQ ID NO: 6129 - DNA, 20 bp, Artificial Sequence
  Artificially Synthesized Primer Sequence
gtcaaaccgaagatgggaga

SEQ ID NO: 6130 - DNA, 20 bp, Artificial Sequence
  Artificially Synthesized Primer Sequence
cgttaggagggcaatggtta

SEQ ID NO: 6131 - DNA, 20 bp, Artificial Sequence
  Artificially Synthesized Primer Sequence
ctggagacctcatcatgtgc

SEQ ID NO: 6132 - DNA, 20 bp, Artificial Sequence
  Artificially Synthesized Primer Sequence
agcgcatagccactgttctt

SEQ ID NO: 6133 - DNA, 20 bp, Artificial Sequence
  Artificially Synthesized Primer Sequence
catctcgagcagagcaacag

SEQ ID NO: 6134 - DNA, 20 bp, Artificial Sequence
  Artificially Synthesized Primer Sequence
acgaccagacacatggatca

SEQ ID NO: 6135 - DNA, 20 bp, Artificial Sequence
  Artificially Synthesized Primer Sequence
acaccacgacagcatgagac

SEQ ID NO: 6136 - DNA, 20 bp, Artificial Sequence
  Artificially Synthesized Primer Sequence
catctcgagcagagcaacag

SEQ ID NO: 6137 - DNA, 20 bp, Artificial Sequence
  Artificially Synthesized Primer Sequence
atggggaactcccgtttatc

SEQ ID NO: 6138 - DNA, 20 bp, Artificial Sequence
  Artificially Synthesized Primer Sequence
gcacgattgcaaactcaaga

SEQ ID NO: 6139 - DNA, 20 bp, Artificial Sequence
  Artificially Synthesized Primer Sequence
gcgagttggtgaaagttggt

SEQ ID NO: 6140 - DNA, 20 bp, Artificial Sequence
  Artificially Synthesized Primer Sequence
atcgtctggatgcaattggt

SEQ ID NO: 6141 - DNA, 20 bp, Artificial Sequence
  Artificially Synthesized Primer Sequence
aacatcctcaacgagatggg

SEQ ID NO: 6142 - DNA, 20 bp, Artificial Sequence
  Artificially Synthesized Primer Sequence
ggatgttctagcagcaagcc

SEQ ID NO: 6143 - DNA, 20 bp, Artificial Sequence
  Artificially Synthesized Primer Sequence
acgtttcgacaggaggactg

SEQ ID NO: 6144 - DNA, 20 bp, Artificial Sequence
  Artificially Synthesized Primer Sequence
ggcttgctgctagaacatcc

SEQ ID NO: 6145 - DNA, 20 bp, Artificial Sequence
  Artificially Synthesized Primer Sequence
cgtgtctggaaacagcttca

SEQ ID NO: 6146 - DNA, 20 bp, Artificial Sequence
  Artificially Synthesized Primer Sequence
gggtacaactcgggaaacaa

SEQ ID NO: 6147 - DNA, 20 bp, Artificial Sequence
  Artificially Synthesized Primer Sequence
tcttccccaaatctgagcat

SEQ ID NO: 6148 - DNA, 20 bp, Artificial Sequence
  Artificially Synthesized Primer Sequence
cagaagccgcagaagaagaa

SEQ ID NO: 6149 - DNA, 20 bp, Artificial Sequence
  Artificially Synthesized Primer Sequence
gaggcttgtagctccccttt

SEQ ID NO: 6150 - DNA, 20 bp, Artificial Sequence
  Artificially Synthesized Primer Sequence
gtttgaggggaggggtatgt

SEQ ID NO: 6151 - DNA, 21 bp, Artificial Sequence
  Artificially Synthesized Primer Sequence
tcttccagcaaatgttcaggt

SEQ ID NO: 6152 - DNA, 20 bp, Artificial Sequence
  Artificially Synthesized Primer Sequence
tcgaggaagaagatggatgc

SEQ ID NO: 6153 - DNA, 20 bp, Artificial Sequence
  Artificially Synthesized Primer Sequence
ggatgaaaaacccccagaat

SEQ ID NO: 6154 - DNA, 20 bp, Artificial Sequence
  Artificially Synthesized Primer Sequence
cgctggtttgtagggatgat

SEQ ID NO: 6155 - DNA, 20 bp, Artificial Sequence
  Artificially Synthesized Primer Sequence
ctgaaccccactggatcttg

SEQ ID NO: 6156 - DNA, 20 bp, Artificial Sequence
  Artificially Synthesized Primer Sequence
ggtattggttccaaacaccg

SEQ ID NO: 6157 - DNA, 20 bp, Artificial Sequence
  Artificially Synthesized Primer Sequence
tgacactgtagctgcgctct

SEQ ID NO: 6158 - DNA, 20 bp, Artificial Sequence
  Artificially Synthesized Primer Sequence
aagaaacggatcgaatgtgc

SEQ ID NO: 6159 - DNA, 20 bp, Artificial Sequence
  Artificially Synthesized Primer Sequence
ctcatggagatttgccgttt

SEQ ID NO: 6160 - DNA, 20 bp, Artificial Sequence
  Artificially Synthesized Primer Sequence
ggcagtgtttcttcggttgt

SEQ ID NO: 6161 - DNA, 20 bp, Artificial Sequence
  Artificially Synthesized Primer Sequence
ctgtgagacaagctggtgga

SEQ ID NO: 6162 - DNA, 20 bp, Artificial Sequence
  Artificially Synthesized Primer Sequence
acaaccccggtttaaattcc

SEQ ID NO: 6163 - DNA, 20 bp, Artificial Sequence
  Artificially Synthesized Primer Sequence
gctacatccgaggagagtgc

SEQ ID NO: 6164 - DNA, 20 bp, Artificial Sequence
  Artificially Synthesized Primer Sequence
acgaacagtacccgcagagt

SEQ ID NO: 6165 - DNA, 20 bp, Artificial Sequence
  Artificially Synthesized Primer Sequence
ggtggatgggtttcattgtc

SEQ ID NO: 6166 - DNA, 20 bp, Artificial Sequence
  Artificially Synthesized Primer Sequence
caccaggtccaagcctacat

SEQ ID NO: 6167 - DNA, 20 bp, Artificial Sequence
  Artificially Synthesized Primer Sequence
ttcaagtagtgccagggctt

SEQ ID NO: 6168 - DNA, 20 bp, Artificial Sequence
  Artificially Synthesized Primer Sequence
acactgcacattcaggcaag

SEQ ID NO: 6169 - DNA, 20 bp, Artificial Sequence
  Artificially Synthesized Primer Sequence
tgcggctgatctatatgcac

SEQ ID NO: 6170 - DNA, 20 bp, Artificial Sequence
  Artificially Synthesized Primer Sequence
tcaccaaatccaaaacacca

SEQ ID NO: 6171 - DNA, 20 bp, Artificial Sequence
  Artificially Synthesized Primer Sequence
tcttgaacgcctgaagcata

SEQ ID NO: 6172 - DNA, 20 bp, Artificial Sequence
  Artificially Synthesized Primer Sequence
tgccgaaacctataactgcc

SEQ ID NO: 6173 - DNA, 20 bp, Artificial Sequence
  Artificially Synthesized Primer Sequence
ggaggcctagggagttcatc

SEQ ID NO: 6174 - DNA, 20 bp, Artificial Sequence
  Artificially Synthesized Primer Sequence
gaccttgcttgtcaacccat

SEQ ID NO: 6175 - DNA, 20 bp, Artificial Sequence
  Artificially Synthesized Primer Sequence
gggagtatgtgcttttccca

SEQ ID NO: 6176 - DNA, 20 bp, Artificial Sequence
  Artificially Synthesized Primer Sequence
cctagcccatggtctctcac

SEQ ID NO: 6177 - DNA, 20 bp, Artificial Sequence
  Artificially Synthesized Primer Sequence
tttgtggcaaggatgtggta

SEQ ID NO: 6178 - DNA, 20 bp, Artificial Sequence
  Artificially Synthesized Primer Sequence
gttcggcatcccagctaata

SEQ ID NO: 6179 - DNA, 20 bp, Artificial Sequence
  Artificially Synthesized Primer Sequence
ccagccaatatgcaaatcaa

SEQ ID NO: 6180 - DNA, 20 bp, Artificial Sequence
  Artificially Synthesized Primer Sequence
tcagggagctcgagaagaag

SEQ ID NO: 6181 - DNA, 20 bp, Artificial Sequence
  Artificially Synthesized Primer Sequence
ttttgtcttggcaatcgtga

SEQ ID NO: 6182 - DNA, 20 bp, Artificial Sequence
  Artificially Synthesized Primer Sequence
ccagttatgttgcccgagtt

SEQ ID NO: 6183 - DNA, 20 bp, Artificial Sequence
  Artificially Synthesized Primer Sequence
atgctacaaacgccaggttc

SEQ ID NO: 6184 - DNA, 20 bp, Artificial Sequence
  Artificially Synthesized Primer Sequence
ggaacatctgtggctccttc

SEQ ID NO: 6185 - DNA, 20 bp, Artificial Sequence
  Artificially Synthesized Primer Sequence
gtggcatgctcttgcagtaa

SEQ ID NO: 6186 - DNA, 20 bp, Artificial Sequence
  Artificially Synthesized Primer Sequence
aggcgattgacagcatctct

SEQ ID NO: 6187 - DNA, 20 bp, Artificial Sequence
  Artificially Synthesized Primer Sequence
tttctgtaatccacccagcc

SEQ ID NO: 6188 - DNA, 20 bp, Artificial Sequence
  Artificially Synthesized Primer Sequence
ctcgccttaccgtggagata

SEQ ID NO: 6189 - DNA, 20 bp, Artificial Sequence
  Artificially Synthesized Primer Sequence
ggccattaccaccattgttc

SEQ ID NO: 6190 - DNA, 20 bp, Artificial Sequence
  Artificially Synthesized Primer Sequence
attgtcatgcatcactggga

SEQ ID NO: 6191 - DNA, 20 bp, Artificial Sequence
  Artificially Synthesized Primer Sequence
tggaaacgagcaacatgcta

SEQ ID NO: 6192 - DNA, 20 bp, Artificial Sequence
  Artificially Synthesized Primer Sequence
ggccattaccaccattgttc

SEQ ID NO: 6193 - DNA, 20 bp, Artificial Sequence
  Artificially Synthesized Primer Sequence
caagaatcccgatgtctggt

SEQ ID NO: 6194 - DNA, 20 bp, Artificial Sequence
  Artificially Synthesized Primer Sequence
cccaaacttggcatgacttt

SEQ ID NO: 6195 - DNA, 20 bp, Artificial Sequence
  Artificially Synthesized Primer Sequence
ccaatctccccaccttttct

SEQ ID NO: 6196 - DNA, 20 bp, Artificial Sequence
  Artificially Synthesized Primer Sequence
aagaaggtcttgctttcgca

SEQ ID NO: 6197 - DNA, 20 bp, Artificial Sequence
  Artificially Synthesized Primer Sequence
ctggcattcaggaccttgtt

SEQ ID NO: 6198 - DNA, 20 bp, Artificial Sequence
  Artificially Synthesized Primer Sequence
cctcgaagcagaatggagtc

SEQ ID NO: 6199 - DNA, 20 bp, Artificial Sequence
  Artificially Synthesized Primer Sequence
ctgatggaaaagcgcaatct

SEQ ID NO: 6200 - DNA, 20 bp, Artificial Sequence
  Artificially Synthesized Primer Sequence
cgaagcttgtctgccacata

SEQ ID NO: 6201 - DNA, 20 bp, Artificial Sequence
  Artificially Synthesized Primer Sequence
gagcggaagagttgatcgtc

SEQ ID NO: 6202 - DNA, 20 bp, Artificial Sequence
  Artificially Synthesized Primer Sequence
gaaccatcgcggtagttgtt

SEQ ID NO: 6203 - DNA, 20 bp, Artificial Sequence
  Artificially Synthesized Primer Sequence
gaaccatcgcggtagttgtt

SEQ ID NO: 6204 - DNA, 20 bp, Artificial Sequence
  Artificially Synthesized Primer Sequence
gagcggaagagttgatcgtc

SEQ ID NO: 6205 - DNA, 20 bp, Artificial Sequence
  Artificially Synthesized Primer Sequence
cttccttgcccttaacctcc

SEQ ID NO: 6206 - DNA, 20 bp, Artificial Sequence
  Artificially Synthesized Primer Sequence
gcctcttccttaatacccgc

SEQ ID NO: 6207 - DNA, 20 bp, Artificial Sequence
  Artificially Synthesized Primer Sequence
aacaacaccaacaacaagcg

SEQ ID NO: 6208 - DNA, 20 bp, Artificial Sequence
  Artificially Synthesized Primer Sequence
aagaaaaggggatgcgagag

SEQ ID NO: 6209 - DNA, 20 bp, Artificial Sequence
  Artificially Synthesized Primer Sequence
gcactgttggcctactggat

SEQ ID NO: 6210 - DNA, 20 bp, Artificial Sequence
  Artificially Synthesized Primer Sequence
gaacaggagagcgttgaagg

SEQ ID NO: 6211 - DNA, 20 bp, Artificial Sequence
  Artificially Synthesized Primer Sequence
gagaaacaatgtcgcagcaa

SEQ ID NO: 6212 - DNA, 19 bp, Artificial Sequence
  Artificially Synthesized Primer Sequence
aagggcctgtacaaggggt

SEQ ID NO: 6213 - DNA, 20 bp, Artificial Sequence
  Artificially Synthesized Primer Sequence
gcactgttggcctactggat

SEQ ID NO: 6214 - DNA, 20 bp, Artificial Sequence
  Artificially Synthesized Primer Sequence
tggttcttggggtactcgtc

SEQ ID NO: 6215 - DNA, 21 bp, Artificial Sequence
  Artificially Synthesized Primer Sequence
tgtagcacgatagcgacacat

SEQ ID NO: 6216 - DNA, 21 bp, Artificial Sequence
  Artificially Synthesized Primer Sequence
tgcagtaggttatggtttccg

SEQ ID NO: 6217 - DNA, 20 bp, Artificial Sequence
  Artificially Synthesized Primer Sequence
tatatctcgcccctcctcct

SEQ ID NO: 6218 - DNA, 20 bp, Artificial Sequence
  Artificially Synthesized Primer Sequence
agggtgctcttcaggtgcta

SEQ ID NO: 6219 - DNA, 20 bp, Artificial Sequence
  Artificially Synthesized Primer Sequence
cttcgtactctgccctggag

SEQ ID NO: 6220 - DNA, 20 bp, Artificial Sequence
  Artificially Synthesized Primer Sequence
cctcgactacgaacaggagc

SEQ ID NO: 6221 - DNA, 20 bp, Artificial Sequence
  Artificially Synthesized Primer Sequence
ggatgtagaggtccaagcca

SEQ ID NO: 6222 - DNA, 20 bp, Artificial Sequence
  Artificially Synthesized Primer Sequence
agaccacacccagctacacc

SEQ ID NO: 6223 - DNA, 20 bp, Artificial Sequence
  Artificially Synthesized Primer Sequence
ccagttgtatgttccatgcg

SEQ ID NO: 6224 - DNA, 20 bp, Artificial Sequence
  Artificially Synthesized Primer Sequence
ggatgtagaggtccaagcca

SEQ ID NO: 6225 - DNA, 20 bp, Artificial Sequence
  Artificially Synthesized Primer Sequence
caaataaaggctcggatgga

SEQ ID NO: 6226 - DNA, 20 bp, Artificial Sequence
  Artificially Synthesized Primer Sequence
gaaaaggtgtccaggtcgaa

SEQ ID NO: 6227 - DNA, 20 bp, Artificial Sequence
  Artificially Synthesized Primer Sequence
gtatcggctactctggcagc

SEQ ID NO: 6228 - DNA, 20 bp, Artificial Sequence
  Artificially Synthesized Primer Sequence
agtggattcgacctggacac

SEQ ID NO: 6229 - DNA, 20 bp, Artificial Sequence
  Artificially Synthesized Primer Sequence
tgtctcctacctccacaccc

SEQ ID NO: 6230 - DNA, 20 bp, Artificial Sequence
  Artificially Synthesized Primer Sequence
tggacatggagccactgata

SEQ ID NO: 6231 - DNA, 20 bp, Artificial Sequence
  Artificially Synthesized Primer Sequence
tcctgctattctgcgttcct

SEQ ID NO: 6232 - DNA, 20 bp, Artificial Sequence
  Artificially Synthesized Primer Sequence
cgcgactcccaatttttaga

SEQ ID NO: 6233 - DNA, 20 bp, Artificial Sequence
  Artificially Synthesized Primer Sequence
ggatgcctttttccatgcta

SEQ ID NO: 6234 - DNA, 20 bp, Artificial Sequence
  Artificially Synthesized Primer Sequence
agacagagcggcagattcat

SEQ ID NO: 6235 - DNA, 20 bp, Artificial Sequence
  Artificially Synthesized Primer Sequence
agacagagcggcagattcat

SEQ ID NO: 6236 - DNA, 20 bp, Artificial Sequence
  Artificially Synthesized Primer Sequence
ggatgcctttttccatgcta

SEQ ID NO: 6237 - DNA, 20 bp, Artificial Sequence
  Artificially Synthesized Primer Sequence
aattcctcgagcactgttgg

SEQ ID NO: 6238 - DNA, 20 bp, Artificial Sequence
  Artificially Synthesized Primer Sequence
gaaggacctgcatttcttcg

SEQ ID NO: 6239 - DNA, 20 bp, Artificial Sequence
  Artificially Synthesized Primer Sequence
cactgcattttgcagatcgt

SEQ ID NO: 6240 - DNA, 20 bp, Artificial Sequence
  Artificially Synthesized Primer Sequence
cagaagccattctagccagg

SEQ ID NO: 6241 - DNA, 20 bp, Artificial Sequence
  Artificially Synthesized Primer Sequence
aaggctggtgactggaagaa

SEQ ID NO: 6242 - DNA, 20 bp, Artificial Sequence
  Artificially Synthesized Primer Sequence
cgaagggctgtcaccattat

SEQ ID NO: 6243 - DNA, 20 bp, Artificial Sequence
  Artificially Synthesized Primer Sequence
cagcttcttttctgctgcct

SEQ ID NO: 6244 - DNA, 20 bp, Artificial Sequence
  Artificially Synthesized Primer Sequence
tggatatgcatttgcacgag

SEQ ID NO: 6245 - DNA, 20 bp, Artificial Sequence
  Artificially Synthesized Primer Sequence
gcaattcgttacgaggcaat

SEQ ID NO: 6246 - DNA, 20 bp, Artificial Sequence
  Artificially Synthesized Primer Sequence
tgcattgctccactgtcttc

SEQ ID NO: 6247 - DNA, 20 bp, Artificial Sequence
  Artificially Synthesized Primer Sequence
atccgtcttgcttctccatc

SEQ ID NO: 6248 - DNA, 20 bp, Artificial Sequence
  Artificially Synthesized Primer Sequence
ccagcagtcaaaagaggacc

SEQ ID NO: 6249 - DNA, 20 bp, Artificial Sequence
  Artificially Synthesized Primer Sequence
aggtccagaagcagaggaca

SEQ ID NO: 6250 - DNA, 20 bp, Artificial Sequence
  Artificially Synthesized Primer Sequence
cgtcagcgagtactatcccc

SEQ ID NO: 6251 - DNA, 20 bp, Artificial Sequence
  Artificially Synthesized Primer Sequence
ggcaaagagaaagcagcaaa

SEQ ID NO: 6252 - DNA, 20 bp, Artificial Sequence
  Artificially Synthesized Primer Sequence
cggagaaagccaaatctgag

SEQ ID NO: 6253 - DNA, 20 bp, Artificial Sequence
  Artificially Synthesized Primer Sequence
acaagccgttgttcggttac

SEQ ID NO: 6254 - DNA, 20 bp, Artificial Sequence
  Artificially Synthesized Primer Sequence
gtctgctccaagaacaaggc

SEQ ID NO: 6255 - DNA, 20 bp, Artificial Sequence
  Artificially Synthesized Primer Sequence
ctggccaatcacagcttgta

SEQ ID NO: 6256 - DNA, 20 bp, Artificial Sequence
  Artificially Synthesized Primer Sequence
tgctcatgctcgtatctgct

SEQ ID NO: 6257 - DNA, 20 bp, Artificial Sequence
  Artificially Synthesized Primer Sequence
cgacgagctcgactacttcc

SEQ ID NO: 6258 - DNA, 20 bp, Artificial Sequence
  Artificially Synthesized Primer Sequence
catactcgtgtgccaccatc

SEQ ID NO: 6259 - DNA, 20 bp, Artificial Sequence
  Artificially Synthesized Primer Sequence
catactcgtgtgccaccatc

SEQ ID NO: 6260 - DNA, 20 bp, Artificial Sequence
  Artificially Synthesized Primer Sequence
ttaactgcatctgcaccacc

SEQ ID NO: 6261 - DNA, 20 bp, Artificial Sequence
  Artificially Synthesized Primer Sequence
ctccttgggaacctgcaata

SEQ ID NO: 6262 - DNA, 20 bp, Artificial Sequence
  Artificially Synthesized Primer Sequence
gcgacttttcatgatacgca

SEQ ID NO: 6263 - DNA, 20 bp, Artificial Sequence
  Artificially Synthesized Primer Sequence
gatagcaaaccgaaatccca

SEQ ID NO: 6264 - DNA, 20 bp, Artificial Sequence
  Artificially Synthesized Primer Sequence
ccctacctcctgtcgatgag

SEQ ID NO: 6265 - DNA, 20 bp, Artificial Sequence
  Artificially Synthesized Primer Sequence
atcctggtggagatgaggtg

SEQ ID NO: 6266 - DNA, 20 bp, Artificial Sequence
  Artificially Synthesized Primer Sequence
aacacactgccaccaaatga

SEQ ID NO: 6267 - DNA, 20 bp, Artificial Sequence
  Artificially Synthesized Primer Sequence
tcagatttgctgtagtgccg

SEQ ID NO: 6268 - DNA, 20 bp, Artificial Sequence
  Artificially Synthesized Primer Sequence
cacaacgtcaccaaggactg

SEQ ID NO: 6269 - DNA, 20 bp, Artificial Sequence
  Artificially Synthesized Primer Sequence
gagttgcgttgacgagaaca

SEQ ID NO: 6270 - DNA, 20 bp, Artificial Sequence
  Artificially Synthesized Primer Sequence
ccatccttttatgcccattg

SEQ ID NO: 6271 - DNA, 20 bp, Artificial Sequence
  Artificially Synthesized Primer Sequence
gtccacaatccctcgaaaaa

SEQ ID NO: 6272 - DNA, 20 bp, Artificial Sequence
  Artificially Synthesized Primer Sequence
ccatcccctctgtaaggtca

SEQ ID NO: 6273 - DNA, 20 bp, Artificial Sequence
  Artificially Synthesized Primer Sequence
ttggaataccggaagagcag

SEQ ID NO: 6274 - DNA, 20 bp, Artificial Sequence
  Artificially Synthesized Primer Sequence
aagtgggatatggtaggggg

SEQ ID NO: 6275 - DNA, 21 bp, Artificial Sequence
  Artificially Synthesized Primer Sequence
ggctcccaagaaacattacaa

SEQ ID NO: 6276 - DNA, 20 bp, Artificial Sequence
  Artificially Synthesized Primer Sequence
ttggaataccggaagagcag

SEQ ID NO: 6277 - DNA, 20 bp, Artificial Sequence
  Artificially Synthesized Primer Sequence
ttccttctcaaacccattcg

SEQ ID NO: 6278 - DNA, 20 bp, Artificial Sequence
  Artificially Synthesized Primer Sequence
ggaaaaaggagtgggaggag

SEQ ID NO: 6279 - DNA, 20 bp, Artificial Sequence
  Artificially Synthesized Primer Sequence
caattcagataaggcggcat

SEQ ID NO: 6280 - DNA, 20 bp, Artificial Sequence
  Artificially Synthesized Primer Sequence
atgagccgaagcaggagtta

SEQ ID NO: 6281 - DNA, 20 bp, Artificial Sequence
  Artificially Synthesized Primer Sequence
gattcttggttgcattccgt

SEQ ID NO: 6282 - DNA, 20 bp, Artificial Sequence
  Artificially Synthesized Primer Sequence
cgaatcgaagaagttcctgc

SEQ ID NO: 6283 - DNA, 20 bp, Artificial Sequence
  Artificially Synthesized Primer Sequence
ccggtattgacaagcatcaa

SEQ ID NO: 6284 - DNA, 20 bp, Artificial Sequence
  Artificially Synthesized Primer Sequence
attcatggcactccgtcttc

SEQ ID NO: 6285 - DNA, 20 bp, Artificial Sequence
  Artificially Synthesized Primer Sequence
agtggatgtgattcggaagg

SEQ ID NO: 6286 - DNA, 20 bp, Artificial Sequence
  Artificially Synthesized Primer Sequence
gaagccgaaacttgctatgc

SEQ ID NO: 6287 - DNA, 20 bp, Artificial Sequence
  Artificially Synthesized Primer Sequence
aagaaagcaacctgccacat

SEQ ID NO: 6288 - DNA, 20 bp, Artificial Sequence
  Artificially Synthesized Primer Sequence
cacagtttctctgcgaggtg

SEQ ID NO: 6289 - DNA, 20 bp, Artificial Sequence
  Artificially Synthesized Primer Sequence
acttccttggctggaaacct

SEQ ID NO: 6290 - DNA, 20 bp, Artificial Sequence
  Artificially Synthesized Primer Sequence
gttccagcatcaaaccacct

SEQ ID NO: 6291 - DNA, 20 bp, Artificial Sequence
  Artificially Synthesized Primer Sequence
tgggctcatagcaaagaggt

SEQ ID NO: 6292 - DNA, 20 bp, Artificial Sequence
  Artificially Synthesized Primer Sequence
agcagaagtctcaagctgcc

SEQ ID NO: 6293 - DNA, 20 bp, Artificial Sequence
  Artificially Synthesized Primer Sequence
catatgcatcgttcaccagg

SEQ ID NO: 6294 - DNA, 20 bp, Artificial Sequence
  Artificially Synthesized Primer Sequence
caagggtcaaggatgaggaa

SEQ ID NO: 6295 - DNA, 20 bp, Artificial Sequence
  Artificially Synthesized Primer Sequence
ccacaagaccttgcaacaga

SEQ ID NO: 6296 - DNA, 21 bp, Artificial Sequence
  Artificially Synthesized Primer Sequence
tgaaacagccactgaggtctt

SEQ ID NO: 6297 - DNA, 20 bp, Artificial Sequence
  Artificially Synthesized Primer Sequence
gactcccacacaggaaccat

SEQ ID NO: 6298 - DNA, 20 bp, Artificial Sequence
  Artificially Synthesized Primer Sequence
tgatcttgtagcatgagccg

SEQ ID NO: 6299 - DNA, 20 bp, Artificial Sequence
  Artificially Synthesized Primer Sequence
gcgggagagcgtatcttgta

SEQ ID NO: 6300 - DNA, 20 bp, Artificial Sequence
  Artificially Synthesized Primer Sequence
acggtcaagtcattgggagt

SEQ ID NO: 6301 - DNA, 20 bp, Artificial Sequence
  Artificially Synthesized Primer Sequence
aaggtggaggagatgaagca

SEQ ID NO: 6302 - DNA, 20 bp, Artificial Sequence
  Artificially Synthesized Primer Sequence
tcaatcgaaactgtgaagcg

SEQ ID NO: 6303 - DNA, 20 bp, Artificial Sequence
  Artificially Synthesized Primer Sequence
caacggaaagggcaaagata

SEQ ID NO: 6304 - DNA, 20 bp, Artificial Sequence
  Artificially Synthesized Primer Sequence
gagcaaggtgctggacatct

SEQ ID NO: 6305 - DNA, 20 bp, Artificial Sequence
  Artificially Synthesized Primer Sequence
tcactttttctatcgccgct

SEQ ID NO: 6306 - DNA, 20 bp, Artificial Sequence
  Artificially Synthesized Primer Sequence
ggagaaactgaactcgctgg

SEQ ID NO: 6307 - DNA, 20 bp, Artificial Sequence
  Artificially Synthesized Primer Sequence
ctgggactgcatatccacct

SEQ ID NO: 6308 - DNA, 20 bp, Artificial Sequence
  Artificially Synthesized Primer Sequence
tcatacaccagggcatacca

SEQ ID NO: 6309 - DNA, 20 bp, Artificial Sequence
  Artificially Synthesized Primer Sequence
ggagttgatccctcaggatg

SEQ ID NO: 6310 - DNA, 20 bp, Artificial Sequence
  Artificially Synthesized Primer Sequence
gcactgctcttccggtattc

SEQ ID NO: 6311 - DNA, 20 bp, Artificial Sequence
  Artificially Synthesized Primer Sequence
acgatcgatcaaaaggacca

SEQ ID NO: 6312 - DNA, 20 bp, Artificial Sequence
  Artificially Synthesized Primer Sequence
aatccgacgaaatcaacgag

SEQ ID NO: 6313 - DNA, 20 bp, Artificial Sequence
  Artificially Synthesized Primer Sequence
cagcgagctcatcaacaaaa

SEQ ID NO: 6314 - DNA, 20 bp, Artificial Sequence
  Artificially Synthesized Primer Sequence
tcggcgatacatttcaatca

SEQ ID NO: 6315 - DNA, 20 bp, Artificial Sequence
  Artificially Synthesized Primer Sequence
aaccccggagtcgtgtaaat

SEQ ID NO: 6316 - DNA, 20 bp, Artificial Sequence
  Artificially Synthesized Primer Sequence
acgccatgtatttctgctcc

SEQ ID NO: 6317 - DNA, 20 bp, Artificial Sequence
  Artificially Synthesized Primer Sequence
cggttgtggtggttctttct

SEQ ID NO: 6318 - DNA, 20 bp, Artificial Sequence
  Artificially Synthesized Primer Sequence
accatgcacaaaggttgaca

SEQ ID NO: 6319 - DNA, 20 bp, Artificial Sequence
  Artificially Synthesized Primer Sequence
tttaggcttttgggcagaga

SEQ ID NO: 6320 - DNA, 20 bp, Artificial Sequence
  Artificially Synthesized Primer Sequence
aacgccaagaaagtggagaa

SEQ ID NO: 6321 - DNA, 20 bp, Artificial Sequence
  Artificially Synthesized Primer Sequence
catggctgttgttcgctcta

SEQ ID NO: 6322 - DNA, 20 bp, Artificial Sequence
  Artificially Synthesized Primer Sequence
ttggctgaaagctcaaggat

SEQ ID NO: 6323 - DNA, 20 bp, Artificial Sequence
  Artificially Synthesized Primer Sequence
ggatgcccgtgaaactaaaa

SEQ ID NO: 6324 - DNA, 20 bp, Artificial Sequence
  Artificially Synthesized Primer Sequence
cacattccttttggcaaggt

SEQ ID NO: 6325 - DNA, 20 bp, Artificial Sequence
  Artificially Synthesized Primer Sequence
caggaggccatgaaaaccta

SEQ ID NO: 6326 - DNA, 20 bp, Artificial Sequence
  Artificially Synthesized Primer Sequence
ttctctgcctcgtgacattg

SEQ ID NO: 6327 - DNA, 20 bp, Artificial Sequence
  Artificially Synthesized Primer Sequence
ctcaacagtggtttcaggca

SEQ ID NO: 6328 - DNA, 20 bp, Artificial Sequence
  Artificially Synthesized Primer Sequence
atttgcggtcttgcagaagt

SEQ ID NO: 6329 - DNA, 20 bp, Artificial Sequence
  Artificially Synthesized Primer Sequence
gatttcgtaggcctctgctg

SEQ ID NO: 6330 - DNA, 20 bp, Artificial Sequence
  Artificially Synthesized Primer Sequence
cacgctccttctgatccttc

SEQ ID NO: 6331 - DNA, 20 bp, Artificial Sequence
  Artificially Synthesized Primer Sequence
gcacaatgccactacaagga

SEQ ID NO: 6332 - DNA, 20 bp, Artificial Sequence
  Artificially Synthesized Primer Sequence
gaaggatcagaaggagcgtg

SEQ ID NO: 6333 - DNA, 20 bp, Artificial Sequence
  Artificially Synthesized Primer Sequence
cctaaccctaaaacctcggc

SEQ ID NO: 6334 - DNA, 20 bp, Artificial Sequence
  Artificially Synthesized Primer Sequence
ttgttcacggatacgcatgt

SEQ ID NO: 6335 - DNA, 20 bp, Artificial Sequence
  Artificially Synthesized Primer Sequence
ttggtgcgtccttagaaacc

SEQ ID NO: 6336 - DNA, 20 bp, Artificial Sequence
  Artificially Synthesized Primer Sequence
tcatgccattcactgctagg

SEQ ID NO: 6337 - DNA, 20 bp, Artificial Sequence
  Artificially Synthesized Primer Sequence
gcgtacgttgctaacccatt

SEQ ID NO: 6338 - DNA, 20 bp, Artificial Sequence
  Artificially Synthesized Primer Sequence
ctccttttcccagagttccc

SEQ ID NO: 6339 - DNA, 20 bp, Artificial Sequence
  Artificially Synthesized Primer Sequence
gctcattatttttctcggcg

SEQ ID NO: 6340 - DNA, 20 bp, Artificial Sequence
  Artificially Synthesized Primer Sequence
gcaaatcagttgctggaaca

SEQ ID NO: 6341 - DNA, 20 bp, Artificial Sequence
  Artificially Synthesized Primer Sequence
ggggttggagtcctggtatt

SEQ ID NO: 6342 - DNA, 20 bp, Artificial Sequence
  Artificially Synthesized Primer Sequence
gtccacaccctcagagcatt

SEQ ID NO: 6343 - DNA, 20 bp, Artificial Sequence
  Artificially Synthesized Primer Sequence
aaatcccagttcctctgcct

SEQ ID NO: 6344 - DNA, 20 bp, Artificial Sequence
  Artificially Synthesized Primer Sequence
acctcgggatcactccttct

SEQ ID NO: 6345 - DNA, 20 bp, Artificial Sequence
  Artificially Synthesized Primer Sequence
ctcctatccttgtcggtgga

SEQ ID NO: 6346 - DNA, 20 bp, Artificial Sequence
  Artificially Synthesized Primer Sequence
cctgaaccacagcagtcaga

SEQ ID NO: 6347 - DNA, 20 bp, Artificial Sequence
  Artificially Synthesized Primer Sequence
aaacccaaattccgtttggt

SEQ ID NO: 6348 - DNA, 20 bp, Artificial Sequence
  Artificially Synthesized Primer Sequence
tcagacggggaatttttgag

SEQ ID NO: 6349 - DNA, 20 bp, Artificial Sequence
  Artificially Synthesized Primer Sequence
atcagtgatcctggtggagc

SEQ ID NO: 6350 - DNA, 20 bp, Artificial Sequence
  Artificially Synthesized Primer Sequence
cgaaattatggggcgagata

SEQ ID NO: 6351 - DNA, 20 bp, Artificial Sequence
  Artificially Synthesized Primer Sequence
acaaccttccttggggactt

SEQ ID NO: 6352 - DNA, 20 bp, Artificial Sequence
  Artificially Synthesized Primer Sequence
caccatggtcaacaagatgg

SEQ ID NO: 6353 - DNA, 20 bp, Artificial Sequence
  Artificially Synthesized Primer Sequence
cggacagttttgatggacct

SEQ ID NO: 6354 - DNA, 20 bp, Artificial Sequence
  Artificially Synthesized Primer Sequence
ccccagctcgtgtatgtttt

SEQ ID NO: 6355 - DNA, 20 bp, Artificial Sequence
  Artificially Synthesized Primer Sequence
aaccgtaaccctaaatgccc

SEQ ID NO: 6356 - DNA, 20 bp, Artificial Sequence
  Artificially Synthesized Primer Sequence
actactggcagggtggtgtc

SEQ ID NO: 6357 - DNA, 20 bp, Artificial Sequence
  Artificially Synthesized Primer Sequence
aggaaccattgtgcttcagg

SEQ ID NO: 6358 - DNA, 20 bp, Artificial Sequence
  Artificially Synthesized Primer Sequence
tggatgatggcaaaaactca

SEQ ID NO: 6359 - DNA, 20 bp, Artificial Sequence
  Artificially Synthesized Primer Sequence
tggatgatggcaaaaactca

SEQ ID NO: 6360 - DNA, 20 bp, Artificial Sequence
  Artificially Synthesized Primer Sequence
aggaaccattgtgcttcagg

SEQ ID NO: 6361 - DNA, 20 bp, Artificial Sequence
  Artificially Synthesized Primer Sequence
tgcttatttgccggaagagt

SEQ ID NO: 6362 - DNA, 20 bp, Artificial Sequence
  Artificially Synthesized Primer Sequence
ttaccggccctcataacaag

SEQ ID NO: 6363 - DNA, 20 bp, Artificial Sequence
  Artificially Synthesized Primer Sequence
aaaaaggcaaagtgtcgtgg

SEQ ID NO: 6364 - DNA, 20 bp, Artificial Sequence
  Artificially Synthesized Primer Sequence
gagagaagcccgaggaagat

SEQ ID NO: 6365 - DNA, 20 bp, Artificial Sequence
  Artificially Synthesized Primer Sequence
cccgcattgagtttgagatt

SEQ ID NO: 6366 - DNA, 20 bp, Artificial Sequence
  Artificially Synthesized Primer Sequence
ttatgcaatgccagcagaag

SEQ ID NO: 6367 - DNA, 20 bp, Artificial Sequence
  Artificially Synthesized Primer Sequence
gatgcaggagacacggagac

SEQ ID NO: 6368 - DNA, 20 bp, Artificial Sequence
  Artificially Synthesized Primer Sequence
gatgtctcgccgtcctatgt

SEQ ID NO: 6369 - DNA, 20 bp, Artificial Sequence
  Artificially Synthesized Primer Sequence
taatgcaagccccaagtacc

SEQ ID NO: 6370 - DNA, 20 bp, Artificial Sequence
  Artificially Synthesized Primer Sequence
caccagagaatggggagaaa

SEQ ID NO: 6371 - DNA, 20 bp, Artificial Sequence
  Artificially Synthesized Primer Sequence
cgaagggaaacaacttgagc

SEQ ID NO: 6372 - DNA, 20 bp, Artificial Sequence
  Artificially Synthesized Primer Sequence
atcacatgtgctgcttgtgg

SEQ ID NO: 6373 - DNA, 20 bp, Artificial Sequence
  Artificially Synthesized Primer Sequence
tgctggcttgtgttagttcg

SEQ ID NO: 6374 - DNA, 20 bp, Artificial Sequence
  Artificially Synthesized Primer Sequence
tccgagagagattgcttcgt

SEQ ID NO: 6375 - DNA, 21 bp, Artificial Sequence
  Artificially Synthesized Primer Sequence
tggaacaggacaaatcacaca

SEQ ID NO: 6376 - DNA, 20 bp, Artificial Sequence
  Artificially Synthesized Primer Sequence
ggctccaaccgttaaacaga

SEQ ID NO: 6377 - DNA, 20 bp, Artificial Sequence
  Artificially Synthesized Primer Sequence
tgttgagcagcagagcttgt

SEQ ID NO: 6378 - DNA, 20 bp, Artificial Sequence
  Artificially Synthesized Primer Sequence
tatccatgttcagtgcgagc

SEQ ID NO: 6379 - DNA, 20 bp, Artificial Sequence
  Artificially Synthesized Primer Sequence
tcatcaatcggtgtcatcgt

SEQ ID NO: 6380 - DNA, 20 bp, Artificial Sequence
  Artificially Synthesized Primer Sequence
caattgctcgcactgaacat

SEQ ID NO: 6381 - DNA, 20 bp, Artificial Sequence
  Artificially Synthesized Primer Sequence
atgtacctgaaaacgccgac

SEQ ID NO: 6382 - DNA, 20 bp, Artificial Sequence
  Artificially Synthesized Primer Sequence
tccaagtacagctatggggc

SEQ ID NO: 6383 - DNA, 20 bp, Artificial Sequence
  Artificially Synthesized Primer Sequence
gcatgctagcacaggacaga

SEQ ID NO: 6384 - DNA, 20 bp, Artificial Sequence
  Artificially Synthesized Primer Sequence
gccccatagctgtacttgga

SEQ ID NO: 6385 - DNA, 20 bp, Artificial Sequence
  Artificially Synthesized Primer Sequence
agaagatcgtcgatggttgg

SEQ ID NO: 6386 - DNA, 20 bp, Artificial Sequence
  Artificially Synthesized Primer Sequence
attccagacaatggcaaagc

SEQ ID NO: 6387 - DNA, 20 bp, Artificial Sequence
  Artificially Synthesized Primer Sequence
tacattccgacaatggcaaa

SEQ ID NO: 6388 - DNA, 20 bp, Artificial Sequence
  Artificially Synthesized Primer Sequence
tgaagatgctaagtgctgcg

SEQ ID NO: 6389 - DNA, 20 bp, Artificial Sequence
  Artificially Synthesized Primer Sequence
gaaagtgcagttcgaggagg

SEQ ID NO: 6390 - DNA, 20 bp, Artificial Sequence
  Artificially Synthesized Primer Sequence
gcggattaagcagggtacaa

SEQ ID NO: 6391 - DNA, 20 bp, Artificial Sequence
  Artificially Synthesized Primer Sequence
caacacagcagaaccaagga

SEQ ID NO: 6392 - DNA, 20 bp, Artificial Sequence
  Artificially Synthesized Primer Sequence
catcgactgcttgcagctta

SEQ ID NO: 6393 - DNA, 20 bp, Artificial Sequence
  Artificially Synthesized Primer Sequence
ttcgaacatcatgggtcatc

SEQ ID NO: 6394 - DNA, 20 bp, Artificial Sequence
  Artificially Synthesized Primer Sequence
aaatgatcagggtagcgcag

SEQ ID NO: 6395 - DNA, 20 bp, Artificial Sequence
  Artificially Synthesized Primer Sequence
agcctgttctctggactgga

SEQ ID NO: 6396 - DNA, 20 bp, Artificial Sequence
  Artificially Synthesized Primer Sequence
catgtgccaagaggacttga

SEQ ID NO: 6397 - DNA, 20 bp, Artificial Sequence
  Artificially Synthesized Primer Sequence
cacagtggatggaactggtg

SEQ ID NO: 6398 - DNA, 20 bp, Artificial Sequence
  Artificially Synthesized Primer Sequence
agagcctgagccaaatgaaa

SEQ ID NO: 6399 - DNA, 20 bp, Artificial Sequence
  Artificially Synthesized Primer Sequence
gaagagcaaggaacacctgc

SEQ ID NO: 6400 - DNA, 20 bp, Artificial Sequence
  Artificially Synthesized Primer Sequence
atgagtacctcgatggtggc

SEQ ID NO: 6401 - DNA, 20 bp, Artificial Sequence
  Artificially Synthesized Primer Sequence
gcaaaggaggaatcatccaa

SEQ ID NO: 6402 - DNA, 20 bp, Artificial Sequence
  Artificially Synthesized Primer Sequence
gggccgatgcaactaaaata

SEQ ID NO: 6403 - DNA, 20 bp, Artificial Sequence
  Artificially Synthesized Primer Sequence
aacaccatccaaaagccaac

SEQ ID NO: 6404 - DNA, 20 bp, Artificial Sequence
  Artificially Synthesized Primer Sequence
actgctggagaagcttagcg

SEQ ID NO: 6405 - DNA, 20 bp, Artificial Sequence
  Artificially Synthesized Primer Sequence
aaaggcatgaagctccagaa

SEQ ID NO: 6406 - DNA, 20 bp, Artificial Sequence
  Artificially Synthesized Primer Sequence
gttcttccactcagcaaggc

SEQ ID NO: 6407 - DNA, 20 bp, Artificial Sequence
  Artificially Synthesized Primer Sequence
agagcagcagataccgcttg

SEQ ID NO: 6408 - DNA, 20 bp, Artificial Sequence
  Artificially Synthesized Primer Sequence
cgactcagttgagaatgcca

SEQ ID NO: 6409 - DNA, 20 bp, Artificial Sequence
  Artificially Synthesized Primer Sequence
tcaagggcagccatatatcc

SEQ ID NO: 6410 - DNA, 20 bp, Artificial Sequence
  Artificially Synthesized Primer Sequence
gcctgggttatctgtttcca

SEQ ID NO: 6411 - DNA, 20 bp, Artificial Sequence
  Artificially Synthesized Primer Sequence
tgtttttccatgcaggtttg

SEQ ID NO: 6412 - DNA, 20 bp, Artificial Sequence
  Artificially Synthesized Primer Sequence
atctgcccactggagatcag

SEQ ID NO: 6413 - DNA, 20 bp, Artificial Sequence
  Artificially Synthesized Primer Sequence
tgagtggaagcgcaagtatg

SEQ ID NO: 6414 - DNA, 20 bp, Artificial Sequence
  Artificially Synthesized Primer Sequence
tgtttattgctgcgttctgc

SEQ ID NO: 6415 - DNA, 20 bp, Artificial Sequence
  Artificially Synthesized Primer Sequence
aagaaccgaaccaacacagg

SEQ ID NO: 6416 - DNA, 20 bp, Artificial Sequence
  Artificially Synthesized Primer Sequence
tgcaagtaccgttcaacagc

SEQ ID NO: 6417 - DNA, 20 bp, Artificial Sequence
  Artificially Synthesized Primer Sequence
acctcatgcaatttggaagc

SEQ ID NO: 6418 - DNA, 20 bp, Artificial Sequence
  Artificially Synthesized Primer Sequence
gagcagcagcatcaacacat

SEQ ID NO: 6419 - DNA, 20 bp, Artificial Sequence
  Artificially Synthesized Primer Sequence
ttggctaatttcaggcaagg

SEQ ID NO: 6420 - DNA, 20 bp, Artificial Sequence
  Artificially Synthesized Primer Sequence
tagttgctgagctgcaaagg

SEQ ID NO: 6421 - DNA, 20 bp, Artificial Sequence
  Artificially Synthesized Primer Sequence
acaagaggtgcaaccgattc

SEQ ID NO: 6422 - DNA, 20 bp, Artificial Sequence
  Artificially Synthesized Primer Sequence
cttggataaaatcgggggtt

SEQ ID NO: 6423 - DNA, 20 bp, Artificial Sequence
  Artificially Synthesized Primer Sequence
cgttgtaccgagcagagaca

SEQ ID NO: 6424 - DNA, 20 bp, Artificial Sequence
  Artificially Synthesized Primer Sequence
atgctcggagtgctttgact

SEQ ID NO: 6425 - DNA, 20 bp, Artificial Sequence
  Artificially Synthesized Primer Sequence
tgcccttaaggagaagctga

SEQ ID NO: 6426 - DNA, 20 bp, Artificial Sequence
  Artificially Synthesized Primer Sequence
agtgatgcacagctgcaaac

SEQ ID NO: 6427 - DNA, 20 bp, Artificial Sequence
  Artificially Synthesized Primer Sequence
gcatcggttagttttctggc

SEQ ID NO: 6428 - DNA, 20 bp, Artificial Sequence
  Artificially Synthesized Primer Sequence
tcctcatgactgatctcccc

SEQ ID NO: 6429 - DNA, 20 bp, Artificial Sequence
  Artificially Synthesized Primer Sequence
cacatcaaggtgaccacgtc

SEQ ID NO: 6430 - DNA, 20 bp, Artificial Sequence
  Artificially Synthesized Primer Sequence
tggttctcgttgaacatgga

SEQ ID NO: 6431 - DNA, 20 bp, Artificial Sequence
  Artificially Synthesized Primer Sequence
caacccaagccctgtacaat

SEQ ID NO: 6432 - DNA, 20 bp, Artificial Sequence
  Artificially Synthesized Primer Sequence
agaacctgttcgacaccacc

SEQ ID NO: 6433 - DNA, 20 bp, Artificial Sequence
  Artificially Synthesized Primer Sequence
tgaaaagggttcacaaaggc

SEQ ID NO: 6434 - DNA, 20 bp, Artificial Sequence
  Artificially Synthesized Primer Sequence
gaccacttcgcatgaacctt

SEQ ID NO: 6435 - DNA, 20 bp, Artificial Sequence
  Artificially Synthesized Primer Sequence
atcgggctcaagaaagttca

SEQ ID NO: 6436 - DNA, 20 bp, Artificial Sequence
  Artificially Synthesized Primer Sequence
ggctattgagcttgaggcac

SEQ ID NO: 6437 - DNA, 20 bp, Artificial Sequence
  Artificially Synthesized Primer Sequence
cgttcaaaaagcagcaaaca

SEQ ID NO: 6438 - DNA, 20 bp, Artificial Sequence
  Artificially Synthesized Primer Sequence
aagcttgtttcagccttcca

SEQ ID NO: 6439 - DNA, 20 bp, Artificial Sequence
  Artificially Synthesized Primer Sequence
gaagaccatgtaggggacga

SEQ ID NO: 6440 - DNA, 20 bp, Artificial Sequence
  Artificially Synthesized Primer Sequence
tgaaggaaggtgacgagctt

SEQ ID NO: 6441 - DNA, 20 bp, Artificial Sequence
  Artificially Synthesized Primer Sequence
tccaaactatgggcaacaca

SEQ ID NO: 6442 - DNA, 20 bp, Artificial Sequence
  Artificially Synthesized Primer Sequence
tgacagagtctgaggggctt

SEQ ID NO: 6443 - DNA, 20 bp, Artificial Sequence
  Artificially Synthesized Primer Sequence
aacttcgaacaagcctggtg

SEQ ID NO: 6444 - DNA, 21 bp, Artificial Sequence
  Artificially Synthesized Primer Sequence
cgaacttctatccctgtgtgc

SEQ ID NO: 6445 - DNA, 20 bp, Artificial Sequence
  Artificially Synthesized Primer Sequence
tacggtcacctcctcctttg

SEQ ID NO: 6446 - DNA, 20 bp, Artificial Sequence
  Artificially Synthesized Primer Sequence
ctatagggcgaattggggac

SEQ ID NO: 6447 - DNA, 20 bp, Artificial Sequence
  Artificially Synthesized Primer Sequence
gactggagcatcacaattcg

SEQ ID NO: 6448 - DNA, 20 bp, Artificial Sequence
  Artificially Synthesized Primer Sequence
gagcgaggtggagaagaggt

SEQ ID NO: 6449 - DNA, 20 bp, Artificial Sequence
  Artificially Synthesized Primer Sequence
catggacgttttcgattcct

SEQ ID NO: 6450 - DNA, 20 bp, Artificial Sequence
  Artificially Synthesized Primer Sequence
ctttcgcgcttatcttggtc

SEQ ID NO: 6451 - DNA, 20 bp, Artificial Sequence
  Artificially Synthesized Primer Sequence
tccttcagaggcgaacctaa

SEQ ID NO: 6452 - DNA, 20 bp, Artificial Sequence
  Artificially Synthesized Primer Sequence
gaccaagataagcgcgaaag

SEQ ID NO: 6453 - DNA, 20 bp, Artificial Sequence
  Artificially Synthesized Primer Sequence
gtccctcatcatcgtccagt

SEQ ID NO: 6454 - DNA, 20 bp, Artificial Sequence
  Artificially Synthesized Primer Sequence
aatagcactagccgccttca

SEQ ID NO: 6455 - DNA, 20 bp, Artificial Sequence
  Artificially Synthesized Primer Sequence
gtattgagaggcgcattgct

SEQ ID NO: 6456 - DNA, 20 bp, Artificial Sequence
  Artificially Synthesized Primer Sequence
gagggaaggattacttcggc

SEQ ID NO: 6457 - DNA, 20 bp, Artificial Sequence
  Artificially Synthesized Primer Sequence
tgaaagctacacaagcaccg

SEQ ID NO: 6458 - DNA, 20 bp, Artificial Sequence
  Artificially Synthesized Primer Sequence
ccagaagtgttctgatcgca

SEQ ID NO: 6459 - DNA, 20 bp, Artificial Sequence
  Artificially Synthesized Primer Sequence
gacggtccactcgatgtttt

SEQ ID NO: 6460 - DNA, 20 bp, Artificial Sequence
  Artificially Synthesized Primer Sequence
tcaaaagtggtagctgcacg

SEQ ID NO: 6461 - DNA, 20 bp, Artificial Sequence
  Artificially Synthesized Primer Sequence
gatctagggggattcgcttc

SEQ ID NO: 6462 - DNA, 20 bp, Artificial Sequence
  Artificially Synthesized Primer Sequence
aggtctgcggacttgaaaga

SEQ ID NO: 6463 - DNA, 20 bp, Artificial Sequence
  Artificially Synthesized Primer Sequence
ctgagcacgcaacaccttta

SEQ ID NO: 6464 - DNA, 20 bp, Artificial Sequence
  Artificially Synthesized Primer Sequence
cgtcgagactgcaggtgata

SEQ ID NO: 6465 - DNA, 20 bp, Artificial Sequence
  Artificially Synthesized Primer Sequence
ggtaattccgataccagcga

SEQ ID NO: 6466 - DNA, 20 bp, Artificial Sequence
  Artificially Synthesized Primer Sequence
actatgcggctgggtaattg

SEQ ID NO: 6467 - DNA, 20 bp, Artificial Sequence
  Artificially Synthesized Primer Sequence
tctcggtgtactgcttcacg

SEQ ID NO: 6468 - DNA, 20 bp, Artificial Sequence
  Artificially Synthesized Primer Sequence
aaggtggactttcgacatgg

SEQ ID NO: 6469 - DNA, 20 bp, Artificial Sequence
  Artificially Synthesized Primer Sequence
tcagaagtggcaaacactgc

SEQ ID NO: 6470 - DNA, 20 bp, Artificial Sequence
  Artificially Synthesized Primer Sequence
tgactggagagacgatgacg

SEQ ID NO: 6471 - DNA, 20 bp, Artificial Sequence
  Artificially Synthesized Primer Sequence
ttacaagaatgcaacgcgac

SEQ ID NO: 6472 - DNA, 20 bp, Artificial Sequence
  Artificially Synthesized Primer Sequence
gtgcaaccatgtttggatca

SEQ ID NO: 6473 - DNA, 20 bp, Artificial Sequence
  Artificially Synthesized Primer Sequence
gaataccggaaaggaaaggg

SEQ ID NO: 6474 - DNA, 20 bp, Artificial Sequence
  Artificially Synthesized Primer Sequence
gcagttggcacttcacagaa

SEQ ID NO: 6475 - DNA, 20 bp, Artificial Sequence
  Artificially Synthesized Primer Sequence
ttaggctcgctggcagtaat

SEQ ID NO: 6476 - DNA, 20 bp, Artificial Sequence
  Artificially Synthesized Primer Sequence
aaactccggaaggatggact

SEQ ID NO: 6477 - DNA, 20 bp, Artificial Sequence
  Artificially Synthesized Primer Sequence
ggttctccactcgtctctcg

SEQ ID NO: 6478 - DNA, 20 bp, Artificial Sequence
  Artificially Synthesized Primer Sequence
atgaaagaccggtttagggg

SEQ ID NO: 6479 - DNA, 20 bp, Artificial Sequence
  Artificially Synthesized Primer Sequence
atttgccttgcctcttttga

SEQ ID NO: 6480 - DNA, 19 bp, Artificial Sequence
  Artificially Synthesized Primer Sequence
gaagaagcgtcatgtcccc

SEQ ID NO: 6481 - DNA, 20 bp, Artificial Sequence
  Artificially Synthesized Primer Sequence
tcatcggattcgataaaggc

SEQ ID NO: 6482 - DNA, 20 bp, Artificial Sequence
  Artificially Synthesized Primer Sequence
ggacggatcgttacctgaga

SEQ ID NO: 6483 - DNA, 20 bp, Artificial Sequence
  Artificially Synthesized Primer Sequence
cattgagcagcagatggaga

SEQ ID NO: 6484 - DNA, 20 bp, Artificial Sequence
  Artificially Synthesized Primer Sequence
atgcacactgagcagcctaa

SEQ ID NO: 6485 - DNA, 20 bp, Artificial Sequence
  Artificially Synthesized Primer Sequence
ctagagggtgctggtgcttc

SEQ ID NO: 6486 - DNA, 20 bp, Artificial Sequence
  Artificially Synthesized Primer Sequence
ggatcagggttgctcacatt

SEQ ID NO: 6487 - DNA, 20 bp, Artificial Sequence
  Artificially Synthesized Primer Sequence
acggcatgcattaaacaaca

SEQ ID NO: 6488 - DNA, 20 bp, Artificial Sequence
  Artificially Synthesized Primer Sequence
gctgaagctgtggtatgggt

SEQ ID NO: 6489 - DNA, 20 bp, Artificial Sequence
  Artificially Synthesized Primer Sequence
tggtatagctgctcgcaatg

SEQ ID NO: 6490 - DNA, 20 bp, Artificial Sequence
  Artificially Synthesized Primer Sequence
ttttgcattcctggtccttc

SEQ ID NO: 6491 - DNA, 20 bp, Artificial Sequence
  Artificially Synthesized Primer Sequence
aaattattcccaacccagcc

SEQ ID NO: 6492 - DNA, 20 bp, Artificial Sequence
  Artificially Synthesized Primer Sequence
taatgcttcagagggtgcct

SEQ ID NO: 6493 - DNA, 20 bp, Artificial Sequence
  Artificially Synthesized Primer Sequence
gcaaagattgccatgcagta

SEQ ID NO: 6494 - DNA, 20 bp, Artificial Sequence
  Artificially Synthesized Primer Sequence
tccacaccagcaatcgaata

SEQ ID NO: 6495 - DNA, 20 bp, Artificial Sequence
  Artificially Synthesized Primer Sequence
catccagcacaaaacactgg

SEQ ID NO: 6496 - DNA, 20 bp, Artificial Sequence
  Artificially Synthesized Primer Sequence
ttcctggtggaggtcaagtc

SEQ ID NO: 6497 - DNA, 20 bp, Artificial Sequence
  Artificially Synthesized Primer Sequence
atggcctagttgccattgtc

SEQ ID NO: 6498 - DNA, 20 bp, Artificial Sequence
  Artificially Synthesized Primer Sequence
tggcaaatatgaagccatga

SEQ ID NO: 6499 - DNA, 20 bp, Artificial Sequence
  Artificially Synthesized Primer Sequence
aataggggatacaggggcac

SEQ ID NO: 6500 - DNA, 20 bp, Artificial Sequence
  Artificially Synthesized Primer Sequence
gtcatgttcggcatgtgttc

SEQ ID NO: 6501 - DNA, 20 bp, Artificial Sequence
  Artificially Synthesized Primer Sequence
atatctgcgctggagcaagt

SEQ ID NO: 6502 - DNA, 20 bp, Artificial Sequence
  Artificially Synthesized Primer Sequence
caatgatgtcagccgctcta

SEQ ID NO: 6503 - DNA, 20 bp, Artificial Sequence
  Artificially Synthesized Primer Sequence
tggctgcttacaacagcatc

SEQ ID NO: 6504 - DNA, 20 bp, Artificial Sequence
  Artificially Synthesized Primer Sequence
aggagcatggagatcgtttg

SEQ ID NO: 6505 - DNA, 20 bp, Artificial Sequence
  Artificially Synthesized Primer Sequence
gtgtccaaggtgctggagat

SEQ ID NO: 6506 - DNA, 20 bp, Artificial Sequence
  Artificially Synthesized Primer Sequence
cttgttggggaaaaggtcaa

SEQ ID NO: 6507 - DNA, 20 bp, Artificial Sequence
  Artificially Synthesized Primer Sequence
gcgccatgtagacaaggatt

SEQ ID NO: 6508 - DNA, 20 bp, Artificial Sequence
  Artificially Synthesized Primer Sequence
gaagatggtgtccaaggtgc

SEQ ID NO: 6509 - DNA, 20 bp, Artificial Sequence
  Artificially Synthesized Primer Sequence
tttgctggagaacacactgc

SEQ ID NO: 6510 - DNA, 20 bp, Artificial Sequence
  Artificially Synthesized Primer Sequence
aggtctacaccgactggtgg

SEQ ID NO: 6511 - DNA, 20 bp, Artificial Sequence
  Artificially Synthesized Primer Sequence
tcgacggtcacagagacaag

SEQ ID NO: 6512 - DNA, 20 bp, Artificial Sequence
  Artificially Synthesized Primer Sequence
catctttgtcgtctgctcca

SEQ ID NO: 6513 - DNA, 20 bp, Artificial Sequence
  Artificially Synthesized Primer Sequence
gtgctcggtttgtggttctt

SEQ ID NO: 6514 - DNA, 20 bp, Artificial Sequence
  Artificially Synthesized Primer Sequence
aaaacaaagccaggcagaaa

SEQ ID NO: 6515 - DNA, 20 bp, Artificial Sequence
  Artificially Synthesized Primer Sequence
acaccacccgagtctgaaac

SEQ ID NO: 6516 - DNA, 20 bp, Artificial Sequence
  Artificially Synthesized Primer Sequence
gaaggccactggttgttgtc

SEQ ID NO: 6517 - DNA, 20 bp, Artificial Sequence
  Artificially Synthesized Primer Sequence
atatgaaacgcgtgggctac

SEQ ID NO: 6518 - DNA, 20 bp, Artificial Sequence
  Artificially Synthesized Primer Sequence
ctttccgttggagcactttc

SEQ ID NO: 6519 - DNA, 20 bp, Artificial Sequence
  Artificially Synthesized Primer Sequence
ttgcaactcatgaccagagc

SEQ ID NO: 6520 - DNA, 20 bp, Artificial Sequence
  Artificially Synthesized Primer Sequence
gaaagtgctccaacggaaag

SEQ ID NO: 6521 - DNA, 20 bp, Artificial Sequence
  Artificially Synthesized Primer Sequence
cttgcaagttcaggggttgt

SEQ ID NO: 6522 - DNA, 20 bp, Artificial Sequence
  Artificially Synthesized Primer Sequence
agtggggagcacaaaacatc

SEQ ID NO: 6523 - DNA, 20 bp, Artificial Sequence
  Artificially Synthesized Primer Sequence
tctccactccccagtaccag

SEQ ID NO: 6524 - DNA, 20 bp, Artificial Sequence
  Artificially Synthesized Primer Sequence
cactgatatctccggatgcc

SEQ ID NO: 6525 - DNA, 20 bp, Artificial Sequence
  Artificially Synthesized Primer Sequence
ctgagaatggttgaggggaa

SEQ ID NO: 6526 - DNA, 20 bp, Artificial Sequence
  Artificially Synthesized Primer Sequence
tgggttgcaatgttcgtaaa

SEQ ID NO: 6527 - DNA, 20 bp, Artificial Sequence
  Artificially Synthesized Primer Sequence
ctcttgcacggttgcatcta

SEQ ID NO: 6528 - DNA, 20 bp, Artificial Sequence
  Artificially Synthesized Primer Sequence
tgatttctcgggatttgacc

SEQ ID NO: 6529 - DNA, 20 bp, Artificial Sequence
  Artificially Synthesized Primer Sequence
tcaagtgctgaattgcttgc

SEQ ID NO: 6530 - DNA, 20 bp, Artificial Sequence
  Artificially Synthesized Primer Sequence
agttggccaaaatcctgttg

SEQ ID NO: 6531 - DNA, 20 bp, Artificial Sequence
  Artificially Synthesized Primer Sequence
gtgacaacagatgtcggtgc

SEQ ID NO: 6532 - DNA, 20 bp, Artificial Sequence
  Artificially Synthesized Primer Sequence
acctctgcctccagttgatg

SEQ ID NO: 6533 - DNA, 20 bp, Artificial Sequence
  Artificially Synthesized Primer Sequence
actgaagccgagaccgaata

SEQ ID NO: 6534 - DNA, 20 bp, Artificial Sequence
  Artificially Synthesized Primer Sequence
tttctggatccatgctttcc

SEQ ID NO: 6535 - DNA, 20 bp, Artificial Sequence
  Artificially Synthesized Primer Sequence
cccttgtgctttcaccagat

SEQ ID NO: 6536 - DNA, 20 bp, Artificial Sequence
  Artificially Synthesized Primer Sequence
ggaaagcatggatccagaaa

SEQ ID NO: 6537 - DNA, 20 bp, Artificial Sequence
  Artificially Synthesized Primer Sequence
caagcgctcctacatcaaca

SEQ ID NO: 6538 - DNA, 20 bp, Artificial Sequence
  Artificially Synthesized Primer Sequence
gccgaagtagctgaatcctg

SEQ ID NO: 6539 - DNA, 20 bp, Artificial Sequence
  Artificially Synthesized Primer Sequence
attggttgcagcgacttctt

SEQ ID NO: 6540 - DNA, 20 bp, Artificial Sequence
  Artificially Synthesized Primer Sequence
gcgtcaccttcttcttcgtc

SEQ ID NO: 6541 - DNA, 20 bp, Artificial Sequence
  Artificially Synthesized Primer Sequence
atggtctgaagcgcgagtat

SEQ ID NO: 6542 - DNA, 20 bp, Artificial Sequence
  Artificially Synthesized Primer Sequence
tacggcattcaaaaccacaa

SEQ ID NO: 6543 - DNA, 20 bp, Artificial Sequence
  Artificially Synthesized Primer Sequence
agcctgtctttgtggctgat

SEQ ID NO: 6544 - DNA, 20 bp, Artificial Sequence
  Artificially Synthesized Primer Sequence
caaattggccgctcagttat

SEQ ID NO: 6545 - DNA, 20 bp, Artificial Sequence
  Artificially Synthesized Primer Sequence
tgtgtaaacagtgtgggcgt

SEQ ID NO: 6546 - DNA, 20 bp, Artificial Sequence
  Artificially Synthesized Primer Sequence
ggaggatgagggggatagag

SEQ ID NO: 6547 - DNA, 21 bp, Artificial Sequence
  Artificially Synthesized Primer Sequence
cgtcgcaatatccttaagtcg

SEQ ID NO: 6548 - DNA, 20 bp, Artificial Sequence
  Artificially Synthesized Primer Sequence
ctgggactgatgcctttcac

SEQ ID NO: 6549 - DNA, 20 bp, Artificial Sequence
  Artificially Synthesized Primer Sequence
tggtggaaaaatccttctgc

SEQ ID NO: 6550 - DNA, 20 bp, Artificial Sequence
  Artificially Synthesized Primer Sequence
tgtctcctctatgcacgtcg

SEQ ID NO: 6551 - DNA, 20 bp, Artificial Sequence
  Artificially Synthesized Primer Sequence
tgcgggttgttctttctacc

SEQ ID NO: 6552 - DNA, 20 bp, Artificial Sequence
  Artificially Synthesized Primer Sequence
cgacgtgcatagaggagaca

SEQ ID NO: 6553 - DNA, 20 bp, Artificial Sequence
  Artificially Synthesized Primer Sequence
caccatcctccgattcagat

SEQ ID NO: 6554 - DNA, 20 bp, Artificial Sequence
  Artificially Synthesized Primer Sequence
gcctaattcgacttgcttcg

SEQ ID NO: 6555 - DNA, 20 bp, Artificial Sequence
  Artificially Synthesized Primer Sequence
cacattgtacaacgccaagg

SEQ ID NO: 6556 - DNA, 20 bp, Artificial Sequence
  Artificially Synthesized Primer Sequence
agcacctcctccagtcattg

SEQ ID NO: 6557 - DNA, 20 bp, Artificial Sequence
  Artificially Synthesized Primer Sequence
cttgctatgcaggtacgcaa

SEQ ID NO: 6558 - DNA, 20 bp, Artificial Sequence
  Artificially Synthesized Primer Sequence
ttctcatccagtccccagac

SEQ ID NO: 6559 - DNA, 20 bp, Artificial Sequence
  Artificially Synthesized Primer Sequence
aatgcaaggcacaagtgatg

SEQ ID NO: 6560 - DNA, 20 bp, Artificial Sequence
  Artificially Synthesized Primer Sequence
tacaggggttgcaactagcc

SEQ ID NO: 6561 - DNA, 20 bp, Artificial Sequence
  Artificially Synthesized Primer Sequence
tgaatgttctggatgtggga

SEQ ID NO: 6562 - DNA, 20 bp, Artificial Sequence
  Artificially Synthesized Primer Sequence
ttacaccaacgaccgaatca

SEQ ID NO: 6563 - DNA, 20 bp, Artificial Sequence
  Artificially Synthesized Primer Sequence
atcaccggatcagagcaact

SEQ ID NO: 6564 - DNA, 20 bp, Artificial Sequence
  Artificially Synthesized Primer Sequence
tgaatgttctggatgtggga

SEQ ID NO: 6565 - DNA, 20 bp, Artificial Sequence
  Artificially Synthesized Primer Sequence
gaagtccatcctaatgccga

SEQ ID NO: 6566 - DNA, 20 bp, Artificial Sequence
  Artificially Synthesized Primer Sequence
cctgagctcccagttttcag

SEQ ID NO: 6567 - DNA, 20 bp, Artificial Sequence
  Artificially Synthesized Primer Sequence
ctcatcaatacatggcaccg

SEQ ID NO: 6568 - DNA, 20 bp, Artificial Sequence
  Artificially Synthesized Primer Sequence
atgttcctcttggcatctgg

SEQ ID NO: 6569 - DNA, 20 bp, Artificial Sequence
  Artificially Synthesized Primer Sequence
gctgaacaggtcaggaggac

SEQ ID NO: 6570 - DNA, 20 bp, Artificial Sequence
  Artificially Synthesized Primer Sequence
ctgttcctttttcgctgctc

SEQ ID NO: 6571 - DNA, 20 bp, Artificial Sequence
  Artificially Synthesized Primer Sequence
ccaatgctcattcgtcaaga

SEQ ID NO: 6572 - DNA, 20 bp, Artificial Sequence
  Artificially Synthesized Primer Sequence
gcgatggaagtccaagctac

SEQ ID NO: 6573 - DNA, 20 bp, Artificial Sequence
  Artificially Synthesized Primer Sequence
gagcctgacaagaagacgct

SEQ ID NO: 6574 - DNA, 20 bp, Artificial Sequence
  Artificially Synthesized Primer Sequence
ggcacacacattgacacaca

SEQ ID NO: 6575 - DNA, 20 bp, Artificial Sequence
  Artificially Synthesized Primer Sequence
ggcacacacattgacacaca

SEQ ID NO: 6576 - DNA, 20 bp, Artificial Sequence
  Artificially Synthesized Primer Sequence
gtcggtagggtcaagtacgg

SEQ ID NO: 6577 - DNA, 20 bp, Artificial Sequence
  Artificially Synthesized Primer Sequence
cctgccaaggacaagaagag

SEQ ID NO: 6578 - DNA, 20 bp, Artificial Sequence
  Artificially Synthesized Primer Sequence
tggctctctggtcgagtttt

SEQ ID NO: 6579 - DNA, 20 bp, Artificial Sequence
  Artificially Synthesized Primer Sequence
tgggggtgattaatggctaa

SEQ ID NO: 6580 - DNA, 20 bp, Artificial Sequence
  Artificially Synthesized Primer Sequence
ctcagattctgctgaacccc

SEQ ID NO: 6581 - DNA, 20 bp, Artificial Sequence
  Artificially Synthesized Primer Sequence
aattcctcgagcactgttgg

SEQ ID NO: 6582 - DNA, 20 bp, Artificial Sequence
  Artificially Synthesized Primer Sequence
gaagaggaggacgatggtga

SEQ ID NO: 6583 - DNA, 20 bp, Artificial Sequence
  Artificially Synthesized Primer Sequence
tgtatatgcattacgccccc

SEQ ID NO: 6584 - DNA, 20 bp, Artificial Sequence
  Artificially Synthesized Primer Sequence
ccaccagtacttcgtggacc

SEQ ID NO: 6585 - DNA, 20 bp, Artificial Sequence
  Artificially Synthesized Primer Sequence
caagccttgaaagcatgtga

SEQ ID NO: 6586 - DNA, 20 bp, Artificial Sequence
  Artificially Synthesized Primer Sequence
cgtttatactgccgccattt

SEQ ID NO: 6587 - DNA, 20 bp, Artificial Sequence
  Artificially Synthesized Primer Sequence
gctcaaaactccagcacgtt

SEQ ID NO: 6588 - DNA, 20 bp, Artificial Sequence
  Artificially Synthesized Primer Sequence
ggttcgaatgggttcttcct

SEQ ID NO: 6589 - DNA, 20 bp, Artificial Sequence
  Artificially Synthesized Primer Sequence
gcgcatttttatagtcggga

SEQ ID NO: 6590 - DNA, 20 bp, Artificial Sequence
  Artificially Synthesized Primer Sequence
agaagctccccaaggaacat

SEQ ID NO: 6591 - DNA, 20 bp, Artificial Sequence
  Artificially Synthesized Primer Sequence
agcctgtagcagcatggatt

SEQ ID NO: 6592 - DNA, 20 bp, Artificial Sequence
  Artificially Synthesized Primer Sequence
cacatcgacatgttccttgg

SEQ ID NO: 6593 - DNA, 20 bp, Artificial Sequence
  Artificially Synthesized Primer Sequence
tcactatagggcgaattggg

SEQ ID NO: 6594 - DNA, 20 bp, Artificial Sequence
  Artificially Synthesized Primer Sequence
cacacgacacaatcaccaca

SEQ ID NO: 6595 - DNA, 20 bp, Artificial Sequence
  Artificially Synthesized Primer Sequence
cataggctcgtacacgcaaa

SEQ ID NO: 6596 - DNA, 20 bp, Artificial Sequence
  Artificially Synthesized Primer Sequence
gcgattgtggtgattgtgtc

SEQ ID NO: 6597 - DNA, 20 bp, Artificial Sequence
  Artificially Synthesized Primer Sequence
gtcaccggaaaactctctgc

SEQ ID NO: 6598 - DNA, 18 bp, Artificial Sequence
  Artificially Synthesized Primer Sequence
gaacgtgctcctcgcact

SEQ ID NO: 6599 - DNA, 20 bp, Artificial Sequence
  Artificially Synthesized Primer Sequence
agggtcacagatcacagcgt

SEQ ID NO: 6600 - DNA, 20 bp, Artificial Sequence
  Artificially Synthesized Primer Sequence
ctggcatcatggaagaggag

SEQ ID NO: 6601 - DNA, 20 bp, Artificial Sequence
  Artificially Synthesized Primer Sequence
cgaatggccaaagaggatta

SEQ ID NO: 6602 - DNA, 20 bp, Artificial Sequence
  Artificially Synthesized Primer Sequence
attaacaagcaaaccagccg

SEQ ID NO: 6603 - DNA, 20 bp, Artificial Sequence
  Artificially Synthesized Primer Sequence
tgcagaaaactactgcaccg

SEQ ID NO: 6604 - DNA, 20 bp, Artificial Sequence
  Artificially Synthesized Primer Sequence
cgagtgcttgatgagggaat

SEQ ID NO: 6605 - DNA, 20 bp, Artificial Sequence
  Artificially Synthesized Primer Sequence
ttgccggaaaactacaaagg

SEQ ID NO: 6606 - DNA, 20 bp, Artificial Sequence
  Artificially Synthesized Primer Sequence
ctttcctcgacggtgatgat

SEQ ID NO: 6607 - DNA, 20 bp, Artificial Sequence
  Artificially Synthesized Primer Sequence
cgtcagtgcaaagaacgaaa

SEQ ID NO: 6608 - DNA, 20 bp, Artificial Sequence
  Artificially Synthesized Primer Sequence
gatcatcaccgtcgaggaag

SEQ ID NO: 6609 - DNA, 20 bp, Artificial Sequence
  Artificially Synthesized Primer Sequence
tccccatttaacggttgtgt

SEQ ID NO: 6610 - DNA, 20 bp, Artificial Sequence
  Artificially Synthesized Primer Sequence
tgggcaatgctagacaatca

SEQ ID NO: 6611 - DNA, 20 bp, Artificial Sequence
  Artificially Synthesized Primer Sequence
cgaggtgaaccaacagcata

SEQ ID NO: 6612 - DNA, 20 bp, Artificial Sequence
  Artificially Synthesized Primer Sequence
tacccgtgcacttcatcaac

SEQ ID NO: 6613 - DNA, 20 bp, Artificial Sequence
  Artificially Synthesized Primer Sequence
ctctcgtttgttcgcacttg

SEQ ID NO: 6614 - DNA, 20 bp, Artificial Sequence
  Artificially Synthesized Primer Sequence
ctcgcaaaaggtaacggaaa

SEQ ID NO: 6615 - DNA, 20 bp, Artificial Sequence
  Artificially Synthesized Primer Sequence
cggaatgagcaatcacacac

SEQ ID NO: 6616 - DNA, 20 bp, Artificial Sequence
  Artificially Synthesized Primer Sequence
tcaaggagttcgagcaggtt

SEQ ID NO: 6617 - DNA, 20 bp, Artificial Sequence
  Artificially Synthesized Primer Sequence
gcctgagccaagaatagcac

SEQ ID NO: 6618 - DNA, 20 bp, Artificial Sequence
  Artificially Synthesized Primer Sequence
gcctttagcgaatcttgcac

SEQ ID NO: 6619 - DNA, 20 bp, Artificial Sequence
  Artificially Synthesized Primer Sequence
gcgaatcccgtaactaacca

SEQ ID NO: 6620 - DNA, 20 bp, Artificial Sequence
  Artificially Synthesized Primer Sequence
cggcagcttatctcaaggac

SEQ ID NO: 6621 - DNA, 20 bp, Artificial Sequence
  Artificially Synthesized Primer Sequence
ctcgctttttgccttttgtc

SEQ ID NO: 6622 - DNA, 20 bp, Artificial Sequence
  Artificially Synthesized Primer Sequence
agacagggtgtaggcattgg

SEQ ID NO: 6623 - DNA, 20 bp, Artificial Sequence
  Artificially Synthesized Primer Sequence
acccaaaaggccaagctatt

SEQ ID NO: 6624 - DNA, 20 bp, Artificial Sequence
  Artificially Synthesized Primer Sequence
tgtcatttgcgaggatgtgt

SEQ ID NO: 6625 - DNA, 20 bp, Artificial Sequence
  Artificially Synthesized Primer Sequence
atgtttttgagcaaccaggc

SEQ ID NO: 6626 - DNA, 20 bp, Artificial Sequence
  Artificially Synthesized Primer Sequence
atctgatcatgcaccttccc

SEQ ID NO: 6627 - DNA, 20 bp, Artificial Sequence
  Artificially Synthesized Primer Sequence
ccaccaagacctgaaccatt

SEQ ID NO: 6628 - DNA, 20 bp, Artificial Sequence
  Artificially Synthesized Primer Sequence
ccgattcaggtgtagcgttt

SEQ ID NO: 6629 - DNA, 20 bp, Artificial Sequence
  Artificially Synthesized Primer Sequence
ggttccattcctgcagatgt

SEQ ID NO: 6630 - DNA, 20 bp, Artificial Sequence
  Artificially Synthesized Primer Sequence
gtttctcggcatgctaggag

SEQ ID NO: 6631 - DNA, 20 bp, Artificial Sequence
  Artificially Synthesized Primer Sequence
gaaggactggtacaccggaa

SEQ ID NO: 6632 - DNA, 20 bp, Artificial Sequence
  Artificially Synthesized Primer Sequence
ggttccattcctgcagatgt

SEQ ID NO: 6633 - DNA, 20 bp, Artificial Sequence
  Artificially Synthesized Primer Sequence
gcatttcaagaaggagcctg

SEQ ID NO: 6634 - DNA, 20 bp, Artificial Sequence
  Artificially Synthesized Primer Sequence
acctctgtgagctgcgattt

SEQ ID NO: 6635 - DNA, 20 bp, Artificial Sequence
  Artificially Synthesized Primer Sequence
agtccaccaccctagcacac

SEQ ID NO: 6636 - DNA, 20 bp, Artificial Sequence
  Artificially Synthesized Primer Sequence
ctcaagaagctgaccttggc

SEQ ID NO: 6637 - DNA, 20 bp, Artificial Sequence
  Artificially Synthesized Primer Sequence
gtctgaggcacatgcaaaga

SEQ ID NO: 6638 - DNA, 20 bp, Artificial Sequence
  Artificially Synthesized Primer Sequence
actggatgcttgatgatccc

SEQ ID NO: 6639 - DNA, 20 bp, Artificial Sequence
  Artificially Synthesized Primer Sequence
tagctggtcacctcgctctt

SEQ ID NO: 6640 - DNA, 20 bp, Artificial Sequence
  Artificially Synthesized Primer Sequence
tgctgcttgactcgttcatc

SEQ ID NO: 6641 - DNA, 20 bp, Artificial Sequence
  Artificially Synthesized Primer Sequence
actggctccaggacaacatc

SEQ ID NO: 6642 - DNA, 20 bp, Artificial Sequence
  Artificially Synthesized Primer Sequence
ttgtgcacgcatgtatcctt

SEQ ID NO: 6643 - DNA, 20 bp, Artificial Sequence
  Artificially Synthesized Primer Sequence
ctaagctagctccaaggcca

SEQ ID NO: 6644 - DNA, 20 bp, Artificial Sequence
  Artificially Synthesized Primer Sequence
actggctccaggacaacatc

SEQ ID NO: 6645 - DNA, 20 bp, Artificial Sequence
  Artificially Synthesized Primer Sequence
ggtccaaacttgcatggtct

SEQ ID NO: 6646 - DNA, 20 bp, Artificial Sequence
  Artificially Synthesized Primer Sequence
gggattttccagcaactgaa

SEQ ID NO: 6647 - DNA, 20 bp, Artificial Sequence
  Artificially Synthesized Primer Sequence
gggattttccagcaactgaa

SEQ ID NO: 6648 - DNA, 20 bp, Artificial Sequence
  Artificially Synthesized Primer Sequence
ggtccaaacttgcatggtct

SEQ ID NO: 6649 - DNA, 20 bp, Artificial Sequence
  Artificially Synthesized Primer Sequence
atatgccgccaagttaatgc

SEQ ID NO: 6650 - DNA, 20 bp, Artificial Sequence
  Artificially Synthesized Primer Sequence
ccagtctgcagcacatgagt

SEQ ID NO: 6651 - DNA, 20 bp, Artificial Sequence
  Artificially Synthesized Primer Sequence
gtattcatgtcgcacaacgg

SEQ ID NO: 6652 - DNA, 20 bp, Artificial Sequence
  Artificially Synthesized Primer Sequence
gtggaaatgatcccatggac

SEQ ID NO: 6653 - DNA, 20 bp, Artificial Sequence
  Artificially Synthesized Primer Sequence
gctcaggtgggatgaacaat

SEQ ID NO: 6654 - DNA, 20 bp, Artificial Sequence
  Artificially Synthesized Primer Sequence
cagaaccaacaccggaactt

SEQ ID NO: 6655 - DNA, 20 bp, Artificial Sequence
  Artificially Synthesized Primer Sequence
gtttggctgctcgttaggtc

SEQ ID NO: 6656 - DNA, 19 bp, Artificial Sequence
  Artificially Synthesized Primer Sequence
cgagatcataaggggtccg

SEQ ID NO: 6657 - DNA, 20 bp, Artificial Sequence
  Artificially Synthesized Primer Sequence
aatatcttgccaggccactg

SEQ ID NO: 6658 - DNA, 20 bp, Artificial Sequence
  Artificially Synthesized Primer Sequence
ttcatggagataaggctggg

SEQ ID NO: 6659 - DNA, 20 bp, Artificial Sequence
  Artificially Synthesized Primer Sequence
aagtgtcttggctcctggaa

SEQ ID NO: 6660 - DNA, 20 bp, Artificial Sequence
  Artificially Synthesized Primer Sequence
ggtcgagtgaccttgtcgat

SEQ ID NO: 6661 - DNA, 20 bp, Artificial Sequence
  Artificially Synthesized Primer Sequence
cgaatggaactttggttcgt

SEQ ID NO: 6662 - DNA, 20 bp, Artificial Sequence
  Artificially Synthesized Primer Sequence
aggtagcgatcatccctgtg

SEQ ID NO: 6663 - DNA, 20 bp, Artificial Sequence
  Artificially Synthesized Primer Sequence
taacgaaggaaaccagcacc

SEQ ID NO: 6664 - DNA, 20 bp, Artificial Sequence
  Artificially Synthesized Primer Sequence
gggaagttcattgcgtttgt

SEQ ID NO: 6665 - DNA, 20 bp, Artificial Sequence
  Artificially Synthesized Primer Sequence
taagctagttctcgcggcat

SEQ ID NO: 6666 - DNA, 20 bp, Artificial Sequence
  Artificially Synthesized Primer Sequence
cggtccatcatcttccgtat

SEQ ID NO: 6667 - DNA, 20 bp, Artificial Sequence
  Artificially Synthesized Primer Sequence
cacgacatcagagggacctt

SEQ ID NO: 6668 - DNA, 20 bp, Artificial Sequence
  Artificially Synthesized Primer Sequence
gttttgggaacacgatctgc

SEQ ID NO: 6669 - DNA, 20 bp, Artificial Sequence
  Artificially Synthesized Primer Sequence
cacttcttcatggtgggctt

SEQ ID NO: 6670 - DNA, 20 bp, Artificial Sequence
  Artificially Synthesized Primer Sequence
gtggagttgccaatgaaggt

SEQ ID NO: 6671 - DNA, 20 bp, Artificial Sequence
  Artificially Synthesized Primer Sequence
atccaacacatgccaagaca

SEQ ID NO: 6672 - DNA, 20 bp, Artificial Sequence
  Artificially Synthesized Primer Sequence
accttcattggcaactccac

SEQ ID NO: 6673 - DNA, 20 bp, Artificial Sequence
  Artificially Synthesized Primer Sequence
ctgcattcgtttttcaagca

SEQ ID NO: 6674 - DNA, 20 bp, Artificial Sequence
  Artificially Synthesized Primer Sequence
tctcagctacatcctgggct

SEQ ID NO: 6675 - DNA, 20 bp, Artificial Sequence
  Artificially Synthesized Primer Sequence
tcttagccttctgagcccaa

SEQ ID NO: 6676 - DNA, 20 bp, Artificial Sequence
  Artificially Synthesized Primer Sequence
agcccaggatgtagctgaga

SEQ ID NO: 6677 - DNA, 10 bp, Artificial Sequence
  Artificially Synthesized Primer Sequence
  MISC_FEATURE (1)..(10): n stands for any base
nnnnnnnnnn

SEQ ID NO: 6678 - DNA, 10 bp, Artificial Sequence
  Artificially Synthesized Primer Sequence
  MISC_FEATURE (1)..(10): n stands for any base
nnnnnnnnnn

SEQ ID NO: 6679 - DNA, 20 bp, Artificial Sequence
  Artificially Synthesized Primer Sequence
cacatgacaacacacccaca

SEQ ID NO: 6680 - DNA, 20 bp, Artificial Sequence
  Artificially Synthesized Primer Sequence
agcttccagagcaagagcag

SEQ ID NO: 6681 - DNA, 20 bp, Artificial Sequence
  Artificially Synthesized Primer Sequence
tgaaactttggatgctgctg

SEQ ID NO: 6682 - DNA, 20 bp, Artificial Sequence
  Artificially Synthesized Primer Sequence
gacattggagggagaccaga

SEQ ID NO: 6683 - DNA, 20 bp, Artificial Sequence
  Artificially Synthesized Primer Sequence
gaaagatctacggtggacgg

SEQ ID NO: 6684 - DNA, 20 bp, Artificial Sequence
  Artificially Synthesized Primer Sequence
ccaccaatgcctagcacttt

SEQ ID NO: 6685 - DNA, 20 bp, Artificial Sequence
  Artificially Synthesized Primer Sequence
ttgaaagttctgccttggct

SEQ ID NO: 6686 - DNA, 20 bp, Artificial Sequence
  Artificially Synthesized Primer Sequence
aagagaaggtttccccagga

SEQ ID NO: 6687 - DNA, 20 bp, Artificial Sequence
  Artificially Synthesized Primer Sequence
cagaaagatctacggtgggc

SEQ ID NO: 6688 - DNA, 20 bp, Artificial Sequence
  Artificially Synthesized Primer Sequence
agggctggatgatctgtttg

SEQ ID NO: 6689 - DNA, 20 bp, Artificial Sequence
  Artificially Synthesized Primer Sequence
gcgctaagagagttcatccg

SEQ ID NO: 6690 - DNA, 20 bp, Artificial Sequence
  Artificially Synthesized Primer Sequence
tttattctaggcggcacacc

SEQ ID NO: 6691 - DNA, 20 bp, Artificial Sequence
  Artificially Synthesized Primer Sequence
tgagctttattctaggcggc

SEQ ID NO: 6692 - DNA, 20 bp, Artificial Sequence
  Artificially Synthesized Primer Sequence
gcgctaagagagttcatccg

SEQ ID NO: 6693 - DNA, 20 bp, Artificial Sequence
  Artificially Synthesized Primer Sequence
tgaaactttggatgctgctg

SEQ ID NO: 6694 - DNA, 20 bp, Artificial Sequence
  Artificially Synthesized Primer Sequence
ttccatcatttcaaggaggc

SEQ ID NO: 6695 - DNA, 20 bp, Artificial Sequence
  Artificially Synthesized Primer Sequence
tccgcagaaaagcagtaagc

SEQ ID NO: 6696 - DNA, 20 bp, Artificial Sequence
  Artificially Synthesized Primer Sequence
gacctttgatgttggtccgt

SEQ ID NO: 6697 - DNA, 20 bp, Artificial Sequence
  Artificially Synthesized Primer Sequence
ccgaataaagcttagccacg

SEQ ID NO: 6698 - DNA, 20 bp, Artificial Sequence
  Artificially Synthesized Primer Sequence
ggtttcaggtgcactttggt

SEQ ID NO: 6699 - DNA, 20 bp, Artificial Sequence
  Artificially Synthesized Primer Sequence
tcctatcaggacgacaaggc

SEQ ID NO: 6700 - DNA, 20 bp, Artificial Sequence
  Artificially Synthesized Primer Sequence
taaatggtagggttgcaggc

SEQ ID NO: 6701 - DNA, 20 bp, Artificial Sequence
  Artificially Synthesized Primer Sequence
atagcttcttcctcctcgcc

SEQ ID NO: 6702 - DNA, 20 bp, Artificial Sequence
  Artificially Synthesized Primer Sequence
cagttcgatcatctccagca

SEQ ID NO: 6703 - DNA, 20 bp, Artificial Sequence
  Artificially Synthesized Primer Sequence
cacatcctcagtacgcatgg

SEQ ID NO: 6704 - DNA, 20 bp, Artificial Sequence
  Artificially Synthesized Primer Sequence
gtgaagagcaaacgagggag

SEQ ID NO: 6705 - DNA, 20 bp, Artificial Sequence
  Artificially Synthesized Primer Sequence
cgagctggcattgtcataga

SEQ ID NO: 6706 - DNA, 20 bp, Artificial Sequence
  Artificially Synthesized Primer Sequence
ggcaaaatcccagtcaaaga

SEQ ID NO: 6707 - DNA, 20 bp, Artificial Sequence
  Artificially Synthesized Primer Sequence
tcctccgacaaggttaatcg

SEQ ID NO: 6708 - DNA, 20 bp, Artificial Sequence
  Artificially Synthesized Primer Sequence
ctgccttgaatcattgctga

SEQ ID NO: 6709 - DNA, 20 bp, Artificial Sequence
  Artificially Synthesized Primer Sequence
cagcgacaagatctggaaca

SEQ ID NO: 6710 - DNA, 20 bp, Artificial Sequence
  Artificially Synthesized Primer Sequence
gcccactctgatcatcgtct

SEQ ID NO: 6711 - DNA, 20 bp, Artificial Sequence
  Artificially Synthesized Primer Sequence
gcacactcacaaaacgcatc

SEQ ID NO: 6712 - DNA, 20 bp, Artificial Sequence
  Artificially Synthesized Primer Sequence
cacaccaggatcatgtacgc

SEQ ID NO: 6713 - DNA, 20 bp, Artificial Sequence
  Artificially Synthesized Primer Sequence
atgaatccgatgtaccccaa

SEQ ID NO: 6714 - DNA, 20 bp, Artificial Sequence
  Artificially Synthesized Primer Sequence
tggagttgatgggtcgtgta

SEQ ID NO: 6715 - DNA, 20 bp, Artificial Sequence
  Artificially Synthesized Primer Sequence
ccaacacagagacaggctca

SEQ ID NO: 6716 - DNA, 20 bp, Artificial Sequence
  Artificially Synthesized Primer Sequence
aatccagattcccagcacag

SEQ ID NO: 6717 - DNA, 20 bp, Artificial Sequence
  Artificially Synthesized Primer Sequence
aactgatgccggtgataagc

SEQ ID NO: 6718 - DNA, 20 bp, Artificial Sequence
  Artificially Synthesized Primer Sequence
ctgcactcggcatacttgaa

SEQ ID NO: 6719 - DNA, 20 bp, Artificial Sequence
  Artificially Synthesized Primer Sequence
tacatccttggagagcctgg

SEQ ID NO: 6720 - DNA, 20 bp, Artificial Sequence
  Artificially Synthesized Primer Sequence
ttcaagtatgccgagtgcag

SEQ ID NO: 6721 - DNA, 20 bp, Artificial Sequence
  Artificially Synthesized Primer Sequence
aggtgccttgctttgactgt

SEQ ID NO: 6722 - DNA, 20 bp, Artificial Sequence
  Artificially Synthesized Primer Sequence
tttttcggttgtaggatggc

SEQ ID NO: 6723 - DNA, 20 bp, Artificial Sequence
  Artificially Synthesized Primer Sequence
accagcatagcttgggctaa

SEQ ID NO: 6724 - DNA, 20 bp, Artificial Sequence
  Artificially Synthesized Primer Sequence
tctggaactggtgtttccct

SEQ ID NO: 6725 - DNA, 20 bp, Artificial Sequence
  Artificially Synthesized Primer Sequence
cgttcttgaagccgactacc

SEQ ID NO: 6726 - DNA, 20 bp, Artificial Sequence
  Artificially Synthesized Primer Sequence
gagacgtcccaactctctgc

SEQ ID NO: 6727 - DNA, 20 bp, Artificial Sequence
  Artificially Synthesized Primer Sequence
ccacgatctcctccctgata

SEQ ID NO: 6728 - DNA, 20 bp, Artificial Sequence
  Artificially Synthesized Primer Sequence
tcatcgccataagagggaac

SEQ ID NO: 6729 - DNA, 20 bp, Artificial Sequence
  Artificially Synthesized Primer Sequence
acggaaggatttgcgatatg

SEQ ID NO: 6730 - DNA, 20 bp, Artificial Sequence
  Artificially Synthesized Primer Sequence
ttgtccctttccctgtcatc

SEQ ID NO: 6731 - DNA, 20 bp, Artificial Sequence
  Artificially Synthesized Primer Sequence
gtaccccgttgttcatccag

SEQ ID NO: 6732 - DNA, 20 bp, Artificial Sequence
  Artificially Synthesized Primer Sequence
tgatctagggtcccaggcta

SEQ ID NO: 6733 - DNA, 20 bp, Artificial Sequence
  Artificially Synthesized Primer Sequence
acgaggggttggagctattt

SEQ ID NO: 6734 - DNA, 20 bp, Artificial Sequence
  Artificially Synthesized Primer Sequence
gggtatgctccttggtttca

SEQ ID NO: 6735 - DNA, 20 bp, Artificial Sequence
  Artificially Synthesized Primer Sequence
tggctactgagccatcaaca

SEQ ID NO: 6736 - DNA, 20 bp, Artificial Sequence
  Artificially Synthesized Primer Sequence
caaggagcatacccctttga

SEQ ID NO: 6737 - DNA, 20 bp, Artificial Sequence
  Artificially Synthesized Primer Sequence
ccaaggtcaacgaggacttc

SEQ ID NO: 6738 - DNA, 20 bp, Artificial Sequence
  Artificially Synthesized Primer Sequence
gcctttctcctcttgacgtg

SEQ ID NO: 6739 - DNA, 20 bp, Artificial Sequence
  Artificially Synthesized Primer Sequence
tacccatggacatgaaagca

SEQ ID NO: 6740 - DNA, 20 bp, Artificial Sequence
  Artificially Synthesized Primer Sequence
ggaaatgttcaaccgagacc

SEQ ID NO: 6741 - DNA, 20 bp, Artificial Sequence
  Artificially Synthesized Primer Sequence
caaggagagcggtgctaaac

SEQ ID NO: 6742 - DNA, 20 bp, Artificial Sequence
  Artificially Synthesized Primer Sequence
agctcctcttgcagcttctg

SEQ ID NO: 6743 - DNA, 20 bp, Artificial Sequence
  Artificially Synthesized Primer Sequence
ggacctaactgaaagcagcg

SEQ ID NO: 6744 - DNA, 20 bp, Artificial Sequence
  Artificially Synthesized Primer Sequence
ctacaacatccccaagggtg

SEQ ID NO: 6745 - DNA, 20 bp, Artificial Sequence
  Artificially Synthesized Primer Sequence
cctttcatggcaggtcattt

SEQ ID NO: 6746 - DNA, 20 bp, Artificial Sequence
  Artificially Synthesized Primer Sequence
accacggaaaacatacgagc

SEQ ID NO: 6747 - DNA, 20 bp, Artificial Sequence
  Artificially Synthesized Primer Sequence
aaagcctcggaacagacaga

SEQ ID NO: 6748 - DNA, 20 bp, Artificial Sequence
  Artificially Synthesized Primer Sequence
aaacagggaatcagctgcaa

SEQ ID NO: 6749 - DNA, 20 bp, Artificial Sequence
  Artificially Synthesized Primer Sequence
cgttctacgcctacctgctc

SEQ ID NO: 6750 - DNA, 20 bp, Artificial Sequence
  Artificially Synthesized Primer Sequence
ctgctcttagtccacctgcc

SEQ ID NO: 6751 - DNA, 20 bp, Artificial Sequence
  Artificially Synthesized Primer Sequence
ctgctcttagtccacctgcc

SEQ ID NO: 6752 - DNA, 20 bp, Artificial Sequence
  Artificially Synthesized Primer Sequence
cgttctacgcctacctgctc

SEQ ID NO: 6753 - DNA, 20 bp, Artificial Sequence
  Artificially Synthesized Primer Sequence
gacctatcatctggggctga

SEQ ID NO: 6754 - DNA, 20 bp, Artificial Sequence
  Artificially Synthesized Primer Sequence
gaataggatcccaacagcga

SEQ ID NO: 6755 - DNA, 20 bp, Artificial Sequence
  Artificially Synthesized Primer Sequence
agcaatggatggcaaagaag

SEQ ID NO: 6756 - DNA, 20 bp, Artificial Sequence
  Artificially Synthesized Primer Sequence
tagcaagacctgcctgtgtg

SEQ ID NO: 6757 - DNA, 20 bp, Artificial Sequence
  Artificially Synthesized Primer Sequence
ccaacaaagaacattgggct

SEQ ID NO: 6758 - DNA, 20 bp, Artificial Sequence
  Artificially Synthesized Primer Sequence
ctcccaccagactttgcatt

SEQ ID NO: 6759 - DNA, 20 bp, Artificial Sequence
  Artificially Synthesized Primer Sequence
agcttgtccaatgtcgaacc

SEQ ID NO: 6760 - DNA, 20 bp, Artificial Sequence
  Artificially Synthesized Primer Sequence
ctcaggcaatgcatcaaatg

SEQ ID NO: 6761 - DNA, 20 bp, Artificial Sequence
  Artificially Synthesized Primer Sequence
ccgctcttcaagtcaactcc

SEQ ID NO: 6762 - DNA, 20 bp, Artificial Sequence
  Artificially Synthesized Primer Sequence
atgcatctctcatggaaggg

SEQ ID NO: 6763 - DNA, 20 bp, Artificial Sequence
  Artificially Synthesized Primer Sequence
atgcatctctcatggaaggg

SEQ ID NO: 6764 - DNA, 20 bp, Artificial Sequence
  Artificially Synthesized Primer Sequence
tcaagtcaactccagcttcg

SEQ ID NO: 6765 - DNA, 20 bp, Artificial Sequence
  Artificially Synthesized Primer Sequence
ttctgtgagtgtgggagcag

SEQ ID NO: 6766 - DNA, 20 bp, Artificial Sequence
  Artificially Synthesized Primer Sequence
atcacttggtcgggtcactc

SEQ ID NO: 6767 - DNA, 20 bp, Artificial Sequence
  Artificially Synthesized Primer Sequence
gactttgaagccgatggaaa

SEQ ID NO: 6768 - DNA, 20 bp, Artificial Sequence
  Artificially Synthesized Primer Sequence
cctttgtagcaaggacagcc

SEQ ID NO: 6769 - DNA, 20 bp, Artificial Sequence
  Artificially Synthesized Primer Sequence
tgctttaggtccattttggg

SEQ ID NO: 6770 - DNA, 20 bp, Artificial Sequence
  Artificially Synthesized Primer Sequence
acctgcttcgtcctgaaaga

SEQ ID NO: 6771 - DNA, 20 bp, Artificial Sequence
  Artificially Synthesized Primer Sequence
acctgcttcgtcctgaaaga

SEQ ID NO: 6772 - DNA, 20 bp, Artificial Sequence
  Artificially Synthesized Primer Sequence
ataggtggctccatcgctaa

SEQ ID NO: 6773 - DNA, 20 bp, Artificial Sequence
  Artificially Synthesized Primer Sequence
tgctgtgatgatagcttgcc

SEQ ID NO: 6774 - DNA, 20 bp, Artificial Sequence
  Artificially Synthesized Primer Sequence
ttggggacagaagtccattc

SEQ ID NO: 6775 - DNA, 20 bp, Artificial Sequence
  Artificially Synthesized Primer Sequence
tgaaccaatatgacccagca

SEQ ID NO: 6776 - DNA, 20 bp, Artificial Sequence
  Artificially Synthesized Primer Sequence
cctccttcattggagctgaa

SEQ ID NO: 6777 - DNA, 20 bp, Artificial Sequence
  Artificially Synthesized Primer Sequence
agctctctcaagcaaaagcg

SEQ ID NO: 6778 - DNA, 20 bp, Artificial Sequence
  Artificially Synthesized Primer Sequence
gactcacggaccgatcattt

SEQ ID NO: 6779 - DNA, 20 bp, Artificial Sequence
  Artificially Synthesized Primer Sequence
gactcacggaccgatcattt

SEQ ID NO: 6780 - DNA, 20 bp, Artificial Sequence
  Artificially Synthesized Primer Sequence
tggcgtcctaatagctgctt

SEQ ID NO: 6781 - DNA, 20 bp, Artificial Sequence
  Artificially Synthesized Primer Sequence
aacaagttcgacggcaagat

SEQ ID NO: 6782 - DNA, 20 bp, Artificial Sequence
  Artificially Synthesized Primer Sequence
catgtcacatcctatgcgct

SEQ ID NO: 6783 - DNA, 20 bp, Artificial Sequence
  Artificially Synthesized Primer Sequence
tcacatcctatgcgctggta

SEQ ID NO: 6784 - DNA, 20 bp, Artificial Sequence
  Artificially Synthesized Primer Sequence
atgtacgacggcaacgactt

SEQ ID NO: 6785 - DNA, 20 bp, Artificial Sequence
  Artificially Synthesized Primer Sequence
gcacactgcccttacacaga

SEQ ID NO: 6786 - DNA, 20 bp, Artificial Sequence
  Artificially Synthesized Primer Sequence
aagtgccggaatgaaatgac

SEQ ID NO: 6787 - DNA, 21 bp, Artificial Sequence
  Artificially Synthesized Primer Sequence
cctccttttgcatgtatcctg

SEQ ID NO: 6788 - DNA, 20 bp, Artificial Sequence
  Artificially Synthesized Primer Sequence
tgttctacacattcaggccg

SEQ ID NO: 6789 - DNA, 20 bp, Artificial Sequence
  Artificially Synthesized Primer Sequence
gattggtggcaaggttcact

SEQ ID NO: 6790 - DNA, 20 bp, Artificial Sequence
  Artificially Synthesized Primer Sequence
tcgtaggacctgcttttgct

SEQ ID NO: 6791 - DNA, 20 bp, Artificial Sequence
  Artificially Synthesized Primer Sequence
cctgccagtcccattacact

SEQ ID NO: 6792 - DNA, 20 bp, Artificial Sequence
  Artificially Synthesized Primer Sequence
gacagctctccacacaagca

SEQ ID NO: 6793 - DNA, 20 bp, Artificial Sequence
  Artificially Synthesized Primer Sequence
aagacacgtggtatgggagc

SEQ ID NO: 6794 - DNA, 20 bp, Artificial Sequence
  Artificially Synthesized Primer Sequence
cctgggcttctccttcttct

SEQ ID NO: 6795 - DNA, 20 bp, Artificial Sequence
  Artificially Synthesized Primer Sequence
gcaacagcagagaaggaaca

SEQ ID NO: 6796 - DNA, 20 bp, Artificial Sequence
  Artificially Synthesized Primer Sequence
taagtgtgctcgtgtccagc

SEQ ID NO: 6797 - DNA, 20 bp, Artificial Sequence
  Artificially Synthesized Primer Sequence
agttgggacaacaaagcagg

SEQ ID NO: 6798 - DNA, 20 bp, Artificial Sequence
  Artificially Synthesized Primer Sequence
ggccacatgacatcatcaac

SEQ ID NO: 6799 - DNA, 20 bp, Artificial Sequence
  Artificially Synthesized Primer Sequence
cacgaggccaccattttatt

SEQ ID NO: 6800 - DNA, 20 bp, Artificial Sequence
  Artificially Synthesized Primer Sequence
cggctctccatagactgctc

SEQ ID NO: 6801 - DNA, 20 bp, Artificial Sequence
  Artificially Synthesized Primer Sequence
accgttaatccagcagcatc

SEQ ID NO: 6802 - DNA, 20 bp, Artificial Sequence
  Artificially Synthesized Primer Sequence
ggccgggtttatataaggga

SEQ ID NO: 6803 - DNA, 20 bp, Artificial Sequence
  Artificially Synthesized Primer Sequence
ttgcagatgctgctggatta

SEQ ID NO: 6804 - DNA, 20 bp, Artificial Sequence
  Artificially Synthesized Primer Sequence
aaagggcaaattgtgaatgg

SEQ ID NO: 6805 - DNA, 20 bp, Artificial Sequence
  Artificially Synthesized Primer Sequence
gcagcacaagaaaagaaggg

SEQ ID NO: 6806 - DNA, 20 bp, Artificial Sequence
  Artificially Synthesized Primer Sequence
gcaaactcctcagggtcaaa

SEQ ID NO: 6807 - DNA, 20 bp, Artificial Sequence
  Artificially Synthesized Primer Sequence
gccaacaatagcgtcgattt

SEQ ID NO: 6808 - DNA, 20 bp, Artificial Sequence
  Artificially Synthesized Primer Sequence
aagaaatgaccaccgtgagg

SEQ ID NO: 6809 - DNA, 20 bp, Artificial Sequence
  Artificially Synthesized Primer Sequence
tggtacgtgctaggcacaag

SEQ ID NO: 6810 - DNA, 20 bp, Artificial Sequence
  Artificially Synthesized Primer Sequence
caatgttggcccacttcttt

SEQ ID NO: 6811 - DNA, 20 bp, Artificial Sequence
  Artificially Synthesized Primer Sequence
gttgcttcttctgagcagcc

SEQ ID NO: 6812 - DNA, 20 bp, Artificial Sequence
  Artificially Synthesized Primer Sequence
gagagttcttcggtcgatgg

SEQ ID NO: 6813 - DNA, 20 bp, Artificial Sequence
  Artificially Synthesized Primer Sequence
ggataagcgtgctctgaagg

SEQ ID NO: 6814 - DNA, 20 bp, Artificial Sequence
  Artificially Synthesized Primer Sequence
tggtccctagaacccagttg

SEQ ID NO: 6815 - DNA, 20 bp, Artificial Sequence
  Artificially Synthesized Primer Sequence
gccaggctttgcaaattaga

SEQ ID NO: 6816 - DNA, 21 bp, Artificial Sequence
  Artificially Synthesized Primer Sequence
caagctcgtgaagttaatggc

SEQ ID NO: 6817 - DNA, 20 bp, Artificial Sequence
  Artificially Synthesized Primer Sequence
ttttgtctgtcggtccttcc

SEQ ID NO: 6818 - DNA, 20 bp, Artificial Sequence
  Artificially Synthesized Primer Sequence
ctaaacagcaaacggggaaa

SEQ ID NO: 6819 - DNA, 20 bp, Artificial Sequence
  Artificially Synthesized Primer Sequence
ggagcgaactaaacaaggca

SEQ ID NO: 6820 - DNA, 20 bp, Artificial Sequence
  Artificially Synthesized Primer Sequence
tccacaatcccctacagctc

SEQ ID NO: 6821 - DNA, 20 bp, Artificial Sequence
  Artificially Synthesized Primer Sequence
aaccgattggaatcgttctg

SEQ ID NO: 6822 - DNA, 20 bp, Artificial Sequence
  Artificially Synthesized Primer Sequence
ggataaacggaaagaagggc

SEQ ID NO: 6823 - DNA, 20 bp, Artificial Sequence
  Artificially Synthesized Primer Sequence
ctttgtcatccggtgctttt

SEQ ID NO: 6824 - DNA, 19 bp, Artificial Sequence
  Artificially Synthesized Primer Sequence
gtcatcgccttccttctcc

SEQ ID NO: 6825 - DNA, 20 bp, Artificial Sequence
  Artificially Synthesized Primer Sequence
cgaaaatatgcccagcaagt

SEQ ID NO: 6826 - DNA, 20 bp, Artificial Sequence
  Artificially Synthesized Primer Sequence
tgtttggttgactgtcccaa

SEQ ID NO: 6827 - DNA, 20 bp, Artificial Sequence
  Artificially Synthesized Primer Sequence
ccagtgagagggccaattta

SEQ ID NO: 6828 - DNA, 20 bp, Artificial Sequence
  Artificially Synthesized Primer Sequence
cagaagggccatgtcttcat

SEQ ID NO: 6829 - DNA, 20 bp, Artificial Sequence
  Artificially Synthesized Primer Sequence
ttgaggaggaatgccaactt

SEQ ID NO: 6830 - DNA, 20 bp, Artificial Sequence
  Artificially Synthesized Primer Sequence
gagtttgatgaccccgagaa

SEQ ID NO: 6831 - DNA, 20 bp, Artificial Sequence
  Artificially Synthesized Primer Sequence
gagtttgatgaccccgagaa

SEQ ID NO: 6832 - DNA, 20 bp, Artificial Sequence
  Artificially Synthesized Primer Sequence
cagccggaattactttgacc

SEQ ID NO: 6833 - DNA, 20 bp, Artificial Sequence
  Artificially Synthesized Primer Sequence
agtggaagagccccaatttt

SEQ ID NO: 6834 - DNA, 20 bp, Artificial Sequence
  Artificially Synthesized Primer Sequence
aactccttctccccctgtgt

SEQ ID NO: 6835 - DNA, 20 bp, Artificial Sequence
  Artificially Synthesized Primer Sequence
gaaaacaaacctcccctcct

SEQ ID NO: 6836 - DNA, 20 bp, Artificial Sequence
  Artificially Synthesized Primer Sequence
ctggatgcgtttaccaacct

SEQ ID NO: 6837 - DNA, 10 bp, Artificial Sequence
  Artificially Synthesized Primer Sequence
  MISC_FEATURE (1)..(10): n stands for any base
nnnnnnnnnn

SEQ ID NO: 6838 - DNA, 10 bp, Artificial Sequence
  Artificially Synthesized Primer Sequence
  MISC_FEATURE (1)..(10): n stands for any base
nnnnnnnnnn

SEQ ID NO: 6839 - DNA, 20 bp, Artificial Sequence
  Artificially Synthesized Primer Sequence
tggtcattcccttcgctatc

SEQ ID NO: 6840 - DNA, 20 bp, Artificial Sequence
  Artificially Synthesized Primer Sequence
caccgccatcttcatattcc

SEQ ID NO: 6841 - DNA, 20 bp, Artificial Sequence
  Artificially Synthesized Primer Sequence
ggcatcgttccctacaaaaa

SEQ ID NO: 6842 - DNA, 20 bp, Artificial Sequence
  Artificially Synthesized Primer Sequence
aagaggggaccttggagaaa

SEQ ID NO: 6843 - DNA, 20 bp, Artificial Sequence
  Artificially Synthesized Primer Sequence
ccgaacccatcataggctaa

SEQ ID NO: 6844 - DNA, 20 bp, Artificial Sequence
  Artificially Synthesized Primer Sequence
tgggattctgtctttcctgg

SEQ ID NO: 6845 - DNA, 20 bp, Artificial Sequence
  Artificially Synthesized Primer Sequence
ggcgctgtactactgaaggc

SEQ ID NO: 6846 - DNA, 20 bp, Artificial Sequence
  Artificially Synthesized Primer Sequence
gctttcagctctttcggatg

SEQ ID NO: 6847 - DNA, 20 bp, Artificial Sequence
  Artificially Synthesized Primer Sequence
ggtacactgcaattgccaaa

SEQ ID NO: 6848 - DNA, 20 bp, Artificial Sequence
  Artificially Synthesized Primer Sequence
cacagaaatttgagctgcca

SEQ ID NO: 6849 - DNA, 20 bp, Artificial Sequence
  Artificially Synthesized Primer Sequence
cctcttgataacgacgagcc

SEQ ID NO: 6850 - DNA, 20 bp, Artificial Sequence
  Artificially Synthesized Primer Sequence
aatcggcagaacagaaatgg

SEQ ID NO: 6851 - DNA, 20 bp, Artificial Sequence
  Artificially Synthesized Primer Sequence
tccagactctctggcgctat

SEQ ID NO: 6852 - DNA, 20 bp, Artificial Sequence
  Artificially Synthesized Primer Sequence
ggcgggctctatgaacacta

SEQ ID NO: 6853 - DNA, 20 bp, Artificial Sequence
  Artificially Synthesized Primer Sequence
gtcaccggaaaactctctgc

SEQ ID NO: 6854 - DNA, 18 bp, Artificial Sequence
  Artificially Synthesized Primer Sequence
gaacgtgctcctcgcact

SEQ ID NO: 6855 - DNA, 20 bp, Artificial Sequence
  Artificially Synthesized Primer Sequence
gggaaaaggcacaattcaga

SEQ ID NO: 6856 - DNA, 20 bp, Artificial Sequence
  Artificially Synthesized Primer Sequence
ggcttgatattgagggggat

SEQ ID NO: 6857 - DNA, 20 bp, Artificial Sequence
  Artificially Synthesized Primer Sequence
ttcaaactggcattgctcac

SEQ ID NO: 6858 - DNA, 20 bp, Artificial Sequence
  Artificially Synthesized Primer Sequence
cttgctgctagctgcttcct

SEQ ID NO: 6859 - DNA, 20 bp, Artificial Sequence
  Artificially Synthesized Primer Sequence
cgtgaaaatgaaaggccact

SEQ ID NO: 6860 - DNA, 20 bp, Artificial Sequence
  Artificially Synthesized Primer Sequence
gtgacctacgaggttcccaa

SEQ ID NO: 6861 - DNA, 20 bp, Artificial Sequence
  Artificially Synthesized Primer Sequence
ggcaggacgatcatcacaat

SEQ ID NO: 6862 - DNA, 20 bp, Artificial Sequence
  Artificially Synthesized Primer Sequence
tacgtatcggtgcgtctcag

SEQ ID NO: 6863 - DNA, 20 bp, Artificial Sequence
  Artificially Synthesized Primer Sequence
tttttaggcaagaaccggac

SEQ ID NO: 6864 - DNA, 20 bp, Artificial Sequence
  Artificially Synthesized Primer Sequence
atcaaacagtggctcccaac

SEQ ID NO: 6865 - DNA, 20 bp, Artificial Sequence
  Artificially Synthesized Primer Sequence
ctagagttgcaaaggtcgcc

SEQ ID NO: 6866 - DNA, 20 bp, Artificial Sequence
  Artificially Synthesized Primer Sequence
gtcccagtggattacgctgt

SEQ ID NO: 6867 - DNA, 20 bp, Artificial Sequence
  Artificially Synthesized Primer Sequence
gaaaagggcgtctcgtgtag

SEQ ID NO: 6868 - DNA, 20 bp, Artificial Sequence
  Artificially Synthesized Primer Sequence
aagagatgactccgctccaa

SEQ ID NO: 6869 - DNA, 20 bp, Artificial Sequence
  Artificially Synthesized Primer Sequence
caaaggaaaaggaaggaggg

SEQ ID NO: 6870 - DNA, 20 bp, Artificial Sequence
  Artificially Synthesized Primer Sequence
ataatgagggatgagtgcgg

SEQ ID NO: 6871 - DNA, 20 bp, Artificial Sequence
  Artificially Synthesized Primer Sequence
cgcgtaattttacacccaca

SEQ ID NO: 6872 - DNA, 20 bp, Artificial Sequence
  Artificially Synthesized Primer Sequence
tcagttcttcagggattcgc

SEQ ID NO: 6873 - DNA, 20 bp, Artificial Sequence
  Artificially Synthesized Primer Sequence
tgcagtaatgacctttcccc

SEQ ID NO: 6874 - DNA, 20 bp, Artificial Sequence
  Artificially Synthesized Primer Sequence
ccccatatcatcctcccttt

SEQ ID NO: 6875 - DNA, 20 bp, Artificial Sequence
  Artificially Synthesized Primer Sequence
ccccatatcatcctcccttt

SEQ ID NO: 6876 - DNA, 20 bp, Artificial Sequence
  Artificially Synthesized Primer Sequence
gcagtaatgacctttcccca

SEQ ID NO: 6877 - DNA, 20 bp, Artificial Sequence
  Artificially Synthesized Primer Sequence
tccgcgcaaatgtattgtta

SEQ ID NO: 6878 - DNA, 20 bp, Artificial Sequence
  Artificially Synthesized Primer Sequence
gaagaaggaaaacaaggggc

SEQ ID NO: 6879 - DNA, 20 bp, Artificial Sequence
  Artificially Synthesized Primer Sequence
aggggtctaatggggtgatt

SEQ ID NO: 6880 - DNA, 20 bp, Artificial Sequence
  Artificially Synthesized Primer Sequence
ggaagtgtgaggctctctgg

SEQ ID NO: 6881 - DNA, 10 bp, Artificial Sequence
  Artificially Synthesized Primer Sequence
  MISC_FEATURE (1)..(10): n stands for any base
nnnnnnnnnn

SEQ ID NO: 6882 - DNA, 10 bp, Artificial Sequence
  Artificially Synthesized Primer Sequence
  MISC_FEATURE (1)..(10): n stands for any base
nnnnnnnnnn

SEQ ID NO: 6883 - DNA, 19 bp, Artificial Sequence
  Artificially Synthesized Primer Sequence
ctcatgcgccatgcatatt

SEQ ID NO: 6884 - DNA, 20 bp, Artificial Sequence
  Artificially Synthesized Primer Sequence
acaacgggaacctgatgaag

SEQ ID NO: 6885 - DNA, 20 bp, Artificial Sequence
  Artificially Synthesized Primer Sequence
gcaaccggagaaggatcata

SEQ ID NO: 6886 - DNA, 20 bp, Artificial Sequence
  Artificially Synthesized Primer Sequence
tgctgctggacacattcttc

SEQ ID NO: 6887 - DNA, 20 bp, Artificial Sequence
  Artificially Synthesized Primer Sequence
tgtgccgtcagacttgtgat

SEQ ID NO: 6888 - DNA, 20 bp, Artificial Sequence
  Artificially Synthesized Primer Sequence
taagacatccggctgttggt

SEQ ID NO: 6889 - DNA, 20 bp, Artificial Sequence
  Artificially Synthesized Primer Sequence
gctctggcatccatagcttc

SEQ ID NO: 6890 - DNA, 20 bp, Artificial Sequence
  Artificially Synthesized Primer Sequence
tgcatcagagcaatagcacc

SEQ ID NO: 6891 - DNA, 20 bp, Artificial Sequence
  Artificially Synthesized Primer Sequence
cgtgtttagcaccacccttt

SEQ ID NO: 6892 - DNA, 20 bp, Artificial Sequence
  Artificially Synthesized Primer Sequence
tgaggagaaaaaggaagcca

SEQ ID NO: 6893 - DNA, 20 bp, Artificial Sequence
  Artificially Synthesized Primer Sequence
gtacccgatcctgtcgaaga

SEQ ID NO: 6894 - DNA, 20 bp, Artificial Sequence
  Artificially Synthesized Primer Sequence
cggaaaggatcgtttgtcat

SEQ ID NO: 6895 - DNA, 20 bp, Artificial Sequence
  Artificially Synthesized Primer Sequence
acaagggtcacttggcagag

SEQ ID NO: 6896 - DNA, 20 bp, Artificial Sequence
  Artificially Synthesized Primer Sequence
gcctacaggcagtcacaaca

SEQ ID NO: 6897 - DNA, 20 bp, Artificial Sequence
  Artificially Synthesized Primer Sequence
gaagaacgtggcttcctcag

SEQ ID NO: 6898 - DNA, 20 bp, Artificial Sequence
  Artificially Synthesized Primer Sequence
atgcccagatagcaaggatg

SEQ ID NO: 6899 - DNA, 20 bp, Artificial Sequence
  Artificially Synthesized Primer Sequence
tgcagttcactgtagtcgcc

SEQ ID NO: 6900 - DNA, 20 bp, Artificial Sequence
  Artificially Synthesized Primer Sequence
catccttgctatctgggcat

SEQ ID NO: 6901 - DNA, 20 bp, Artificial Sequence
  Artificially Synthesized Primer Sequence
cgaagacctcactccaaagc

SEQ ID NO: 6902 - DNA, 20 bp, Artificial Sequence
  Artificially Synthesized Primer Sequence
aaaagcaaacctagcaggca

SEQ ID NO: 6903 - DNA, 20 bp, Artificial Sequence
  Artificially Synthesized Primer Sequence
agctgatgatggagcaaacc

SEQ ID NO: 6904 - DNA, 20 bp, Artificial Sequence
  Artificially Synthesized Primer Sequence
aagacctcactccaaagcga

SEQ ID NO: 6905 - DNA, 20 bp, Artificial Sequence
  Artificially Synthesized Primer Sequence
gtggtgggctgagaacaaat

SEQ ID NO: 6906 - DNA, 20 bp, Artificial Sequence
  Artificially Synthesized Primer Sequence
cgttcaaggagacaacagca

SEQ ID NO: 6907 - DNA, 20 bp, Artificial Sequence
  Artificially Synthesized Primer Sequence
cgttcaaggagacaacagca

SEQ ID NO: 6908 - DNA, 20 bp, Artificial Sequence
  Artificially Synthesized Primer Sequence
gtggtgggctgagaacaaat

SEQ ID NO: 6909 - DNA, 10 bp, Artificial Sequence
  Artificially Synthesized Primer Sequence
  MISC_FEATURE (1)..(10): n stands for any base
nnnnnnnnnn

SEQ ID NO: 6910 - DNA, 10 bp, Artificial Sequence
  Artificially Synthesized Primer Sequence
  MISC_FEATURE (1)..(10): n stands for any base
nnnnnnnnnn

SEQ ID NO: 6911 - DNA, 20 bp, Artificial Sequence
  Artificially Synthesized Primer Sequence
ccatctcacaggcattttga

SEQ ID NO: 6912 - DNA, 20 bp, Artificial Sequence
  Artificially Synthesized Primer Sequence
ccagggcatccacttctact

SEQ ID NO: 6913 - DNA, 20 bp, Artificial Sequence
  Artificially Synthesized Primer Sequence
ggctttcgtgagagcaaaac

SEQ ID NO: 6914 - DNA, 20 bp, Artificial Sequence
  Artificially Synthesized Primer Sequence
tgatgcccactcgtaaatca

SEQ ID NO: 6915 - DNA, 20 bp, Artificial Sequence
  Artificially Synthesized Primer Sequence
tcgtcctcacgatcttcctc

SEQ ID NO: 6916 - DNA, 20 bp, Artificial Sequence
  Artificially Synthesized Primer Sequence
cctgacttcaatggtccgat

SEQ ID NO: 6917 - DNA, 20 bp, Artificial Sequence
  Artificially Synthesized Primer Sequence
agcttgctgattcagtcggt

SEQ ID NO: 6918 - DNA, 20 bp, Artificial Sequence
  Artificially Synthesized Primer Sequence
cacgaaatgatgtggagcac

SEQ ID NO: 6919 - DNA, 20 bp, Artificial Sequence
  Artificially Synthesized Primer Sequence
aagcaatcgtaaaaccgacg

SEQ ID NO: 6920 - DNA, 20 bp, Artificial Sequence
  Artificially Synthesized Primer Sequence
tttggaaggagtatggggaa

SEQ ID NO: 6921 - DNA, 20 bp, Artificial Sequence
  Artificially Synthesized Primer Sequence
ggcgacacaaccatctttct

SEQ ID NO: 6922 - DNA, 20 bp, Artificial Sequence
  Artificially Synthesized Primer Sequence
actaaaaggagccccatgct

SEQ ID NO: 6923 - DNA, 20 bp, Artificial Sequence
  Artificially Synthesized Primer Sequence
ctatctggtgaaactccgcc

SEQ ID NO: 6924 - DNA, 20 bp, Artificial Sequence
  Artificially Synthesized Primer Sequence
cttgattgtcgtgttgtccg

SEQ ID NO: 6925 - DNA, 20 bp, Artificial Sequence
  Artificially Synthesized Primer Sequence
cgatacgccttcgtcttctc

SEQ ID NO: 6926 - DNA, 20 bp, Artificial Sequence
  Artificially Synthesized Primer Sequence
tttttgattggataagcccg

SEQ ID NO: 6927 - DNA, 20 bp, Artificial Sequence
  Artificially Synthesized Primer Sequence
aaatccgtcgacgacaagac

SEQ ID NO: 6928 - DNA, 20 bp, Artificial Sequence
  Artificially Synthesized Primer Sequence
aaggtctccaagctcaccaa

SEQ ID NO: 6929 - DNA, 20 bp, Artificial Sequence
  Artificially Synthesized Primer Sequence
gacgatcagttccccgtaga

SEQ ID NO: 6930 - DNA, 20 bp, Artificial Sequence
  Artificially Synthesized Primer Sequence
aactcccgaaacaaaatccc

SEQ ID NO: 6931 - DNA, 20 bp, Artificial Sequence
  Artificially Synthesized Primer Sequence
aactcccgaaacaaaatccc

SEQ ID NO: 6932 - DNA, 20 bp, Artificial Sequence
  Artificially Synthesized Primer Sequence
gacgatcagttccccgtaga

SEQ ID NO: 6933 - DNA, 20 bp, Artificial Sequence
  Artificially Synthesized Primer Sequence
acggcagtaccacctaaacg

SEQ ID NO: 6934 - DNA, 20 bp, Artificial Sequence
  Artificially Synthesized Primer Sequence
ataaaggggaaattgtgggc

SEQ ID NO: 6935 - DNA, 20 bp, Artificial Sequence
  Artificially Synthesized Primer Sequence
ctgatccaccttccctttga

SEQ ID NO: 6936 - DNA, 20 bp, Artificial Sequence
  Artificially Synthesized Primer Sequence
gagttgatttcggtggcagt

SEQ ID NO: 6937 - DNA, 20 bp, Artificial Sequence
  Artificially Synthesized Primer Sequence
gaagaacgtggcttcctcag

SEQ ID NO: 6938 - DNA, 20 bp, Artificial Sequence
  Artificially Synthesized Primer Sequence
atgcccagatagcaaggatg

SEQ ID NO: 6939 - DNA, 20 bp, Artificial Sequence
  Artificially Synthesized Primer Sequence
tgcgttgttgttgacaggat

SEQ ID NO: 6940 - DNA, 20 bp, Artificial Sequence
  Artificially Synthesized Primer Sequence
gttcggtgaggctgtatggt

SEQ ID NO: 6941 - DNA, 20 bp, Artificial Sequence
  Artificially Synthesized Primer Sequence
ccatgaggacgaactgacct

SEQ ID NO: 6942 - DNA, 20 bp, Artificial Sequence
  Artificially Synthesized Primer Sequence
aggaaaggaaaaggccaaga

SEQ ID NO: 6943 - DNA, 20 bp, Artificial Sequence
  Artificially Synthesized Primer Sequence
ttgtgctcgtttgcagtttc

SEQ ID NO: 6944 - DNA, 20 bp, Artificial Sequence
  Artificially Synthesized Primer Sequence
tgctcccctctttatggtga

SEQ ID NO: 6945 - DNA, 20 bp, Artificial Sequence
  Artificially Synthesized Primer Sequence
tatcgcagcagtcgtttgtc

SEQ ID NO: 6946 - DNA, 20 bp, Artificial Sequence
  Artificially Synthesized Primer Sequence
cctttggaaccagcacattt

SEQ ID NO: 6947 - DNA, 20 bp, Artificial Sequence
  Artificially Synthesized Primer Sequence
aaggggccgaattatttttg

SEQ ID NO: 6948 - DNA, 20 bp, Artificial Sequence
  Artificially Synthesized Primer Sequence
acggacataggtcaaatccg

SEQ ID NO: 6949 - DNA, 20 bp, Artificial Sequence
  Artificially Synthesized Primer Sequence
ggtgcagaagagctactggg

SEQ ID NO: 6950 - DNA, 20 bp, Artificial Sequence
  Artificially Synthesized Primer Sequence
tggcagattgtccatttcaa

SEQ ID NO: 6951 - DNA, 20 bp, Artificial Sequence
  Artificially Synthesized Primer Sequence
tggcaagatggtcaattcaa

SEQ ID NO: 6952 - DNA, 20 bp, Artificial Sequence
  Artificially Synthesized Primer Sequence
ggtgcagaagagctactggg

SEQ ID NO: 6953 - DNA, 20 bp, Artificial Sequence
  Artificially Synthesized Primer Sequence
gaaccatcgatcggtaggaa

SEQ ID NO: 6954 - DNA, 20 bp, Artificial Sequence
  Artificially Synthesized Primer Sequence
cgatctgtgaccacctgttg

SEQ ID NO: 6955 - DNA, 20 bp, Artificial Sequence
  Artificially Synthesized Primer Sequence
cgctttaatggtgtgaccct

SEQ ID NO: 6956 - DNA, 20 bp, Artificial Sequence
  Artificially Synthesized Primer Sequence
cagcagcaactggaactacg

SEQ ID NO: 6957 - DNA, 20 bp, Artificial Sequence
  Artificially Synthesized Primer Sequence
tactccgcatatggatgcaa

SEQ ID NO: 6958 - DNA, 20 bp, Artificial Sequence
  Artificially Synthesized Primer Sequence
gcggagcgaaaattacaaag

SEQ ID NO: 6959 - DNA, 20 bp, Artificial Sequence
  Artificially Synthesized Primer Sequence
caacaggtcaacaacgcact

SEQ ID NO: 6960 - DNA, 20 bp, Artificial Sequence
  Artificially Synthesized Primer Sequence
catatgctcaaaccccatca

SEQ ID NO: 6961 - DNA, 20 bp, Artificial Sequence
  Artificially Synthesized Primer Sequence
gcatcgctgtgcatttctta

SEQ ID NO: 6962 - DNA, 20 bp, Artificial Sequence
  Artificially Synthesized Primer Sequence
agaacggccctggtcttaat

SEQ ID NO: 6963 - DNA, 20 bp, Artificial Sequence
  Artificially Synthesized Primer Sequence
atttgcatctgttggctgtg

SEQ ID NO: 6964 - DNA, 20 bp, Artificial Sequence
  Artificially Synthesized Primer Sequence
accttgatcctcacaggtgc

SEQ ID NO: 6965 - DNA, 20 bp, Artificial Sequence
  Artificially Synthesized Primer Sequence
cagaagaggtcaacaacgca

SEQ ID NO: 6966 - DNA, 20 bp, Artificial Sequence
  Artificially Synthesized Primer Sequence
agctttctcaagggaggagg

SEQ ID NO: 6967 - DNA, 20 bp, Artificial Sequence
  Artificially Synthesized Primer Sequence
cgcatatggatgcaaacaag

SEQ ID NO: 6968 - DNA, 20 bp, Artificial Sequence
  Artificially Synthesized Primer Sequence
aaattatccccgaaacctgc

SEQ ID NO: 6969 - DNA, 20 bp, Artificial Sequence
  Artificially Synthesized Primer Sequence
gcatccagtgctgctattca

SEQ ID NO: 6970 - DNA, 20 bp, Artificial Sequence
  Artificially Synthesized Primer Sequence
ccaatgcgtcattcctacct

SEQ ID NO: 6971 - DNA, 20 bp, Artificial Sequence
  Artificially Synthesized Primer Sequence
agcagcagagcgctttattc

SEQ ID NO: 6972 - DNA, 20 bp, Artificial Sequence
  Artificially Synthesized Primer Sequence
ggttgttggttagacgcgat

SEQ ID NO: 6973 - DNA, 20 bp, Artificial Sequence
  Artificially Synthesized Primer Sequence
ggtgacaacaccaacaccag

SEQ ID NO: 6974 - DNA, 20 bp, Artificial Sequence
  Artificially Synthesized Primer Sequence
gaaccggacacgagtaccat

SEQ ID NO: 6975 - DNA, 20 bp, Artificial Sequence
  Artificially Synthesized Primer Sequence
ttagtgcccctttcgactgt

SEQ ID NO: 6976 - DNA, 20 bp, Artificial Sequence
  Artificially Synthesized Primer Sequence
cagtacaccaaggagtccgc

SEQ ID NO: 6977 - DNA, 20 bp, Artificial Sequence
  Artificially Synthesized Primer Sequence
cagaagaggtcaacaacgca

SEQ ID NO: 6978 - DNA, 20 bp, Artificial Sequence
  Artificially Synthesized Primer Sequence
agctttctcaagggaggagg

SEQ ID NO: 6979 - DNA, 20 bp, Artificial Sequence
  Artificially Synthesized Primer Sequence
tgacagcttctgtccaggtg

SEQ ID NO: 6980 - DNA, 20 bp, Artificial Sequence
  Artificially Synthesized Primer Sequence
ctgcaaggcctgtaaccttc

SEQ ID NO: 6981 - DNA, 20 bp, Artificial Sequence
  Artificially Synthesized Primer Sequence
cagggaaaaagcaatggaaa

SEQ ID NO: 6982 - DNA, 20 bp, Artificial Sequence
  Artificially Synthesized Primer Sequence
ccgtacatttcagcccactt

SEQ ID NO: 6983 - DNA, 20 bp, Artificial Sequence
  Artificially Synthesized Primer Sequence
ttcccttggaggtcttttga

SEQ ID NO: 6984 - DNA, 20 bp, Artificial Sequence
  Artificially Synthesized Primer Sequence
gcagggtcatggatgaaaat

SEQ ID NO: 6985 - DNA, 20 bp, Artificial Sequence
  Artificially Synthesized Primer Sequence
actaccgttccgggatctct

SEQ ID NO: 6986 - DNA, 20 bp, Artificial Sequence
  Artificially Synthesized Primer Sequence
gcttagttggctgcctgttc

SEQ ID NO: 6987 - DNA, 20 bp, Artificial Sequence
  Artificially Synthesized Primer Sequence
gcttagttggctgcctgttc

SEQ ID NO: 6988 - DNA, 20 bp, Artificial Sequence
  Artificially Synthesized Primer Sequence
agcaacgccaaggtacagtt

SEQ ID NO: 6989 - DNA, 20 bp, Artificial Sequence
  Artificially Synthesized Primer Sequence
aaactttgggaaatttgggg

SEQ ID NO: 6990 - DNA, 20 bp, Artificial Sequence
  Artificially Synthesized Primer Sequence
gtaggcccataaaggcacaa

SEQ ID NO: 6991 - DNA, 20 bp, Artificial Sequence
  Artificially Synthesized Primer Sequence
ggaggcattcaccaaacact

SEQ ID NO: 6992 - DNA, 20 bp, Artificial Sequence
  Artificially Synthesized Primer Sequence
tcagctagctttgtttggca

SEQ ID NO: 6993 - DNA, 20 bp, Artificial Sequence
  Artificially Synthesized Primer Sequence
cggtttcccgactgtagtgt

SEQ ID NO: 6994 - DNA, 20 bp, Artificial Sequence
  Artificially Synthesized Primer Sequence
aggaaggagggaacgaaaaa

SEQ ID NO: 6995 - DNA, 20 bp, Artificial Sequence
  Artificially Synthesized Primer Sequence
tggactgagttacgttcccc

SEQ ID NO: 6996 - DNA, 20 bp, Artificial Sequence
  Artificially Synthesized Primer Sequence
tctactacgccagccaggac

SEQ ID NO: 6997 - DNA, 20 bp, Artificial Sequence
  Artificially Synthesized Primer Sequence
aagctgctattggaggcaaa

SEQ ID NO: 6998 - DNA, 20 bp, Artificial Sequence
  Artificially Synthesized Primer Sequence
ggttctccaaaggttcacca

SEQ ID NO: 6999 - DNA, 20 bp, Artificial Sequence
  Artificially Synthesized Primer Sequence
acacggtaccagtcctcgac

SEQ ID NO: 7000 - DNA, 20 bp, Artificial Sequence
  Artificially Synthesized Primer Sequence
tagaagcctgcgagaggatg

SEQ ID NO: 7001 - DNA, 20 bp, Artificial Sequence
  Artificially Synthesized Primer Sequence
gaaggaggtggaccaagtga

SEQ ID NO: 7002 - DNA, 20 bp, Artificial Sequence
  Artificially Synthesized Primer Sequence
gaatttaccgagccgtgtgt

SEQ ID NO: 7003 - DNA, 20 bp, Artificial Sequence
  Artificially Synthesized Primer Sequence
cttctggaggcgtaatttgc

SEQ ID NO: 7004 - DNA, 20 bp, Artificial Sequence
  Artificially Synthesized Primer Sequence
tggagaaacaggagcgatct

SEQ ID NO: 7005 - DNA, 20 bp, Artificial Sequence
  Artificially Synthesized Primer Sequence
cattgggggaaacataggtg

SEQ ID NO: 7006 - DNA, 20 bp, Artificial Sequence
  Artificially Synthesized Primer Sequence
gatggaagagaaggaagggg

SEQ ID NO: 7007 - DNA, 20 bp, Artificial Sequence
  Artificially Synthesized Primer Sequence
atttcgaagacaagccatgc

SEQ ID NO: 7008 - DNA, 20 bp, Artificial Sequence
  Artificially Synthesized Primer Sequence
atcagcgaaaggaagctcaa

SEQ ID NO: 7009 - DNA, 20 bp, Artificial Sequence
  Artificially Synthesized Primer Sequence
agaggttgccaacacagagg

SEQ ID NO: 7010 - DNA, 20 bp, Artificial Sequence
  Artificially Synthesized Primer Sequence
cttggtttgctgtggtctca

SEQ ID NO: 7011 - DNA, 19 bp, Artificial Sequence
  Artificially Synthesized Primer Sequence
tgctcctttcatctcacgg

SEQ ID NO: 7012 - DNA, 20 bp, Artificial Sequence
  Artificially Synthesized Primer Sequence
gcatgagcgaacacaaacac

SEQ ID NO: 7013 - DNA, 20 bp, Artificial Sequence
  Artificially Synthesized Primer Sequence
tcaacgagttcctgaagcct

SEQ ID NO: 7014 - DNA, 20 bp, Artificial Sequence
  Artificially Synthesized Primer Sequence
atggatgaatggtcgggata

SEQ ID NO: 7015 - DNA, 20 bp, Artificial Sequence
  Artificially Synthesized Primer Sequence
tcggcgatattgataaaggg

SEQ ID NO: 7016 - DNA, 20 bp, Artificial Sequence
  Artificially Synthesized Primer Sequence
tggaggagaagaggaaagca

SEQ ID NO: 7017 - DNA, 20 bp, Artificial Sequence
  Artificially Synthesized Primer Sequence
tgacaggatagaccccaagg

SEQ ID NO: 7018 - DNA, 20 bp, Artificial Sequence
  Artificially Synthesized Primer Sequence
aggtacaccgtacacagccc

SEQ ID NO: 7019 - DNA, 20 bp, Artificial Sequence
  Artificially Synthesized Primer Sequence
aggtacaccgtacacagccc

SEQ ID NO: 7020 - DNA, 20 bp, Artificial Sequence
  Artificially Synthesized Primer Sequence
tgacaggatagaccccaagg

SEQ ID NO: 7021 - DNA, 20 bp, Artificial Sequence
  Artificially Synthesized Primer Sequence
ggcttgaaaggtgtggatgt

SEQ ID NO: 7022 - DNA, 20 bp, Artificial Sequence
  Artificially Synthesized Primer Sequence
tgtcagctcttcggtttcct

SEQ ID NO: 7023 - DNA, 20 bp, Artificial Sequence
  Artificially Synthesized Primer Sequence
aagaaaccgaccgacaactg

SEQ ID NO: 7024 - DNA, 20 bp, Artificial Sequence
  Artificially Synthesized Primer Sequence
ctgagctaactgagctgcca

SEQ ID NO: 7025 - DNA, 20 bp, Artificial Sequence
  Artificially Synthesized Primer Sequence
aggtggagtcctggcttttt

SEQ ID NO: 7026 - DNA, 20 bp, Artificial Sequence
  Artificially Synthesized Primer Sequence
cgggttctttagggtcaaca

SEQ ID NO: 7027 - DNA, 20 bp, Artificial Sequence
  Artificially Synthesized Primer Sequence
agcgtctacataccccagga

SEQ ID NO: 7028 - DNA, 20 bp, Artificial Sequence
  Artificially Synthesized Primer Sequence
aatggattcggtgtggagtc

SEQ ID NO: 7029 - DNA, 20 bp, Artificial Sequence
  Artificially Synthesized Primer Sequence
aatgctgttggaggtggaac

SEQ ID NO: 7030 - DNA, 20 bp, Artificial Sequence
  Artificially Synthesized Primer Sequence
gctgctcatggtaagccttc

SEQ ID NO: 7031 - DNA, 20 bp, Artificial Sequence
  Artificially Synthesized Primer Sequence
ggcctcagagaactctccct

SEQ ID NO: 7032 - DNA, 20 bp, Artificial Sequence
  Artificially Synthesized Primer Sequence
cctcctatgccccagtgata

SEQ ID NO: 7033 - DNA, 20 bp, Artificial Sequence
  Artificially Synthesized Primer Sequence
acaaattgttagggcatcgc

SEQ ID NO: 7034 - DNA, 20 bp, Artificial Sequence
  Artificially Synthesized Primer Sequence
ttgtgggccatatttccaat

SEQ ID NO: 7035 - DNA, 20 bp, Artificial Sequence
  Artificially Synthesized Primer Sequence
gatgtggatccagggttgac

SEQ ID NO: 7036 - DNA, 20 bp, Artificial Sequence
  Artificially Synthesized Primer Sequence
gtcatcttgggttggagcat

SEQ ID NO: 7037 - DNA, 20 bp, Artificial Sequence
  Artificially Synthesized Primer Sequence
tacagttgcttcaggcgatg

SEQ ID NO: 7038 - DNA, 20 bp, Artificial Sequence
  Artificially Synthesized Primer Sequence
tgtccccacgaatacaacaa

SEQ ID NO: 7039 - DNA, 20 bp, Artificial Sequence
  Artificially Synthesized Primer Sequence
ccctacaaatccgcaaagaa

SEQ ID NO: 7040 - DNA, 20 bp, Artificial Sequence
  Artificially Synthesized Primer Sequence
gtatctaggcagcgtttcgc

SEQ ID NO: 7041 - DNA, 20 bp, Artificial Sequence
  Artificially Synthesized Primer Sequence
aaaccatgctggaactggag

SEQ ID NO: 7042 - DNA, 20 bp, Artificial Sequence
  Artificially Synthesized Primer Sequence
gaatggtttgtggcttgctt

SEQ ID NO: 7043 - DNA, 20 bp, Artificial Sequence
  Artificially Synthesized Primer Sequence
cagtggaaatggtaggccag

SEQ ID NO: 7044 - DNA, 20 bp, Artificial Sequence
  Artificially Synthesized Primer Sequence
cacttcacaggacgagacga

SEQ ID NO: 7045 - DNA, 20 bp, Artificial Sequence
  Artificially Synthesized Primer Sequence
tcgcatggacgtgacactat

SEQ ID NO: 7046 - DNA, 20 bp, Artificial Sequence
  Artificially Synthesized Primer Sequence
atcccattgttgcagtaggc

SEQ ID NO: 7047 - DNA, 20 bp, Artificial Sequence
  Artificially Synthesized Primer Sequence
ggaattaggcgacacaggaa

SEQ ID NO: 7048 - DNA, 20 bp, Artificial Sequence
  Artificially Synthesized Primer Sequence
ccttgtgatcatttgcatgg

SEQ ID NO: 7049 - DNA, 20 bp, Artificial Sequence
  Artificially Synthesized Primer Sequence
tgcgctatgagatcaacagg

SEQ ID NO: 7050 - DNA, 20 bp, Artificial Sequence
  Artificially Synthesized Primer Sequence
ctaatgaccgtgccaggatt

SEQ ID NO: 7051 - DNA, 20 bp, Artificial Sequence
  Artificially Synthesized Primer Sequence
ctaatgaccgtgccaggatt

SEQ ID NO: 7052 - DNA, 20 bp, Artificial Sequence
  Artificially Synthesized Primer Sequence
cctgtggatcctctctgctc

SEQ ID NO: 7053 - DNA, 20 bp, Artificial Sequence
  Artificially Synthesized Primer Sequence
ggcttttggaatgaacgtgt

SEQ ID NO: 7054 - DNA, 20 bp, Artificial Sequence
  Artificially Synthesized Primer Sequence
tcacggattgatgttgcatt

SEQ ID NO: 7055 - DNA, 20 bp, Artificial Sequence
  Artificially Synthesized Primer Sequence
caacatgggataccgacaca

SEQ ID NO: 7056 - DNA, 20 bp, Artificial Sequence
  Artificially Synthesized Primer Sequence
cagaagcttaacgaggacgg

SEQ ID NO: 7057 - DNA, 20 bp, Artificial Sequence
  Artificially Synthesized Primer Sequence
gtgttcttggcctggttgat

SEQ ID NO: 7058 - DNA, 20 bp, Artificial Sequence
  Artificially Synthesized Primer Sequence
gtcgatcttggactgggaga

SEQ ID NO: 7059 - DNA, 20 bp, Artificial Sequence
  Artificially Synthesized Primer Sequence
gaacacaacgcggtacaaga

SEQ ID NO: 7060 - DNA, 20 bp, Artificial Sequence
  Artificially Synthesized Primer Sequence
tctcccagtccaagatcgac

SEQ ID NO: 7061 - DNA, 20 bp, Artificial Sequence
  Artificially Synthesized Primer Sequence
aggacctcaacaaccacagg

SEQ ID NO: 7062 - DNA, 20 bp, Artificial Sequence
  Artificially Synthesized Primer Sequence
cgaacccacttgtcatcctt

SEQ ID NO: 7063 - DNA, 20 bp, Artificial Sequence
  Artificially Synthesized Primer Sequence
cgagggatcacaaaccaact

SEQ ID NO: 7064 - DNA, 20 bp, Artificial Sequence
  Artificially Synthesized Primer Sequence
agatccgctactgcttggaa

SEQ ID NO: 7065 - DNA, 20 bp, Artificial Sequence
  Artificially Synthesized Primer Sequence
tggggatagctttcaggttg

SEQ ID NO: 7066 - DNA, 20 bp, Artificial Sequence
  Artificially Synthesized Primer Sequence
attagctggcagtggctcat

SEQ ID NO: 7067 - DNA, 20 bp, Artificial Sequence
  Artificially Synthesized Primer Sequence
gaagtgcttacatcacggca

SEQ ID NO: 7068 - DNA, 20 bp, Artificial Sequence
  Artificially Synthesized Primer Sequence
cgtatcggtttgtcacgttg

SEQ ID NO: 7069 - DNA, 20 bp, Artificial Sequence
  Artificially Synthesized Primer Sequence
ctctggctatggagcacaca

SEQ ID NO: 7070 - DNA, 20 bp, Artificial Sequence
  Artificially Synthesized Primer Sequence
gaggaggcatcgtcagaaag

SEQ ID NO: 7071 - DNA, 20 bp, Artificial Sequence
  Artificially Synthesized Primer Sequence
aattgtgtgcgctctctgtg

SEQ ID NO: 7072 - DNA, 20 bp, Artificial Sequence
  Artificially Synthesized Primer Sequence
ttcaagcaggacgagtgatg

SEQ ID NO: 7073 - DNA, 20 bp, Artificial Sequence
  Artificially Synthesized Primer Sequence
tgtcaaacgtggaatccaga

SEQ ID NO: 7074 - DNA, 20 bp, Artificial Sequence
  Artificially Synthesized Primer Sequence
tgagcaatggaaagcttgtg

SEQ ID NO: 7075 - DNA, 20 bp, Artificial Sequence
  Artificially Synthesized Primer Sequence
gggaagcgatccatctatca

SEQ ID NO: 7076 - DNA, 20 bp, Artificial Sequence
  Artificially Synthesized Primer Sequence
gatttgggcatggaggacta

SEQ ID NO: 7077 - DNA, 20 bp, Artificial Sequence
  Artificially Synthesized Primer Sequence
gctgcagaactactaccgcc

SEQ ID NO: 7078 - DNA, 20 bp, Artificial Sequence
  Artificially Synthesized Primer Sequence
gtgacgacatcaccaccttg

SEQ ID NO: 7079 - DNA, 20 bp, Artificial Sequence
  Artificially Synthesized Primer Sequence
ctgccgggtacattcaagtt

SEQ ID NO: 7080 - DNA, 20 bp, Artificial Sequence
  Artificially Synthesized Primer Sequence
gctgcagaactactaccgcc

SEQ ID NO: 7081 - DNA, 20 bp, Artificial Sequence
  Artificially Synthesized Primer Sequence
cgacccgtagtgatctggtt

SEQ ID NO: 7082 - DNA, 20 bp, Artificial Sequence
  Artificially Synthesized Primer Sequence
ttgcgactggatctcatctg

SEQ ID NO: 7083 - DNA, 20 bp, Artificial Sequence
  Artificially Synthesized Primer Sequence
cgaaaggaattactcgtggc

SEQ ID NO: 7084 - DNA, 20 bp, Artificial Sequence
  Artificially Synthesized Primer Sequence
ggctggcaactctgaagaac

SEQ ID NO: 7085 - DNA, 20 bp, Artificial Sequence
  Artificially Synthesized Primer Sequence
attccggtgtcccaaacata

SEQ ID NO: 7086 - DNA, 20 bp, Artificial Sequence
  Artificially Synthesized Primer Sequence
gaccgttgcaccttctcaat

SEQ ID NO: 7087 - DNA, 20 bp, Artificial Sequence
  Artificially Synthesized Primer Sequence
tcatcttcatcttcgcatcg

SEQ ID NO: 7088 - DNA, 20 bp, Artificial Sequence
  Artificially Synthesized Primer Sequence
gagaaactcagcttccgtgg

SEQ ID NO: 7089 - DNA, 20 bp, Artificial Sequence
  Artificially Synthesized Primer Sequence
aaggtcaaggaggggaagaa

SEQ ID NO: 7090 - DNA, 20 bp, Artificial Sequence
  Artificially Synthesized Primer Sequence
ctcaggaaaatgccatccat

SEQ ID NO: 7091 - DNA, 20 bp, Artificial Sequence
  Artificially Synthesized Primer Sequence
cgtcagcctcagatttcgac

SEQ ID NO: 7092 - DNA, 20 bp, Artificial Sequence
  Artificially Synthesized Primer Sequence
acacaccgaagtatggcctc

SEQ ID NO: 7093 - DNA, 20 bp, Artificial Sequence
  Artificially Synthesized Primer Sequence
ctacggcgagacctacttcg

SEQ ID NO: 7094 - DNA, 20 bp, Artificial Sequence
  Artificially Synthesized Primer Sequence
atttgtgtgactgtcgctgc

SEQ ID NO: 7095 - DNA, 20 bp, Artificial Sequence
  Artificially Synthesized Primer Sequence
ttggaacaaagcaacaccaa

SEQ ID NO: 7096 - DNA, 20 bp, Artificial Sequence
  Artificially Synthesized Primer Sequence
cgtacaagcacatcaccgac

SEQ ID NO: 7097 - DNA, 20 bp, Artificial Sequence
  Artificially Synthesized Primer Sequence
gttcagtgatggggcaaagt

SEQ ID NO: 7098 - DNA, 20 bp, Artificial Sequence
  Artificially Synthesized Primer Sequence
tgacaagaaacgcgaaagtg

SEQ ID NO: 7099 - DNA, 20 bp, Artificial Sequence
  Artificially Synthesized Primer Sequence
catctggcaccctttcagtt

SEQ ID NO: 7100 - DNA, 20 bp, Artificial Sequence
  Artificially Synthesized Primer Sequence
aagcctgcaatgcatacctc

SEQ ID NO: 7101 - DNA, 20 bp, Artificial Sequence
  Artificially Synthesized Primer Sequence
ctcctcctcctcttcctgct

SEQ ID NO: 7102 - DNA, 20 bp, Artificial Sequence
  Artificially Synthesized Primer Sequence
gccttgggagatcatacgtg

SEQ ID NO: 7103 - DNA, 20 bp, Artificial Sequence
  Artificially Synthesized Primer Sequence
aaacaggccgcaaatgtaag

SEQ ID NO: 7104 - DNA, 20 bp, Artificial Sequence
  Artificially Synthesized Primer Sequence
ataccttgtggtgcgatcct

SEQ ID NO: 7105 - DNA, 20 bp, Artificial Sequence
  Artificially Synthesized Primer Sequence
tagtagctgcagcaaggcaa

SEQ ID NO: 7106 - DNA, 20 bp, Artificial Sequence
  Artificially Synthesized Primer Sequence
aattgcagtcttttgacccg

SEQ ID NO: 7107 - DNA, 20 bp, Artificial Sequence
  Artificially Synthesized Primer Sequence
tgcgcagaaaagaagaaggt

SEQ ID NO: 7108 - DNA, 20 bp, Artificial Sequence
  Artificially Synthesized Primer Sequence
ttacatgatgggcttcgacc

SEQ ID NO: 7109 - DNA, 20 bp, Artificial Sequence
  Artificially Synthesized Primer Sequence
gactcggagcactggatctc

SEQ ID NO: 7110 - DNA, 20 bp, Artificial Sequence
  Artificially Synthesized Primer Sequence
acagaaaatctgcgcaacct

SEQ ID NO: 7111 - DNA, 20 bp, Artificial Sequence
  Artificially Synthesized Primer Sequence
caaagaagcagcggtatggt

SEQ ID NO: 7112 - DNA, 20 bp, Artificial Sequence
  Artificially Synthesized Primer Sequence
aagggaagaaagggagcaag

SEQ ID NO: 7113 - DNA, 20 bp, Artificial Sequence
  Artificially Synthesized Primer Sequence
ctgcctctgggttctgtttc

SEQ ID NO: 7114 - DNA, 20 bp, Artificial Sequence
  Artificially Synthesized Primer Sequence
cacatccaacaaacgaccag

SEQ ID NO: 7115 - DNA, 20 bp, Artificial Sequence
  Artificially Synthesized Primer Sequence
agacaaaaatgccaaccgtc

SEQ ID NO: 7116 - DNA, 20 bp, Artificial Sequence
  Artificially Synthesized Primer Sequence
acatccagcaaaattcgagg

SEQ ID NO: 7117 - DNA, 20 bp, Artificial Sequence
  Artificially Synthesized Primer Sequence
caggacttggtaaagctcgc

SEQ ID NO: 7118 - DNA, 20 bp, Artificial Sequence
  Artificially Synthesized Primer Sequence
ccaaagttggtgttgccttt

SEQ ID NO: 7119 - DNA, 20 bp, Artificial Sequence
  Artificially Synthesized Primer Sequence
aggaaggcgtaaaccgatct

SEQ ID NO: 7120 - DNA, 20 bp, Artificial Sequence
  Artificially Synthesized Primer Sequence
atcgaaaaggcaacaccaac

SEQ ID NO: 7121 - DNA, 20 bp, Artificial Sequence
  Artificially Synthesized Primer Sequence
gaagacggcgatgatgaaat

SEQ ID NO: 7122 - DNA, 20 bp, Artificial Sequence
  Artificially Synthesized Primer Sequence
tttggacatgctgctagacg

SEQ ID NO: 7123 - DNA, 20 bp, Artificial Sequence
  Artificially Synthesized Primer Sequence
caccaacgggtatatgggag

SEQ ID NO: 7124 - DNA, 20 bp, Artificial Sequence
  Artificially Synthesized Primer Sequence
gactccagcagcaacattga

SEQ ID NO: 7125 - DNA, 20 bp, Artificial Sequence
  Artificially Synthesized Primer Sequence
ggcataggtcgagcaacaat

SEQ ID NO: 7126 - DNA, 20 bp, Artificial Sequence
  Artificially Synthesized Primer Sequence
gaggggaaacttcgtgaaca

SEQ ID NO: 7127 - DNA, 20 bp, Artificial Sequence
  Artificially Synthesized Primer Sequence
cgtgcgataactgagatgga

SEQ ID NO: 7128 - DNA, 20 bp, Artificial Sequence
  Artificially Synthesized Primer Sequence
ccagtgctaaaagaggcagc

SEQ ID NO: 7129 - DNA, 20 bp, Artificial Sequence
  Artificially Synthesized Primer Sequence
cgtcacgaccagtgactacg

SEQ ID NO: 7130 - DNA, 20 bp, Artificial Sequence
  Artificially Synthesized Primer Sequence
tatcagggatcgcattagcc

SEQ ID NO: 7131 - DNA, 21 bp, Artificial Sequence
  Artificially Synthesized Primer Sequence
ttggatcagttgggtatgagc

SEQ ID NO: 7132 - DNA, 20 bp, Artificial Sequence
  Artificially Synthesized Primer Sequence
cttcacctcgtctcgtctga

SEQ ID NO: 7133 - DNA, 20 bp, Artificial Sequence
  Artificially Synthesized Primer Sequence
gctcttcacctacgactccg

SEQ ID NO: 7134 - DNA, 20 bp, Artificial Sequence
  Artificially Synthesized Primer Sequence
gccgcaaatgatagaagagg

SEQ ID NO: 7135 - DNA, 20 bp, Artificial Sequence
  Artificially Synthesized Primer Sequence
agcttgagaaacaagccagc

SEQ ID NO: 7136 - DNA, 20 bp, Artificial Sequence
  Artificially Synthesized Primer Sequence
cggagaccgagtgagaaaga

SEQ ID NO: 7137 - DNA, 20 bp, Artificial Sequence
  Artificially Synthesized Primer Sequence
ttcacgcccttcttctctgt

SEQ ID NO: 7138 - DNA, 20 bp, Artificial Sequence
  Artificially Synthesized Primer Sequence
tgacagacagcaatcttccg

SEQ ID NO: 7139 - DNA, 20 bp, Artificial Sequence
  Artificially Synthesized Primer Sequence
aatacggaggggaaacgaag

SEQ ID NO: 7140 - DNA, 20 bp, Artificial Sequence
  Artificially Synthesized Primer Sequence
acctccccagctcaactacc

SEQ ID NO: 7141 - DNA, 20 bp, Artificial Sequence
  Artificially Synthesized Primer Sequence
gactcggagcactggatctc

SEQ ID NO: 7142 - DNA, 20 bp, Artificial Sequence
  Artificially Synthesized Primer Sequence
attgttgctcgacctatgcc

SEQ ID NO: 7143 - DNA, 20 bp, Artificial Sequence
  Artificially Synthesized Primer Sequence
gcccaaaccctatcttccat

SEQ ID NO: 7144 - DNA, 20 bp, Artificial Sequence
  Artificially Synthesized Primer Sequence
ggcataggtcgagcaacaat

SEQ ID NO: 7145 - DNA, 20 bp, Artificial Sequence
  Artificially Synthesized Primer Sequence
tgcaaggttggaccctattc

SEQ ID NO: 7146 - DNA, 20 bp, Artificial Sequence
  Artificially Synthesized Primer Sequence
cttcacatgcgacttctcca

SEQ ID NO: 7147 - DNA, 20 bp, Artificial Sequence
  Artificially Synthesized Primer Sequence
caaatgccgacaacatcatc

SEQ ID NO: 7148 - DNA, 20 bp, Artificial Sequence
  Artificially Synthesized Primer Sequence
tgctccatcacttaggaccc

SEQ ID NO: 7149 - DNA, 20 bp, Artificial Sequence
  Artificially Synthesized Primer Sequence
cattctgcacgaggagtcaa

SEQ ID NO: 7150 - DNA, 20 bp, Artificial Sequence
  Artificially Synthesized Primer Sequence
tgattgaatcgcacaagctc

SEQ ID NO: 7151 - DNA, 20 bp, Artificial Sequence
  Artificially Synthesized Primer Sequence
aaggccagttgagttgttgg

SEQ ID NO: 7152 - DNA, 20 bp, Artificial Sequence
  Artificially Synthesized Primer Sequence
atccaccatgtaaaacccga

SEQ ID NO: 7153 - DNA, 20 bp, Artificial Sequence
  Artificially Synthesized Primer Sequence
aggctggcagagctaaaaca

SEQ ID NO: 7154 - DNA, 20 bp, Artificial Sequence
  Artificially Synthesized Primer Sequence
aataggcgaatttggttccc

SEQ ID NO: 7155 - DNA, 20 bp, Artificial Sequence
  Artificially Synthesized Primer Sequence
ctgttttagctctgccagcc

SEQ ID NO: 7156 - DNA, 20 bp, Artificial Sequence
  Artificially Synthesized Primer Sequence
agaagaggaaaacggaaggg

SEQ ID NO: 7157 - DNA, 20 bp, Artificial Sequence
  Artificially Synthesized Primer Sequence
ctagtacccccaatctgcga

SEQ ID NO: 7158 - DNA, 20 bp, Artificial Sequence
  Artificially Synthesized Primer Sequence
tcgatgcgctcatacatctc

SEQ ID NO: 7159 - DNA, 20 bp, Artificial Sequence
  Artificially Synthesized Primer Sequence
atcaaaggaatgcagggttg

SEQ ID NO: 7160 - DNA, 20 bp, Artificial Sequence
  Artificially Synthesized Primer Sequence
tcagtttcatcgcactctgg

SEQ ID NO: 7161 - DNA, 20 bp, Artificial Sequence
  Artificially Synthesized Primer Sequence
ggccagtggatcaatgagtt

SEQ ID NO: 7162 - DNA, 20 bp, Artificial Sequence
  Artificially Synthesized Primer Sequence
tccacagaaatctcgcctct

SEQ ID NO: 7163 - DNA, 20 bp, Artificial Sequence
  Artificially Synthesized Primer Sequence
aaaaagtggagtgctgccat

SEQ ID NO: 7164 - DNA, 20 bp, Artificial Sequence
  Artificially Synthesized Primer Sequence
gccatggatcttcttcaagg

SEQ ID NO: 7165 - DNA, 20 bp, Artificial Sequence
  Artificially Synthesized Primer Sequence
gggtcccatgttgtcgatac

SEQ ID NO: 7166 - DNA, 20 bp, Artificial Sequence
  Artificially Synthesized Primer Sequence
gccggacctagcattcaata

SEQ ID NO: 7167 - DNA, 20 bp, Artificial Sequence
  Artificially Synthesized Primer Sequence
tagctggtcttgcggatctt

SEQ ID NO: 7168 - DNA, 20 bp, Artificial Sequence
  Artificially Synthesized Primer Sequence
tcatgtggattcagttcgga

SEQ ID NO: 7169 - DNA, 20 bp, Artificial Sequence
  Artificially Synthesized Primer Sequence
ccatccgtttccaggagtta

SEQ ID NO: 7170 - DNA, 20 bp, Artificial Sequence
  Artificially Synthesized Primer Sequence
tcgaaaggagaaggcgatta

SEQ ID NO: 7171 - DNA, 20 bp, Artificial Sequence
  Artificially Synthesized Primer Sequence
gcggaacgaccattgtatct

SEQ ID NO: 7172 - DNA, 20 bp, Artificial Sequence
  Artificially Synthesized Primer Sequence
ttatctcttctgccgggatg

SEQ ID NO: 7173 - DNA, 20 bp, Artificial Sequence
  Artificially Synthesized Primer Sequence
aaggatgacatcaactcggc

SEQ ID NO: 7174 - DNA, 20 bp, Artificial Sequence
  Artificially Synthesized Primer Sequence
gcgccagatagtaaagcctg

SEQ ID NO: 7175 - DNA, 20 bp, Artificial Sequence
  Artificially Synthesized Primer Sequence
tcctgtgcagtagcatcgac

SEQ ID NO: 7176 - DNA, 20 bp, Artificial Sequence
  Artificially Synthesized Primer Sequence
ccaggctttactatctggcg

SEQ ID NO: 7177 - DNA, 20 bp, Artificial Sequence
  Artificially Synthesized Primer Sequence
actgcccaaaaagtcaccac

SEQ ID NO: 7178 - DNA, 20 bp, Artificial Sequence
  Artificially Synthesized Primer Sequence
aattcgtacaggccatcgac

SEQ ID NO: 7179 - DNA, 20 bp, Artificial Sequence
  Artificially Synthesized Primer Sequence
ttcgttacaggcatcgacag

SEQ ID NO: 7180 - DNA, 20 bp, Artificial Sequence
  Artificially Synthesized Primer Sequence
atatccaaggaccatgagcg

SEQ ID NO: 7181 - DNA, 20 bp, Artificial Sequence
  Artificially Synthesized Primer Sequence
actgttggcctactgggatg

SEQ ID NO: 7182 - DNA, 20 bp, Artificial Sequence
  Artificially Synthesized Primer Sequence
tagtactccgggtgggtcac

SEQ ID NO: 7183 - DNA, 20 bp, Artificial Sequence
  Artificially Synthesized Primer Sequence
tgcaaacacacaaccaaaca

SEQ ID NO: 7184 - DNA, 20 bp, Artificial Sequence
  Artificially Synthesized Primer Sequence
tcaccctacgtggttcacaa

SEQ ID NO: 7185 - DNA, 20 bp, Artificial Sequence
  Artificially Synthesized Primer Sequence
acgtgaaagggatgatcctg

SEQ ID NO: 7186 - DNA, 20 bp, Artificial Sequence
  Artificially Synthesized Primer Sequence
tgactccaggtgcagctatg

SEQ ID NO: 7187 - DNA, 20 bp, Artificial Sequence
  Artificially Synthesized Primer Sequence
aaaggcccacatgttaggtg

SEQ ID NO: 7188 - DNA, 20 bp, Artificial Sequence
  Artificially Synthesized Primer Sequence
caacctaccatccatctcgg

SEQ ID NO: 7189 - DNA, 20 bp, Artificial Sequence
  Artificially Synthesized Primer Sequence
tgtacaacaaagcaggctgg

SEQ ID NO: 7190 - DNA, 20 bp, Artificial Sequence
  Artificially Synthesized Primer Sequence
gttcttggcgaaggtctcag

SEQ ID NO: 7191 - DNA, 20 bp, Artificial Sequence
  Artificially Synthesized Primer Sequence
ccaaacaatttcttcgcaca

SEQ ID NO: 7192 - DNA, 20 bp, Artificial Sequence
  Artificially Synthesized Primer Sequence
atttgcggagctcaaggtta

SEQ ID NO: 7193 - DNA, 20 bp, Artificial Sequence
  Artificially Synthesized Primer Sequence
ctgttccctccttctttccc

SEQ ID NO: 7194 - DNA, 20 bp, Artificial Sequence
  Artificially Synthesized Primer Sequence
agaataccaacagagcgcgt

SEQ ID NO: 7195 - DNA, 20 bp, Artificial Sequence
  Artificially Synthesized Primer Sequence
tggtttttcggctttttcac

SEQ ID NO: 7196 - DNA, 20 bp, Artificial Sequence
  Artificially Synthesized Primer Sequence
ctgttgaggggtaccgtgtt

SEQ ID NO: 7197 - DNA, 20 bp, Artificial Sequence
  Artificially Synthesized Primer Sequence
ccttctcgaagaaccgtgag

SEQ ID NO: 7198 - DNA, 20 bp, Artificial Sequence
  Artificially Synthesized Primer Sequence
ctgctcaaacaagccaaaca

SEQ ID NO: 7199 - DNA, 20 bp, Artificial Sequence
  Artificially Synthesized Primer Sequence
tgtgagcagctccagaacac

SEQ ID NO: 7200 - DNA, 20 bp, Artificial Sequence
  Artificially Synthesized Primer Sequence
ctcagagcatccttgccatt

SEQ ID NO: 7201 - DNA, 20 bp, Artificial Sequence
  Artificially Synthesized Primer Sequence
ttccgtgggagagagagaga

SEQ ID NO: 7202 - DNA, 20 bp, Artificial Sequence
  Artificially Synthesized Primer Sequence
cacaaaccccaacaaaacaa

SEQ ID NO: 7203 - DNA, 20 bp, Artificial Sequence
  Artificially Synthesized Primer Sequence
acaagactgttctgctccgc

SEQ ID NO: 7204 - DNA, 19 bp, Artificial Sequence
  Artificially Synthesized Primer Sequence
aaccctgaacggctaccag

SEQ ID NO: 7205 - DNA, 20 bp, Artificial Sequence
  Artificially Synthesized Primer Sequence
tgcaggagatggtatgtcca

SEQ ID NO: 7206 - DNA, 20 bp, Artificial Sequence
  Artificially Synthesized Primer Sequence
tatttgagcgagttttgggg

SEQ ID NO: 7207 - DNA, 20 bp, Artificial Sequence
  Artificially Synthesized Primer Sequence
tatgcaaccggacagacaaa

SEQ ID NO: 7208 - DNA, 20 bp, Artificial Sequence
  Artificially Synthesized Primer Sequence
aaagagcccaacagggagtt

SEQ ID NO: 7209 - DNA, 20 bp, Artificial Sequence
  Artificially Synthesized Primer Sequence
cccctaggaagaggatggac

SEQ ID NO: 7210 - DNA, 20 bp, Artificial Sequence
  Artificially Synthesized Primer Sequence
agcgcaggataaactgccta

SEQ ID NO: 7211 - DNA, 20 bp, Artificial Sequence
  Artificially Synthesized Primer Sequence
agcgcaggataaactgccta

SEQ ID NO: 7212 - DNA, 20 bp, Artificial Sequence
  Artificially Synthesized Primer Sequence
cccctaggaagaggatggac

SEQ ID NO: 7213 - DNA, 20 bp, Artificial Sequence
  Artificially Synthesized Primer Sequence
gaaccagaacaccgtcgatt

SEQ ID NO: 7214 - DNA, 20 bp, Artificial Sequence
  Artificially Synthesized Primer Sequence
aagtccctgtgccatgtagg

SEQ ID NO: 7215 - DNA, 20 bp, Artificial Sequence
  Artificially Synthesized Primer Sequence
tccaaatcaagccttcaacc

SEQ ID NO: 7216 - DNA, 20 bp, Artificial Sequence
  Artificially Synthesized Primer Sequence
tgatgtgaagaacaggcagg

SEQ ID NO: 7217 - DNA, 20 bp, Artificial Sequence
  Artificially Synthesized Primer Sequence
gctgcatgagattgctacga

SEQ ID NO: 7218 - DNA, 20 bp, Artificial Sequence
  Artificially Synthesized Primer Sequence
gccatttgaaagtcccagaa

SEQ ID NO: 7219 - DNA, 20 bp, Artificial Sequence
  Artificially Synthesized Primer Sequence
cacatggccgcatattgtag

SEQ ID NO: 7220 - DNA, 20 bp, Artificial Sequence
  Artificially Synthesized Primer Sequence
cacccgcagatcaaagaaat

SEQ ID NO: 7221 - DNA, 20 bp, Artificial Sequence
  Artificially Synthesized Primer Sequence
ccgcacggtacaaggagtat

SEQ ID NO: 7222 - DNA, 20 bp, Artificial Sequence
  Artificially Synthesized Primer Sequence
acaaactcggacaaaaacgg

SEQ ID NO: 7223 - DNA, 20 bp, Artificial Sequence
  Artificially Synthesized Primer Sequence
gctagccaactaatcgtgcc

SEQ ID NO: 7224 - DNA, 20 bp, Artificial Sequence
  Artificially Synthesized Primer Sequence
ccgcacggtacaaggagtat

SEQ ID NO: 7225 - DNA, 20 bp, Artificial Sequence
  Artificially Synthesized Primer Sequence
cattattcccaggtcgtgct

SEQ ID NO: 7226 - DNA, 20 bp, Artificial Sequence
  Artificially Synthesized Primer Sequence
ggggaaaggaaagaaaaacg

SEQ ID NO: 7227 - DNA, 20 bp, Artificial Sequence
  Artificially Synthesized Primer Sequence
aggtgaagaagaaggcacga

SEQ ID NO: 7228 - DNA, 20 bp, Artificial Sequence
  Artificially Synthesized Primer Sequence
tctgtggatgagctcctgtg

SEQ ID NO: 7229 - DNA, 20 bp, Artificial Sequence
  Artificially Synthesized Primer Sequence
cctacatggcacagggactt

SEQ ID NO: 7230 - DNA, 20 bp, Artificial Sequence
  Artificially Synthesized Primer Sequence
acaagtctccggctctcaaa

SEQ ID NO: 7231 - DNA, 20 bp, Artificial Sequence
  Artificially Synthesized Primer Sequence
acaagtctccggctctcaaa

SEQ ID NO: 7232 - DNA, 20 bp, Artificial Sequence
  Artificially Synthesized Primer Sequence
cctacatggcacagggactt

SEQ ID NO: 7233 - DNA, 20 bp, Artificial Sequence
  Artificially Synthesized Primer Sequence
ctcaggttcaaccgtgtcaa

SEQ ID NO: 7234 - DNA, 20 bp, Artificial Sequence
  Artificially Synthesized Primer Sequence
caggcatgcttctccttctc

SEQ ID NO: 7235 - DNA, 20 bp, Artificial Sequence
  Artificially Synthesized Primer Sequence
cgtcgcaggactgtactgaa

SEQ ID NO: 7236 - DNA, 20 bp, Artificial Sequence
  Artificially Synthesized Primer Sequence
aggaagcgacatggaagatg

SEQ ID NO: 7237 - DNA, 20 bp, Artificial Sequence
  Artificially Synthesized Primer Sequence
atcgaggtgctgaggaagaa

SEQ ID NO: 7238 - DNA, 20 bp, Artificial Sequence
  Artificially Synthesized Primer Sequence
ccgaatctagcaagactgcc

SEQ ID NO: 7239 - DNA, 20 bp, Artificial Sequence
  Artificially Synthesized Primer Sequence
cgagaagaaacggagacgac

SEQ ID NO: 7240 - DNA, 20 bp, Artificial Sequence
  Artificially Synthesized Primer Sequence
gatcatcaacgagagcgtga

SEQ ID NO: 7241 - DNA, 20 bp, Artificial Sequence
  Artificially Synthesized Primer Sequence
agtatgggaccacatcctcg

SEQ ID NO: 7242 - DNA, 20 bp, Artificial Sequence
  Artificially Synthesized Primer Sequence
aaaatccattcgagtggtcg

SEQ ID NO: 7243 - DNA, 20 bp, Artificial Sequence
  Artificially Synthesized Primer Sequence
aatccattcgagtggtcgtc

SEQ ID NO: 7244 - DNA, 20 bp, Artificial Sequence
  Artificially Synthesized Primer Sequence
gtggggtacggaccagtatg

SEQ ID NO: 7245 - DNA, 20 bp, Artificial Sequence
  Artificially Synthesized Primer Sequence
atcaatcgcctgtaccttcg

SEQ ID NO: 7246 - DNA, 20 bp, Artificial Sequence
  Artificially Synthesized Primer Sequence
ccaacgctcattgacagaga

SEQ ID NO: 7247 - DNA, 20 bp, Artificial Sequence
  Artificially Synthesized Primer Sequence
cgactctttctgccggttag

SEQ ID NO: 7248 - DNA, 20 bp, Artificial Sequence
  Artificially Synthesized Primer Sequence
ttctctgtcaatgagcgtgg

SEQ ID NO: 7249 - DNA, 20 bp, Artificial Sequence
  Artificially Synthesized Primer Sequence
cccttatgggggttgtttct

SEQ ID NO: 7250 - DNA, 20 bp, Artificial Sequence
  Artificially Synthesized Primer Sequence
cgaacaggagcaatacgtca

SEQ ID NO: 7251 - DNA, 21 bp, Artificial Sequence
  Artificially Synthesized Primer Sequence
tcctagtagcagtgtagcggc

SEQ ID NO: 7252 - DNA, 19 bp, Artificial Sequence
  Artificially Synthesized Primer Sequence
gttcgacgtggtgatccag

SEQ ID NO: 7253 - DNA, 20 bp, Artificial Sequence
  Artificially Synthesized Primer Sequence
ctcaggttcaaccgtgtcaa

SEQ ID NO: 7254 - DNA, 20 bp, Artificial Sequence
  Artificially Synthesized Primer Sequence
caggcatgcttctccttctc

SEQ ID NO: 7255 - DNA, 20 bp, Artificial Sequence
  Artificially Synthesized Primer Sequence
ctcgatcatcagcgacttca

SEQ ID NO: 7256 - DNA, 20 bp, Artificial Sequence
  Artificially Synthesized Primer Sequence
gaagaggcaccttctgcaac

SEQ ID NO: 7257 - DNA, 20 bp, Artificial Sequence
  Artificially Synthesized Primer Sequence
ggcggtgttttagagttcca

SEQ ID NO: 7258 - DNA, 20 bp, Artificial Sequence
  Artificially Synthesized Primer Sequence
gccaagcagaaacgtaaagg

SEQ ID NO: 7259 - DNA, 20 bp, Artificial Sequence
  Artificially Synthesized Primer Sequence
aatgtgcacaccaaggttga

SEQ ID NO: 7260 - DNA, 20 bp, Artificial Sequence
  Artificially Synthesized Primer Sequence
agacaacaaccgcctgtacc

SEQ ID NO: 7261 - DNA, 20 bp, Artificial Sequence
  Artificially Synthesized Primer Sequence
catttttgctgaggtgctga

SEQ ID NO: 7262 - DNA, 20 bp, Artificial Sequence
  Artificially Synthesized Primer Sequence
atcatcctttgacaccctgc

SEQ ID NO: 7263 - DNA, 20 bp, Artificial Sequence
  Artificially Synthesized Primer Sequence
gatcctcatccgccaactta

SEQ ID NO: 7264 - DNA, 20 bp, Artificial Sequence
  Artificially Synthesized Primer Sequence
tgggcaatatcagcatcaag

SEQ ID NO: 7265 - DNA, 20 bp, Artificial Sequence
  Artificially Synthesized Primer Sequence
tgtgcagctcctgtaaccag

SEQ ID NO: 7266 - DNA, 20 bp, Artificial Sequence
  Artificially Synthesized Primer Sequence
taaaactggggcttgtggac

SEQ ID NO: 7267 - DNA, 20 bp, Artificial Sequence
  Artificially Synthesized Primer Sequence
ggtggcatgggagtttgata

SEQ ID NO: 7268 - DNA, 20 bp, Artificial Sequence
  Artificially Synthesized Primer Sequence
ctttgctatcccccagttga

SEQ ID NO: 7269 - DNA, 20 bp, Artificial Sequence
  Artificially Synthesized Primer Sequence
tttcttcggacctttgatgc

SEQ ID NO: 7270 - DNA, 20 bp, Artificial Sequence
  Artificially Synthesized Primer Sequence
gatccattttccttcagcca

SEQ ID NO: 7271 - DNA, 20 bp, Artificial Sequence
  Artificially Synthesized Primer Sequence
ttctgaagctgggggttatg

SEQ ID NO: 7272 - DNA, 20 bp, Artificial Sequence
  Artificially Synthesized Primer Sequence
cggtagttgtggagcaggtc

SEQ ID NO: 7273 - DNA, 20 bp, Artificial Sequence
  Artificially Synthesized Primer Sequence
acgttgcattgacatcagga

SEQ ID NO: 7274 - DNA, 20 bp, Artificial Sequence
  Artificially Synthesized Primer Sequence
ggtttccactcgacacaggt

SEQ ID NO: 7275 - DNA, 20 bp, Artificial Sequence
  Artificially Synthesized Primer Sequence
actcttccagccacctacga

SEQ ID NO: 7276 - DNA, 20 bp, Artificial Sequence
  Artificially Synthesized Primer Sequence
gatccaacaggacgaggaga

SEQ ID NO: 7277 - DNA, 20 bp, Artificial Sequence
  Artificially Synthesized Primer Sequence
cacatcctcggctactggag

SEQ ID NO: 7278 - DNA, 20 bp, Artificial Sequence
  Artificially Synthesized Primer Sequence
gattcaggtggcctgttttg

SEQ ID NO: 7279 - DNA, 20 bp, Artificial Sequence
  Artificially Synthesized Primer Sequence
ttgctgtgctggaacttgac

SEQ ID NO: 7280 - DNA, 20 bp, Artificial Sequence
  Artificially Synthesized Primer Sequence
tgtacttgcaatgtctcggg

SEQ ID NO: 7281 - DNA, 20 bp, Artificial Sequence
  Artificially Synthesized Primer Sequence
tcggcacgaggctactctat

SEQ ID NO: 7282 - DNA, 20 bp, Artificial Sequence
  Artificially Synthesized Primer Sequence
ctgtcttctgccctccagac

SEQ ID NO: 7283 - DNA, 20 bp, Artificial Sequence
  Artificially Synthesized Primer Sequence
catctccaatcacgcaaatg

SEQ ID NO: 7284 - DNA, 20 bp, Artificial Sequence
  Artificially Synthesized Primer Sequence
tcatcaacgtggtgtccaag

SEQ ID NO: 7285 - DNA, 20 bp, Artificial Sequence
  Artificially Synthesized Primer Sequence
tgaatgctcaggagagcaga

SEQ ID NO: 7286 - DNA, 20 bp, Artificial Sequence
  Artificially Synthesized Primer Sequence
ccttccttccttccttcacc

SEQ ID NO: 7287 - DNA, 20 bp, Artificial Sequence
  Artificially Synthesized Primer Sequence
ccttccttccttccttcacc

SEQ ID NO: 7288 - DNA, 20 bp, Artificial Sequence
  Artificially Synthesized Primer Sequence
tgaatgctcaggagagcaga

SEQ ID NO: 7289 - DNA, 20 bp, Artificial Sequence
  Artificially Synthesized Primer Sequence
ccgctaattctgtccggtta

SEQ ID NO: 7290 - DNA, 20 bp, Artificial Sequence
  Artificially Synthesized Primer Sequence
tgtggattctcccctactgg

SEQ ID NO: 7291 - DNA, 20 bp, Artificial Sequence
  Artificially Synthesized Primer Sequence
cggcgattcaccactaaaat

SEQ ID NO: 7292 - DNA, 20 bp, Artificial Sequence
  Artificially Synthesized Primer Sequence
gtcaagttcatcaagggcgt

SEQ ID NO: 7293 - DNA, 20 bp, Artificial Sequence
  Artificially Synthesized Primer Sequence
gtctgaggatgagcaggagc

SEQ ID NO: 7294 - DNA, 20 bp, Artificial Sequence
  Artificially Synthesized Primer Sequence
cccagtctcttgcttcttgg

SEQ ID NO: 7295 - DNA, 20 bp, Artificial Sequence
  Artificially Synthesized Primer Sequence
ggttttctcccttccctcag

SEQ ID NO: 7296 - DNA, 20 bp, Artificial Sequence
  Artificially Synthesized Primer Sequence
ccaagaagcaagagactggg

SEQ ID NO: 7297 - DNA, 20 bp, Artificial Sequence
  Artificially Synthesized Primer Sequence
agagcctgctgatgacgagt

SEQ ID NO: 7298 - DNA, 20 bp, Artificial Sequence
  Artificially Synthesized Primer Sequence
gctgcagcttatcaaggacc

SEQ ID NO: 7299 - DNA, 20 bp, Artificial Sequence
  Artificially Synthesized Primer Sequence
atgatcccacaacaccaaca

SEQ ID NO: 7300 - DNA, 20 bp, Artificial Sequence
  Artificially Synthesized Primer Sequence
atgttcttctgctgatgggc

SEQ ID NO: 7301 - DNA, 20 bp, Artificial Sequence
  Artificially Synthesized Primer Sequence
gcaaacaacaccaacctcct

SEQ ID NO: 7302 - DNA, 20 bp, Artificial Sequence
  Artificially Synthesized Primer Sequence
ctggacatagggcatcaggt

SEQ ID NO: 7303 - DNA, 20 bp, Artificial Sequence
  Artificially Synthesized Primer Sequence
tacaaggcaagggaaccaac

SEQ ID NO: 7304 - DNA, 20 bp, Artificial Sequence
  Artificially Synthesized Primer Sequence
ccctctggtttatgctggaa

SEQ ID NO: 7305 - DNA, 20 bp, Artificial Sequence
  Artificially Synthesized Primer Sequence
cgtgaacttacaggcgacaa

SEQ ID NO: 7306 - DNA, 20 bp, Artificial Sequence
  Artificially Synthesized Primer Sequence
ggatagccaagacgccataa

SEQ ID NO: 7307 - DNA, 20 bp, Artificial Sequence
  Artificially Synthesized Primer Sequence
ggacgcagaaaaatcagagc

SEQ ID NO: 7308 - DNA, 20 bp, Artificial Sequence
  Artificially Synthesized Primer Sequence
attgttctgtgaccaagggc

SEQ ID NO: 7309 - DNA, 20 bp, Artificial Sequence
  Artificially Synthesized Primer Sequence
aattcctcgagcactgttgg

SEQ ID NO: 7310 - DNA, 20 bp, Artificial Sequence
  Artificially Synthesized Primer Sequence
gctctgatttttctgcgtcc

SEQ ID NO: 7311 - DNA, 20 bp, Artificial Sequence
  Artificially Synthesized Primer Sequence
gctttgcattccaagatggt

SEQ ID NO: 7312 - DNA, 20 bp, Artificial Sequence
  Artificially Synthesized Primer Sequence
aggtccaagatggaggaggt

SEQ ID NO: 7313 - DNA, 20 bp, Artificial Sequence
  Artificially Synthesized Primer Sequence
acagcatcagcatcagcatc

SEQ ID NO: 7314 - DNA, 20 bp, Artificial Sequence
  Artificially Synthesized Primer Sequence
cattcaccagcagcaactgt

SEQ ID NO: 7315 - DNA, 20 bp, Artificial Sequence
  Artificially Synthesized Primer Sequence
gctctccactctcttgcacc

SEQ ID NO: 7316 - DNA, 20 bp, Artificial Sequence
  Artificially Synthesized Primer Sequence
gtatgcttgcaggaaggctc

SEQ ID NO: 7317 - DNA, 20 bp, Artificial Sequence
  Artificially Synthesized Primer Sequence
atagcctgcttcgtcagcat

SEQ ID NO: 7318 - DNA, 20 bp, Artificial Sequence
  Artificially Synthesized Primer Sequence
acggggaaaagaggagaaga

SEQ ID NO: 7319 - DNA, 20 bp, Artificial Sequence
  Artificially Synthesized Primer Sequence
gcctgcatatcagcacagaa

SEQ ID NO: 7320 - DNA, 20 bp, Artificial Sequence
  Artificially Synthesized Primer Sequence
cctgatcacccgttcttcat

SEQ ID NO: 7321 - DNA, 20 bp, Artificial Sequence
  Artificially Synthesized Primer Sequence
atcccatcaccgttgtgaat

SEQ ID NO: 7322 - DNA, 20 bp, Artificial Sequence
  Artificially Synthesized Primer Sequence
acaagggtggtcgtcaagtc

SEQ ID NO: 7323 - DNA, 20 bp, Artificial Sequence
  Artificially Synthesized Primer Sequence
atgcatccaggaaaccagaa

SEQ ID NO: 7324 - DNA, 20 bp, Artificial Sequence
  Artificially Synthesized Primer Sequence
aagacgaaggtgtgctcgat

SEQ ID NO: 7325 - DNA, 20 bp, Artificial Sequence
  Artificially Synthesized Primer Sequence
caggcaagccgtaaaaagag

SEQ ID NO: 7326 - DNA, 20 bp, Artificial Sequence
  Artificially Synthesized Primer Sequence
cttgtgaagcacagcggata

SEQ ID NO: 7327 - DNA, 20 bp, Artificial Sequence
  Artificially Synthesized Primer Sequence
tcgatgagaatagcccttcc

SEQ ID NO: 7328 - DNA, 20 bp, Artificial Sequence
  Artificially Synthesized Primer Sequence
acctgtggatcatcccattc

SEQ ID NO: 7329 - DNA, 20 bp, Artificial Sequence
  Artificially Synthesized Primer Sequence
ccatgtctgacagcgagaaa

SEQ ID NO: 7330 - DNA, 20 bp, Artificial Sequence
  Artificially Synthesized Primer Sequence
cgtagaactcagccacgtca

SEQ ID NO: 7331 - DNA, 20 bp, Artificial Sequence
  Artificially Synthesized Primer Sequence
aactttggcatctcacaggc

SEQ ID NO: 7332 - DNA, 20 bp, Artificial Sequence
  Artificially Synthesized Primer Sequence
ggctgaagaagcacatgtca

SEQ ID NO: 7333 - DNA, 20 bp, Artificial Sequence
  Artificially Synthesized Primer Sequence
gtggccataaggtgcattct

SEQ ID NO: 7334 - DNA, 20 bp, Artificial Sequence
  Artificially Synthesized Primer Sequence
agttgtttctggcgtagcgt

SEQ ID NO: 7335 - DNA, 20 bp, Artificial Sequence
  Artificially Synthesized Primer Sequence
agttgtttctggcgtagcgt

SEQ ID NO: 7336 - DNA, 20 bp, Artificial Sequence
  Artificially Synthesized Primer Sequence
catgtggggtaaagactgcc

SEQ ID NO: 7337 - DNA, 20 bp, Artificial Sequence
  Artificially Synthesized Primer Sequence
catcggcgtaaaccaatctt

SEQ ID NO: 7338 - DNA, 20 bp, Artificial Sequence
  Artificially Synthesized Primer Sequence
tcgcttcgcaagttcctaat

SEQ ID NO: 7339 - DNA, 22 bp, Artificial Sequence
  Artificially Synthesized Primer Sequence
cataccagattctgcagtccaa

SEQ ID NO: 7340 - DNA, 20 bp, Artificial Sequence
  Artificially Synthesized Primer Sequence
gccgcaaactcaaaatatgc

SEQ ID NO: 7341 - DNA, 20 bp, Artificial Sequence
  Artificially Synthesized Primer Sequence
cccgagaggggaggtaataa

SEQ ID NO: 7342 - DNA, 20 bp, Artificial Sequence
  Artificially Synthesized Primer Sequence
cagcgttaaccttagctggc

SEQ ID NO: 7343 - DNA, 20 bp, Artificial Sequence
  Artificially Synthesized Primer Sequence
gacacccaaagggcatctta

SEQ ID NO: 7344 - DNA, 20 bp, Artificial Sequence
  Artificially Synthesized Primer Sequence
aggggcagacaatgaatgac

SEQ ID NO: 7345 - DNA, 20 bp, Artificial Sequence
  Artificially Synthesized Primer Sequence
tctatcccgtcccctctctt

SEQ ID NO: 7346 - DNA, 20 bp, Artificial Sequence
  Artificially Synthesized Primer Sequence
gcacatgggtcacagtcaac

SEQ ID NO: 7347 - DNA, 20 bp, Artificial Sequence
  Artificially Synthesized Primer Sequence
ttgacccctcgaatggagta

SEQ ID NO: 7348 - DNA, 20 bp, Artificial Sequence
  Artificially Synthesized Primer Sequence
tgctgcagtttgttctctgc

SEQ ID NO: 7349 - DNA, 20 bp, Artificial Sequence
  Artificially Synthesized Primer Sequence
acacatcaaggccatcacaa

SEQ ID NO: 7350 - DNA, 20 bp, Artificial Sequence
  Artificially Synthesized Primer Sequence
cttccctcagccactcaaag

SEQ ID NO: 7351 - DNA, 20 bp, Artificial Sequence
  Artificially Synthesized Primer Sequence
gctatccactgccgaatcat

SEQ ID NO: 7352 - DNA, 20 bp, Artificial Sequence
  Artificially Synthesized Primer Sequence
gaactttgagtggctgaggg

SEQ ID NO: 7353 - DNA, 20 bp, Artificial Sequence
  Artificially Synthesized Primer Sequence
gagaagccaaagcactggac

SEQ ID NO: 7354 - DNA, 20 bp, Artificial Sequence
  Artificially Synthesized Primer Sequence
tatgtcctcatctgcaagcg

SEQ ID NO: 7355 - DNA, 20 bp, Artificial Sequence
  Artificially Synthesized Primer Sequence
tgctttctaccacgagcaaa

SEQ ID NO: 7356 - DNA, 20 bp, Artificial Sequence
  Artificially Synthesized Primer Sequence
agctcactgcttcggaaaac

SEQ ID NO: 7357 - DNA, 20 bp, Artificial Sequence
  Artificially Synthesized Primer Sequence
agcactgttggcctttatcg

SEQ ID NO: 7358 - DNA, 20 bp, Artificial Sequence
  Artificially Synthesized Primer Sequence
tcccctgacttgtactcgct

SEQ ID NO: 7359 - DNA, 20 bp, Artificial Sequence
  Artificially Synthesized Primer Sequence
gacgagagggctccacttta

SEQ ID NO: 7360 - DNA, 20 bp, Artificial Sequence
  Artificially Synthesized Primer Sequence
cataggcgctgtatctccgt

SEQ ID NO: 7361 - DNA, 20 bp, Artificial Sequence
  Artificially Synthesized Primer Sequence
tccttacccccacctattcc

SEQ ID NO: 7362 - DNA, 20 bp, Artificial Sequence
  Artificially Synthesized Primer Sequence
caacacaagcattcgtggac

SEQ ID NO: 7363 - DNA, 20 bp, Artificial Sequence
  Artificially Synthesized Primer Sequence
caacatacccacagcacagc

SEQ ID NO: 7364 - DNA, 20 bp, Artificial Sequence
  Artificially Synthesized Primer Sequence
ggtcatcccaggagggttat

SEQ ID NO: 7365 - DNA, 20 bp, Artificial Sequence
  Artificially Synthesized Primer Sequence
gagaagccaaagcactggac

SEQ ID NO: 7366 - DNA, 20 bp, Artificial Sequence
  Artificially Synthesized Primer Sequence
gatgggtaagtgcaaggcat

SEQ ID NO: 7367 - DNA, 20 bp, Artificial Sequence
  Artificially Synthesized Primer Sequence
tctcagcatccaacaatcca

SEQ ID NO: 7368 - DNA, 20 bp, Artificial Sequence
  Artificially Synthesized Primer Sequence
gagaagccaaagcactggac

SEQ ID NO: 7369 - DNA, 20 bp, Artificial Sequence
  Artificially Synthesized Primer Sequence
cctttgttgtgagccaggtt

SEQ ID NO: 7370 - DNA, 20 bp, Artificial Sequence
  Artificially Synthesized Primer Sequence
caggcttgtcaaacgggtat

SEQ ID NO: 7371 - DNA, 20 bp, Artificial Sequence
  Artificially Synthesized Primer Sequence
tccaaagttggaccgttctc

SEQ ID NO: 7372 - DNA, 20 bp, Artificial Sequence
  Artificially Synthesized Primer Sequence
acatgagcagcattagcacg

SEQ ID NO: 7373 - DNA, 20 bp, Artificial Sequence
  Artificially Synthesized Primer Sequence
gggggtgtgtttcttcctct

SEQ ID NO: 7374 - DNA, 21 bp, Artificial Sequence
  Artificially Synthesized Primer Sequence
tgttttgaagtgtgtgtcgtg

SEQ ID NO: 7375 - DNA, 20 bp, Artificial Sequence
  Artificially Synthesized Primer Sequence
ggaatggacgcaagctattg

SEQ ID NO: 7376 - DNA, 20 bp, Artificial Sequence
  Artificially Synthesized Primer Sequence
accttcccgttctacgacct

SEQ ID NO: 7377 - DNA, 20 bp, Artificial Sequence
  Artificially Synthesized Primer Sequence
gacccgctcgagaactactg

SEQ ID NO: 7378 - DNA, 20 bp, Artificial Sequence
  Artificially Synthesized Primer Sequence
tcgatctggctctcgtctct

SEQ ID NO: 7379 - DNA, 20 bp, Artificial Sequence
  Artificially Synthesized Primer Sequence
tcgatctggctctcgtctct

SEQ ID NO: 7380 - DNA, 20 bp, Artificial Sequence
  Artificially Synthesized Primer Sequence
gacccgctcgagaactactg

SEQ ID NO: 7381 - DNA, 20 bp, Artificial Sequence
  Artificially Synthesized Primer Sequence
gaggttggactcaccttcca

SEQ ID NO: 7382 - DNA, 20 bp, Artificial Sequence
  Artificially Synthesized Primer Sequence
gttgccatattcggagagga

SEQ ID NO: 7383 - DNA, 20 bp, Artificial Sequence
  Artificially Synthesized Primer Sequence
gataaatggaggacgagcga

SEQ ID NO: 7384 - DNA, 20 bp, Artificial Sequence
  Artificially Synthesized Primer Sequence
tgaggttggactcaccttcc

SEQ ID NO: 7385 - DNA, 20 bp, Artificial Sequence
  Artificially Synthesized Primer Sequence
ggtcgctggctaatcttgag

SEQ ID NO: 7386 - DNA, 20 bp, Artificial Sequence
  Artificially Synthesized Primer Sequence
acgacgaggaattttggttg

SEQ ID NO: 7387 - DNA, 20 bp, Artificial Sequence
  Artificially Synthesized Primer Sequence
cgccttattggatcaagagc

SEQ ID NO: 7388 - DNA, 20 bp, Artificial Sequence
  Artificially Synthesized Primer Sequence
gaggtgatgggaggagaagg

SEQ ID NO: 7389 - DNA, 20 bp, Artificial Sequence
  Artificially Synthesized Primer Sequence
cggaagatgtcacctccatt

SEQ ID NO: 7390 - DNA, 20 bp, Artificial Sequence
  Artificially Synthesized Primer Sequence
ggttgcattggctttgattt

SEQ ID NO: 7391 - DNA, 20 bp, Artificial Sequence
  Artificially Synthesized Primer Sequence
ggttgcattggctttgattt

SEQ ID NO: 7392 - DNA, 20 bp, Artificial Sequence
  Artificially Synthesized Primer Sequence
aagatgtcacctccattccg

SEQ ID NO: 7393 - DNA, 20 bp, Artificial Sequence
  Artificially Synthesized Primer Sequence
aattcctcgagcactgttgg

SEQ ID NO: 7394 - DNA, 19 bp, Artificial Sequence
  Artificially Synthesized Primer Sequence
agagctggcagaagaaggc

SEQ ID NO: 7395 - DNA, 20 bp, Artificial Sequence
  Artificially Synthesized Primer Sequence
ggaagaaacgggtagtcggt

SEQ ID NO: 7396 - DNA, 20 bp, Artificial Sequence
  Artificially Synthesized Primer Sequence
catgggatcctctacctcca

SEQ ID NO: 7397 - DNA, 20 bp, Artificial Sequence
  Artificially Synthesized Primer Sequence
accctgcagcagaacaagat

SEQ ID NO: 7398 - DNA, 20 bp, Artificial Sequence
  Artificially Synthesized Primer Sequence
gtcgtactccttgagctggc

SEQ ID NO: 7399 - DNA, 20 bp, Artificial Sequence
  Artificially Synthesized Primer Sequence
caaacgaccaccagaactca

SEQ ID NO: 7400 - DNA, 20 bp, Artificial Sequence
  Artificially Synthesized Primer Sequence
acgacaaatccgtcaaggac

SEQ ID NO: 7401 - DNA, 20 bp, Artificial Sequence
  Artificially Synthesized Primer Sequence
catcagccgatgctgtctta

SEQ ID NO: 7402 - DNA, 20 bp, Artificial Sequence
  Artificially Synthesized Primer Sequence
taggccttcaggtatgggtg

SEQ ID NO: 7403 - DNA, 20 bp, Artificial Sequence
  Artificially Synthesized Primer Sequence
ctgaagccagcatcagaaaa

SEQ ID NO: 7404 - DNA, 19 bp, Artificial Sequence
  Artificially Synthesized Primer Sequence
tcctcacgttgtcgtttcc

SEQ ID NO: 7405 - DNA, 20 bp, Artificial Sequence
  Artificially Synthesized Primer Sequence
cgcctgtcctctagatacgc

SEQ ID NO: 7406 - DNA, 20 bp, Artificial Sequence
  Artificially Synthesized Primer Sequence
agtgcggtatattgaacggc

SEQ ID NO: 7407 - DNA, 20 bp, Artificial Sequence
  Artificially Synthesized Primer Sequence
agttccgccttgctcaacta

SEQ ID NO: 7408 - DNA, 20 bp, Artificial Sequence
  Artificially Synthesized Primer Sequence
cgtagaagccattgtcagca

SEQ ID NO: 7409 - DNA, 20 bp, Artificial Sequence
  Artificially Synthesized Primer Sequence
gggtggaaggttcttgttga

SEQ ID NO: 7410 - DNA, 20 bp, Artificial Sequence
  Artificially Synthesized Primer Sequence
cctataaggggaattgggga

SEQ ID NO: 7411 - DNA, 20 bp, Artificial Sequence
  Artificially Synthesized Primer Sequence
acagttttgagttccggtgc

SEQ ID NO: 7412 - DNA, 20 bp, Artificial Sequence
  Artificially Synthesized Primer Sequence
ctttcgccaaaactggagag

SEQ ID NO: 7413 - DNA, 20 bp, Artificial Sequence
  Artificially Synthesized Primer Sequence
cccaacgaccagagagagag

SEQ ID NO: 7414 - DNA, 20 bp, Artificial Sequence
  Artificially Synthesized Primer Sequence
caggggacttttcagttcca

SEQ ID NO: 7415 - DNA, 21 bp, Artificial Sequence
  Artificially Synthesized Primer Sequence
aggtgtctcgattctgcttca

SEQ ID NO: 7416 - DNA, 20 bp, Artificial Sequence
  Artificially Synthesized Primer Sequence
acaaggctgggggtacatct

SEQ ID NO: 7417 - DNA, 20 bp, Artificial Sequence
  Artificially Synthesized Primer Sequence
ggtgtttacggaggagtcca

SEQ ID NO: 7418 - DNA, 20 bp, Artificial Sequence
  Artificially Synthesized Primer Sequence
caccttggtggctcgtattt

SEQ ID NO: 7419 - DNA, 20 bp, Artificial Sequence
  Artificially Synthesized Primer Sequence
accttggtggctcgtatttg

SEQ ID NO: 7420 - DNA, 20 bp, Artificial Sequence
  Artificially Synthesized Primer Sequence
ggtgtttacggaggagtcca

SEQ ID NO: 7421 - DNA, 20 bp, Artificial Sequence
  Artificially Synthesized Primer Sequence
ctgccattgcccttattgtt

SEQ ID NO: 7422 - DNA, 20 bp, Artificial Sequence
  Artificially Synthesized Primer Sequence
ggacgctgatgttagggtgt

SEQ ID NO: 7423 - DNA, 20 bp, Artificial Sequence
  Artificially Synthesized Primer Sequence
aaaatataggtcgacggccc

SEQ ID NO: 7424 - DNA, 20 bp, Artificial Sequence
  Artificially Synthesized Primer Sequence
atacagcttcggcatggttc

SEQ ID NO: 7425 - DNA, 20 bp, Artificial Sequence
  Artificially Synthesized Primer Sequence
tacaggcgctccagaagttt

SEQ ID NO: 7426 - DNA, 20 bp, Artificial Sequence
  Artificially Synthesized Primer Sequence
aacagcaatgtttccaaggg

SEQ ID NO: 7427 - DNA, 20 bp, Artificial Sequence
  Artificially Synthesized Primer Sequence
ctaactggcctcagaatcgg

SEQ ID NO: 7428 - DNA, 20 bp, Artificial Sequence
  Artificially Synthesized Primer Sequence
ccctgccatctgattctctc

SEQ ID NO: 7429 - DNA, 20 bp, Artificial Sequence
  Artificially Synthesized Primer Sequence
gaaaaaccagtcaggggaca

SEQ ID NO: 7430 - DNA, 20 bp, Artificial Sequence
  Artificially Synthesized Primer Sequence
atggcaggcaatgctttatc

SEQ ID NO: 7431 - DNA, 20 bp, Artificial Sequence
  Artificially Synthesized Primer Sequence
ctgtcacgggtcacacattc

SEQ ID NO: 7432 - DNA, 20 bp, Artificial Sequence
  Artificially Synthesized Primer Sequence
catttcaccctcggctgtat

SEQ ID NO: 7433 - DNA, 20 bp, Artificial Sequence
  Artificially Synthesized Primer Sequence
ccaaatgcctctccttacca

SEQ ID NO: 7434 - DNA, 20 bp, Artificial Sequence
  Artificially Synthesized Primer Sequence
ctcttttggagggagctgtg

SEQ ID NO: 7435 - DNA, 20 bp, Artificial Sequence
  Artificially Synthesized Primer Sequence
acaagaacaaggcacttggc

SEQ ID NO: 7436 - DNA, 20 bp, Artificial Sequence
  Artificially Synthesized Primer Sequence
cggttatccgagatgctgat

SEQ ID NO: 7437 - DNA, 20 bp, Artificial Sequence
  Artificially Synthesized Primer Sequence
accttcaaaaacatcgacgc

SEQ ID NO: 7438 - DNA, 20 bp, Artificial Sequence
  Artificially Synthesized Primer Sequence
tccgagcctctgagtaagga

SEQ ID NO: 7439 - DNA, 20 bp, Artificial Sequence
  Artificially Synthesized Primer Sequence
tgagattgcttagcacgacg

SEQ ID NO: 7440 - DNA, 20 bp, Artificial Sequence
  Artificially Synthesized Primer Sequence
tggactgcaaagttgaccag

SEQ ID NO: 7441 - DNA, 20 bp, Artificial Sequence
  Artificially Synthesized Primer Sequence
gtccagctgcacttgtctca

SEQ ID NO: 7442 - DNA, 20 bp, Artificial Sequence
  Artificially Synthesized Primer Sequence
tgcaggatgttgctgttctc

SEQ ID NO: 7443 - DNA, 20 bp, Artificial Sequence
  Artificially Synthesized Primer Sequence
tgaatggccgatttcttttc

SEQ ID NO: 7444 - DNA, 20 bp, Artificial Sequence
  Artificially Synthesized Primer Sequence
catagcaacccctacaaccg

SEQ ID NO: 7445 - DNA, 20 bp, Artificial Sequence
  Artificially Synthesized Primer Sequence
aagagcctggaggaggagag

SEQ ID NO: 7446 - DNA, 20 bp, Artificial Sequence
  Artificially Synthesized Primer Sequence
ggtcaatcggaatcagagga

SEQ ID NO: 7447 - DNA, 20 bp, Artificial Sequence
  Artificially Synthesized Primer Sequence
tagcctacctacgctgcgat

SEQ ID NO: 7448 - DNA, 20 bp, Artificial Sequence
  Artificially Synthesized Primer Sequence
gagggtgtgtagggaggtga

SEQ ID NO: 7449 - DNA, 20 bp, Artificial Sequence
  Artificially Synthesized Primer Sequence
caaggtgctggaaggtgtct

SEQ ID NO: 7450 - DNA, 20 bp, Artificial Sequence
  Artificially Synthesized Primer Sequence
ggtatcgcacagcatcattg

SEQ ID NO: 7451 - DNA, 20 bp, Artificial Sequence
  Artificially Synthesized Primer Sequence
gctggtacaagcagaacgaa

SEQ ID NO: 7452 - DNA, 20 bp, Artificial Sequence
  Artificially Synthesized Primer Sequence
cccctgctgatcttctctga

SEQ ID NO: 7453 - DNA, 20 bp, Artificial Sequence
  Artificially Synthesized Primer Sequence
actctttgttggggacatcg

SEQ ID NO: 7454 - DNA, 20 bp, Artificial Sequence
  Artificially Synthesized Primer Sequence
gtgaatcctggaacatggct

SEQ ID NO: 7455 - DNA, 20 bp, Artificial Sequence
  Artificially Synthesized Primer Sequence
tcgaagcgacaaacttcaaa

SEQ ID NO: 7456 - DNA, 20 bp, Artificial Sequence
  Artificially Synthesized Primer Sequence
gacccagagaaatccgatga

SEQ ID NO: 7457 - DNA, 20 bp, Artificial Sequence
  Artificially Synthesized Primer Sequence
ctttcagtaaccgctctccg

SEQ ID NO: 7458 - DNA, 20 bp, Artificial Sequence
  Artificially Synthesized Primer Sequence
gtactggcaaaagaggagcg

SEQ ID NO: 7459 - DNA, 20 bp, Artificial Sequence
  Artificially Synthesized Primer Sequence
acgtgcctggatgaagaatc

SEQ ID NO: 7460 - DNA, 20 bp, Artificial Sequence
  Artificially Synthesized Primer Sequence
tagaaaggctagagctgcgg

SEQ ID NO: 7461 - DNA, 20 bp, Artificial Sequence
  Artificially Synthesized Primer Sequence
gcttgatgctcagcttaccc

SEQ ID NO: 7462 - DNA, 20 bp, Artificial Sequence
  Artificially Synthesized Primer Sequence
cactgtttccagcacccttt

SEQ ID NO: 7463 - DNA, 20 bp, Artificial Sequence
  Artificially Synthesized Primer Sequence
ttgggtatgcgttcaaacaa

SEQ ID NO: 7464 - DNA, 20 bp, Artificial Sequence
  Artificially Synthesized Primer Sequence
aacctgggatcggatagctc

SEQ ID NO: 7465 - DNA, 20 bp, Artificial Sequence
  Artificially Synthesized Primer Sequence
tccctctcacatcccatttc

SEQ ID NO: 7466 - DNA, 20 bp, Artificial Sequence
  Artificially Synthesized Primer Sequence
tgaattgcacaagggacaaa

SEQ ID NO: 7467 - DNA, 20 bp, Artificial Sequence
  Artificially Synthesized Primer Sequence
tcaaacaggaacatcatgcc

SEQ ID NO: 7468 - DNA, 20 bp, Artificial Sequence
  Artificially Synthesized Primer Sequence
attgtgctgtcaaatgcgaa

SEQ ID NO: 7469 - DNA, 20 bp, Artificial Sequence
  Artificially Synthesized Primer Sequence
tatttcctccgccacatctc

SEQ ID NO: 7470 - DNA, 20 bp, Artificial Sequence
  Artificially Synthesized Primer Sequence
cggtagtcacacagcaggaa

SEQ ID NO: 7471 - DNA, 20 bp, Artificial Sequence
  Artificially Synthesized Primer Sequence
acgaatcaccctgtggtagc

SEQ ID NO: 7472 - DNA, 20 bp, Artificial Sequence
  Artificially Synthesized Primer Sequence
catcgagcaggttgagaaca

SEQ ID NO: 7473 - DNA, 20 bp, Artificial Sequence
  Artificially Synthesized Primer Sequence
caaagtggtgaacgatggtg

SEQ ID NO: 7474 - DNA, 20 bp, Artificial Sequence
  Artificially Synthesized Primer Sequence
tcaatggcatcagcaatcat

SEQ ID NO: 7475 - DNA, 20 bp, Artificial Sequence
  Artificially Synthesized Primer Sequence
cgcaaaaatggcaatcctac

SEQ ID NO: 7476 - DNA, 20 bp, Artificial Sequence
  Artificially Synthesized Primer Sequence
aggggaagttgtgatcgaga

SEQ ID NO: 7477 - DNA, 20 bp, Artificial Sequence
  Artificially Synthesized Primer Sequence
ttttggccctaaaaacaacg

SEQ ID NO: 7478 - DNA, 20 bp, Artificial Sequence
  Artificially Synthesized Primer Sequence
atagaagggcggaaaaggaa

SEQ ID NO: 7479 - DNA, 20 bp, Artificial Sequence
  Artificially Synthesized Primer Sequence
aagatcattggctttgtgcc

SEQ ID NO: 7480 - DNA, 20 bp, Artificial Sequence
  Artificially Synthesized Primer Sequence
atgttcaccccttcaagtgc

SEQ ID NO: 7481 - DNA, 20 bp, Artificial Sequence
  Artificially Synthesized Primer Sequence
atgccaaattctacggcaac

SEQ ID NO: 7482 - DNA, 20 bp, Artificial Sequence
  Artificially Synthesized Primer Sequence
gcacaatgaccattgaccag

SEQ ID NO: 7483 - DNA, 20 bp, Artificial Sequence
  Artificially Synthesized Primer Sequence
cctgcacgtagtaagcgaca

SEQ ID NO: 7484 - DNA, 20 bp, Artificial Sequence
  Artificially Synthesized Primer Sequence
ccggaggttaaaggagaagg

SEQ ID NO: 7485 - DNA, 20 bp, Artificial Sequence
  Artificially Synthesized Primer Sequence
agcgctactacgagaaccga

SEQ ID NO: 7486 - DNA, 20 bp, Artificial Sequence
  Artificially Synthesized Primer Sequence
agggtatgaggcgaaaacct

SEQ ID NO: 7487 - DNA, 21 bp, Artificial Sequence
  Artificially Synthesized Primer Sequence
aagggaaagagagagaagcga

SEQ ID NO: 7488 - DNA, 20 bp, Artificial Sequence
  Artificially Synthesized Primer Sequence
agcgctactacgagaaccga

SEQ ID NO: 7489 - DNA, 20 bp, Artificial Sequence
  Artificially Synthesized Primer Sequence
caacatgctggaatggtttg

SEQ ID NO: 7490 - DNA, 20 bp, Artificial Sequence
  Artificially Synthesized Primer Sequence
gcatgaccatatgcttgcac

SEQ ID NO: 7491 - DNA, 20 bp, Artificial Sequence
  Artificially Synthesized Primer Sequence
ttcacccatgttaaaccacg

SEQ ID NO: 7492 - DNA, 20 bp, Artificial Sequence
  Artificially Synthesized Primer Sequence
tttgacgacaagttcatccg

SEQ ID NO: 7493 - DNA, 22 bp, Artificial Sequence
  Artificially Synthesized Primer Sequence
tttaaaggagaaagggagaggg

SEQ ID NO: 7494 - DNA, 18 bp, Artificial Sequence
  Artificially Synthesized Primer Sequence
gggcggcgaaagaagttt

SEQ ID NO: 7495 - DNA, 20 bp, Artificial Sequence
  Artificially Synthesized Primer Sequence
aatccgttcttccttttcgg

SEQ ID NO: 7496 - DNA, 20 bp, Artificial Sequence
  Artificially Synthesized Primer Sequence
caacttgcagtcatcggcta

SEQ ID NO: 7497 - DNA, 20 bp, Artificial Sequence
  Artificially Synthesized Primer Sequence
cgctacaaaccctgcttctc

SEQ ID NO: 7498 - DNA, 20 bp, Artificial Sequence
  Artificially Synthesized Primer Sequence
gccatactgctggttgtgtg

SEQ ID NO: 7499 - DNA, 20 bp, Artificial Sequence
  Artificially Synthesized Primer Sequence
gttcacaacccttggcactt

SEQ ID NO: 7500 - DNA, 20 bp, Artificial Sequence
  Artificially Synthesized Primer Sequence
tcttgactgggcaattaggg

SEQ ID NO: 7501 - DNA, 20 bp, Artificial Sequence
  Artificially Synthesized Primer Sequence
ctcgcgatgcagtatcaaaa

SEQ ID NO: 7502 - DNA, 20 bp, Artificial Sequence
  Artificially Synthesized Primer Sequence
caaaagcattgtagccagca

SEQ ID NO: 7503 - DNA, 20 bp, Artificial Sequence
  Artificially Synthesized Primer Sequence
cgagcatacaaaggacgaca

SEQ ID NO: 7504 - DNA, 20 bp, Artificial Sequence
  Artificially Synthesized Primer Sequence
ggacacctgattgcaacctt

SEQ ID NO: 7505 - DNA, 20 bp, Artificial Sequence
  Artificially Synthesized Primer Sequence
atggcctttccctcaattct

SEQ ID NO: 7506 - DNA, 20 bp, Artificial Sequence
  Artificially Synthesized Primer Sequence
atgcagacccaatgcacata

SEQ ID NO: 7507 - DNA, 20 bp, Artificial Sequence
  Artificially Synthesized Primer Sequence
gggggcatactctccaaact

SEQ ID NO: 7508 - DNA, 20 bp, Artificial Sequence
  Artificially Synthesized Primer Sequence
gacgcgacgattcagaagat

SEQ ID NO: 7509 - DNA, 20 bp, Artificial Sequence
  Artificially Synthesized Primer Sequence
atgattgctgatgccattga

SEQ ID NO: 7510 - DNA, 20 bp, Artificial Sequence
  Artificially Synthesized Primer Sequence
tcccaagttggtctaccgtc

SEQ ID NO: 7511 - DNA, 20 bp, Artificial Sequence
  Artificially Synthesized Primer Sequence
cttggcctgaactgaagcat

SEQ ID NO: 7512 - DNA, 20 bp, Artificial Sequence
  Artificially Synthesized Primer Sequence
aattgaagaccacgacgagc

SEQ ID NO: 7513 - DNA, 20 bp, Artificial Sequence
  Artificially Synthesized Primer Sequence
ctggagaggcttctctggtg

SEQ ID NO: 7514 - DNA, 20 bp, Artificial Sequence
  Artificially Synthesized Primer Sequence
cgggcttctatgctcttctg

SEQ ID NO: 7515 - DNA, 20 bp, Artificial Sequence
  Artificially Synthesized Primer Sequence
gagaagccaaaagcaggttg

SEQ ID NO: 7516 - DNA, 20 bp, Artificial Sequence
  Artificially Synthesized Primer Sequence
gaggctgaaacaggaagcac

SEQ ID NO: 7517 - DNA, 20 bp, Artificial Sequence
  Artificially Synthesized Primer Sequence
tgtcttacttgccacccctc

SEQ ID NO: 7518 - DNA, 20 bp, Artificial Sequence
  Artificially Synthesized Primer Sequence
gatgatacggacgtaggcgt

SEQ ID NO: 7519 - DNA, 20 bp, Artificial Sequence
  Artificially Synthesized Primer Sequence
cgaccgaccaatgtgaacta

SEQ ID NO: 7520 - DNA, 20 bp, Artificial Sequence
  Artificially Synthesized Primer Sequence
tcttacttgccacccctcac

SEQ ID NO: 7521 - DNA, 20 bp, Artificial Sequence
  Artificially Synthesized Primer Sequence
tagccccaagagaggactga

SEQ ID NO: 7522 - DNA, 20 bp, Artificial Sequence
  Artificially Synthesized Primer Sequence
agtcgcgaacgacaagaact

SEQ ID NO: 7523 - DNA, 20 bp, Artificial Sequence
  Artificially Synthesized Primer Sequence
gggcaacttcaaccaagtgt

SEQ ID NO: 7524 - DNA, 20 bp, Artificial Sequence
  Artificially Synthesized Primer Sequence
gactgcaagggttggtgatt

SEQ ID NO: 7525 - DNA, 20 bp, Artificial Sequence
  Artificially Synthesized Primer Sequence
tgtcttacttgccacccctc

SEQ ID NO: 7526 - DNA, 20 bp, Artificial Sequence
  Artificially Synthesized Primer Sequence
ttgacctcttccacctcgtt

SEQ ID NO: 7527 - DNA, 20 bp, Artificial Sequence
  Artificially Synthesized Primer Sequence
cttgcactttatgccttgcc

SEQ ID NO: 7528 - DNA, 20 bp, Artificial Sequence
  Artificially Synthesized Primer Sequence
tgtcttacttgccacccctc

SEQ ID NO: 7529 - DNA, 20 bp, Artificial Sequence
  Artificially Synthesized Primer Sequence
caagatccagcgtcttgtga

SEQ ID NO: 7530 - DNA, 20 bp, Artificial Sequence
  Artificially Synthesized Primer Sequence
gtgcttgaaactctttcgcc

SEQ ID NO: 7531 - DNA, 20 bp, Artificial Sequence
  Artificially Synthesized Primer Sequence
gtgcttgaaactctttcgcc

SEQ ID NO: 7532 - DNA, 20 bp, Artificial Sequence
  Artificially Synthesized Primer Sequence
gatgatgatgtccgcagcta

SEQ ID NO: 7533 - DNA, 20 bp, Artificial Sequence
  Artificially Synthesized Primer Sequence
tgcttatgttcaaggggagg

SEQ ID NO: 7534 - DNA, 20 bp, Artificial Sequence
  Artificially Synthesized Primer Sequence
caccattttgggagcgtagt

SEQ ID NO: 7535 - DNA, 20 bp, Artificial Sequence
  Artificially Synthesized Primer Sequence
gcagctaggaaggaacatgc

SEQ ID NO: 7536 - DNA, 20 bp, Artificial Sequence
  Artificially Synthesized Primer Sequence
agtgatatttcgctgggcac

SEQ ID NO: 7537 - DNA, 20 bp, Artificial Sequence
  Artificially Synthesized Primer Sequence
gaaccatcatcaggagggaa

SEQ ID NO: 7538 - DNA, 20 bp, Artificial Sequence
  Artificially Synthesized Primer Sequence
cggtgatgggtcttgtcttt

SEQ ID NO: 7539 - DNA, 20 bp, Artificial Sequence
  Artificially Synthesized Primer Sequence
gctcaagcatgtcaaccaaa

SEQ ID NO: 7540 - DNA, 20 bp, Artificial Sequence
  Artificially Synthesized Primer Sequence
tctaattccagcagcaaccc

SEQ ID NO: 7541 - DNA, 20 bp, Artificial Sequence
  Artificially Synthesized Primer Sequence
ggcccatcaagaaacacatc

SEQ ID NO: 7542 - DNA, 20 bp, Artificial Sequence
  Artificially Synthesized Primer Sequence
ttccaagagttggagaacgg

SEQ ID NO: 7543 - DNA, 20 bp, Artificial Sequence
  Artificially Synthesized Primer Sequence
aaactgacacccactgaccc

SEQ ID NO: 7544 - DNA, 20 bp, Artificial Sequence
  Artificially Synthesized Primer Sequence
ggcccatcaagaaacacatc

SEQ ID NO: 7545 - DNA, 20 bp, Artificial Sequence
  Artificially Synthesized Primer Sequence
ttccatcatccagacaacca

SEQ ID NO: 7546 - DNA, 20 bp, Artificial Sequence
  Artificially Synthesized Primer Sequence
ataagcccaacgcaagaatg

SEQ ID NO: 7547 - DNA, 20 bp, Artificial Sequence
  Artificially Synthesized Primer Sequence
tggagggccaatttctacac

SEQ ID NO: 7548 - DNA, 20 bp, Artificial Sequence
  Artificially Synthesized Primer Sequence
tgcaataagtgtccagccaa

SEQ ID NO: 7549 - DNA, 20 bp, Artificial Sequence
  Artificially Synthesized Primer Sequence
caaagacgctctacaagggc

SEQ ID NO: 7550 - DNA, 20 bp, Artificial Sequence
  Artificially Synthesized Primer Sequence
taacataacatgcacgcggt

SEQ ID NO: 7551 - DNA, 20 bp, Artificial Sequence
  Artificially Synthesized Primer Sequence
gcgcgcacactgtataacat

SEQ ID NO: 7552 - DNA, 20 bp, Artificial Sequence
  Artificially Synthesized Primer Sequence
caaagacgctctacaagggc

SEQ ID NO: 7553 - DNA, 20 bp, Artificial Sequence
  Artificially Synthesized Primer Sequence
agcagtatgggctcaccatc

SEQ ID NO: 7554 - DNA, 20 bp, Artificial Sequence
  Artificially Synthesized Primer Sequence
cccctaaatgtgggatcctt

SEQ ID NO: 7555 - DNA, 20 bp, Artificial Sequence
  Artificially Synthesized Primer Sequence
gagaggccacgtcaatcaat

SEQ ID NO: 7556 - DNA, 20 bp, Artificial Sequence
  Artificially Synthesized Primer Sequence
aagtttgggtccccagttct

SEQ ID NO: 7557 - DNA, 20 bp, Artificial Sequence
  Artificially Synthesized Primer Sequence
ctgtacgggaacctcgacat

SEQ ID NO: 7558 - DNA, 20 bp, Artificial Sequence
  Artificially Synthesized Primer Sequence
atgctaagcagagagccgag

SEQ ID NO: 7559 - DNA, 20 bp, Artificial Sequence
  Artificially Synthesized Primer Sequence
atgctaagcagagagccgag

SEQ ID NO: 7560 - DNA, 20 bp, Artificial Sequence
  Artificially Synthesized Primer Sequence
ctgtacgggaacctcgacat

SEQ ID NO: 7561 - DNA, 20 bp, Artificial Sequence
  Artificially Synthesized Primer Sequence
tgggcaaagaaaagatccac

SEQ ID NO: 7562 - DNA, 20 bp, Artificial Sequence
  Artificially Synthesized Primer Sequence
taagcacagcacaatcagcc

SEQ ID NO: 7563 - DNA, 20 bp, Artificial Sequence
  Artificially Synthesized Primer Sequence
aactatcgccaccaccaaac

SEQ ID NO: 7564 - DNA, 20 bp, Artificial Sequence
  Artificially Synthesized Primer Sequence
agatcagcaacggttatgcc

SEQ ID NO: 7565 - DNA, 20 bp, Artificial Sequence
  Artificially Synthesized Primer Sequence
ctcgttgtccagggtttgtt

SEQ ID NO: 7566 - DNA, 20 bp, Artificial Sequence
  Artificially Synthesized Primer Sequence
tagcaacagtcccaggctct

SEQ ID NO: 7567 - DNA, 20 bp, Artificial Sequence
  Artificially Synthesized Primer Sequence
ggctacccaaacagatggaa

SEQ ID NO: 7568 - DNA, 20 bp, Artificial Sequence
  Artificially Synthesized Primer Sequence
aagtgacccaggaatcctcc

SEQ ID NO: 7569 - DNA, 20 bp, Artificial Sequence
  Artificially Synthesized Primer Sequence
ttgccccttcagatgacttc

SEQ ID NO: 7570 - DNA, 20 bp, Artificial Sequence
  Artificially Synthesized Primer Sequence
atatcagcctagcggtccct

SEQ ID NO: 7571 - DNA, 20 bp, Artificial Sequence
  Artificially Synthesized Primer Sequence
atatcagcctagcggtccct

SEQ ID NO: 7572 - DNA, 20 bp, Artificial Sequence
  Artificially Synthesized Primer Sequence
agcatacggctattcgagga

SEQ ID NO: 7573 - DNA, 20 bp, Artificial Sequence
  Artificially Synthesized Primer Sequence
cagggggtttcttctgttga

SEQ ID NO: 7574 - DNA, 20 bp, Artificial Sequence
  Artificially Synthesized Primer Sequence
atgaattggaaaggtgcagg

SEQ ID NO: 7575 - DNA, 20 bp, Artificial Sequence
  Artificially Synthesized Primer Sequence
agcagggctcaacaacaact

SEQ ID NO: 7576 - DNA, 20 bp, Artificial Sequence
  Artificially Synthesized Primer Sequence
tagcttggtggttctgggtc

SEQ ID NO: 7577 - DNA, 20 bp, Artificial Sequence
  Artificially Synthesized Primer Sequence
gcgggattaagcagtggtaa

SEQ ID NO: 7578 - DNA, 20 bp, Artificial Sequence
  Artificially Synthesized Primer Sequence
aatgccgaatgtccagaaac

SEQ ID NO: 7579 - DNA, 20 bp, Artificial Sequence
  Artificially Synthesized Primer Sequence
ggctacatcggatcttctgg

SEQ ID NO: 7580 - DNA, 19 bp, Artificial Sequence
  Artificially Synthesized Primer Sequence
tgaagggaacccctttcac

SEQ ID NO: 7581 - DNA, 20 bp, Artificial Sequence
  Artificially Synthesized Primer Sequence
ccaaggatggttcgagatgt

SEQ ID NO: 7582 - DNA, 20 bp, Artificial Sequence
  Artificially Synthesized Primer Sequence
ataccgatttttgcggacag

SEQ ID NO: 7583 - DNA, 20 bp, Artificial Sequence
  Artificially Synthesized Primer Sequence
ggtgagactgaacgtgcaaa

SEQ ID NO: 7584 - DNA, 20 bp, Artificial Sequence
  Artificially Synthesized Primer Sequence
caaccaatcgggcagatact

SEQ ID NO: 7585 - DNA, 20 bp, Artificial Sequence
  Artificially Synthesized Primer Sequence
gccaaggctgttgctaactc

SEQ ID NO: 7586 - DNA, 20 bp, Artificial Sequence
  Artificially Synthesized Primer Sequence
cgccgcctagtcttaatgtc

SEQ ID NO: 7587 - DNA, 20 bp, Artificial Sequence
  Artificially Synthesized Primer Sequence
acaaatttgcgcctatcctc

SEQ ID NO: 7588 - DNA, 20 bp, Artificial Sequence
  Artificially Synthesized Primer Sequence
gacattaagactaggcggcg

SEQ ID NO: 7589 - DNA, 20 bp, Artificial Sequence
  Artificially Synthesized Primer Sequence
actacgggtggctcaacaac

SEQ ID NO: 7590 - DNA, 20 bp, Artificial Sequence
  Artificially Synthesized Primer Sequence
gaattgccggatactgagga

SEQ ID NO: 7591 - DNA, 20 bp, Artificial Sequence
  Artificially Synthesized Primer Sequence
gaattgccggatactgagga

SEQ ID NO: 7592 - DNA, 20 bp, Artificial Sequence
  Artificially Synthesized Primer Sequence
actacgggtggctcaacaac

SEQ ID NO: 7593 - DNA, 20 bp, Artificial Sequence
  Artificially Synthesized Primer Sequence
gcaactcttgataggaggcg

SEQ ID NO: 7594 - DNA, 20 bp, Artificial Sequence
  Artificially Synthesized Primer Sequence
aaccctatccttgttgtgcg

SEQ ID NO: 7595 - DNA, 20 bp, Artificial Sequence
  Artificially Synthesized Primer Sequence
gacaacatcaccgacgaatg

SEQ ID NO: 7596 - DNA, 20 bp, Artificial Sequence
  Artificially Synthesized Primer Sequence
catgcagagccagcagagta

SEQ ID NO: 7597 - DNA, 20 bp, Artificial Sequence
  Artificially Synthesized Primer Sequence
catctgggagttcgtggagt

SEQ ID NO: 7598 - DNA, 20 bp, Artificial Sequence
  Artificially Synthesized Primer Sequence
gggcttgtatacgtccctga

SEQ ID NO: 7599 - DNA, 21 bp, Artificial Sequence
  Artificially Synthesized Primer Sequence
cacgtatcgtgacgtaacagg

SEQ ID NO: 7600 - DNA, 20 bp, Artificial Sequence
  Artificially Synthesized Primer Sequence
aacgacgagagcctggagta

SEQ ID NO: 7601 - DNA, 20 bp, Artificial Sequence
  Artificially Synthesized Primer Sequence
gaggaatcgcaccaaagaag

SEQ ID NO: 7602 - DNA, 20 bp, Artificial Sequence
  Artificially Synthesized Primer Sequence
gcgacaaccaaaagggtcta

SEQ ID NO: 7603 - DNA, 20 bp, Artificial Sequence
  Artificially Synthesized Primer Sequence
gcgacaaccaaaagggtcta

SEQ ID NO: 7604 - DNA, 20 bp, Artificial Sequence
  Artificially Synthesized Primer Sequence
tgaaacctgcttcatcatcg

SEQ ID NO: 7605 - DNA, 20 bp, Artificial Sequence
  Artificially Synthesized Primer Sequence
tccattaaagactggcaccc

SEQ ID NO: 7606 - DNA, 20 bp, Artificial Sequence
  Artificially Synthesized Primer Sequence
gcttccccctcctctatgtc

SEQ ID NO: 7607 - DNA, 20 bp, Artificial Sequence
  Artificially Synthesized Primer Sequence
cttgcaaagaatggcctagc

SEQ ID NO: 7608 - DNA, 20 bp, Artificial Sequence
  Artificially Synthesized Primer Sequence
gaaaacatgccaggaaggac

SEQ ID NO: 7609 - DNA, 20 bp, Artificial Sequence
  Artificially Synthesized Primer Sequence
caagcacagcacctcctaca

SEQ ID NO: 7610 - DNA, 20 bp, Artificial Sequence
  Artificially Synthesized Primer Sequence
gccaggtggaactcgtagac

SEQ ID NO: 7611 - DNA, 20 bp, Artificial Sequence
  Artificially Synthesized Primer Sequence
ctggcgtttctacagcacaa

SEQ ID NO: 7612 - DNA, 20 bp, Artificial Sequence
  Artificially Synthesized Primer Sequence
agatctgcacagcatgcaac

SEQ ID NO: 7613 - DNA, 20 bp, Artificial Sequence
  Artificially Synthesized Primer Sequence
aaggacatgaggtggagcac

SEQ ID NO: 7614 - DNA, 20 bp, Artificial Sequence
  Artificially Synthesized Primer Sequence
gcccacatcgtttcttcagt

SEQ ID NO: 7615 - DNA, 20 bp, Artificial Sequence
  Artificially Synthesized Primer Sequence
gcccacatcgtttcttcagt

SEQ ID NO: 7616 - DNA, 20 bp, Artificial Sequence
  Artificially Synthesized Primer Sequence
aaggacatgaggtggagcac

SEQ ID NO: 7617 - DNA, 20 bp, Artificial Sequence
  Artificially Synthesized Primer Sequence
tatagcaccaagggtttggg

SEQ ID NO: 7618 - DNA, 20 bp, Artificial Sequence
  Artificially Synthesized Primer Sequence
ccgctttttcgttcctttta

SEQ ID NO: 7619 - DNA, 20 bp, Artificial Sequence
  Artificially Synthesized Primer Sequence
ggggaaaaccctgattgatt

SEQ ID NO: 7620 - DNA, 20 bp, Artificial Sequence
  Artificially Synthesized Primer Sequence
ctgggaagaggatgtttgga

SEQ ID NO: 7621 - DNA, 20 bp, Artificial Sequence
  Artificially Synthesized Primer Sequence
tcttcgacaaggacggagat

SEQ ID NO: 7622 - DNA, 20 bp, Artificial Sequence
  Artificially Synthesized Primer Sequence
gagatgaagccgttttggtc

SEQ ID NO: 7623 - DNA, 20 bp, Artificial Sequence
  Artificially Synthesized Primer Sequence
caccagggaggacacaagtt

SEQ ID NO: 7624 - DNA, 20 bp, Artificial Sequence
  Artificially Synthesized Primer Sequence
cgcaagatgaaggacactga

SEQ ID NO: 7625 - DNA, 20 bp, Artificial Sequence
  Artificially Synthesized Primer Sequence
acaacgagaagccgacactt

SEQ ID NO: 7626 - DNA, 20 bp, Artificial Sequence
  Artificially Synthesized Primer Sequence
ggatcttaatctggggaggc

SEQ ID NO: 7627 - DNA, 20 bp, Artificial Sequence
  Artificially Synthesized Primer Sequence
acaacgagaagccgacactt

SEQ ID NO: 7628 - DNA, 20 bp, Artificial Sequence
  Artificially Synthesized Primer Sequence
agagcttcggcaggtttaca

SEQ ID NO: 7629 - DNA, 20 bp, Artificial Sequence
  Artificially Synthesized Primer Sequence
accgacgcgtatgatctctt

SEQ ID NO: 7630 - DNA, 18 bp, Artificial Sequence
  Artificially Synthesized Primer Sequence
cagccgaagaagagctgg

SEQ ID NO: 7631 - DNA, 20 bp, Artificial Sequence
  Artificially Synthesized Primer Sequence
tggctgctatgctacgtttg

SEQ ID NO: 7632 - DNA, 20 bp, Artificial Sequence
  Artificially Synthesized Primer Sequence
aatttggaggagctgttgga

SEQ ID NO: 7633 - DNA, 20 bp, Artificial Sequence
  Artificially Synthesized Primer Sequence
gtcatgagctcaagttggca

SEQ ID NO: 7634 - DNA, 20 bp, Artificial Sequence
  Artificially Synthesized Primer Sequence
gtggcaaagttttgaaggga

SEQ ID NO: 7635 - DNA, 20 bp, Artificial Sequence
  Artificially Synthesized Primer Sequence
gcatcatcaactcgtcatgg

SEQ ID NO: 7636 - DNA, 20 bp, Artificial Sequence
  Artificially Synthesized Primer Sequence
cagagtgcacctgtgaagga

SEQ ID NO: 7637 - DNA, 20 bp, Artificial Sequence
  Artificially Synthesized Primer Sequence
aatcgttcgtctgacttggg

SEQ ID NO: 7638 - DNA, 20 bp, Artificial Sequence
  Artificially Synthesized Primer Sequence
aacgtcgtcgcgtagcttat

SEQ ID NO: 7639 - DNA, 20 bp, Artificial Sequence
  Artificially Synthesized Primer Sequence
ccactctctccaacaccctc

SEQ ID NO: 7640 - DNA, 20 bp, Artificial Sequence
  Artificially Synthesized Primer Sequence
gtcgtcgtcgtcgtagtcct

SEQ ID NO: 7641 - DNA, 20 bp, Artificial Sequence
  Artificially Synthesized Primer Sequence
tacctcaacttcgacgcctt

SEQ ID NO: 7642 - DNA, 20 bp, Artificial Sequence
  Artificially Synthesized Primer Sequence
acacatcgcacacggtttta

SEQ ID NO: 7643 - DNA, 20 bp, Artificial Sequence
  Artificially Synthesized Primer Sequence
caacaccctcttcttcctcg

SEQ ID NO: 7644 - DNA, 20 bp, Artificial Sequence
  Artificially Synthesized Primer Sequence
tacctcaacttcgacgcctt

SEQ ID NO: 7645 - DNA, 20 bp, Artificial Sequence
  Artificially Synthesized Primer Sequence
agggactgttcgttttgtgg

SEQ ID NO: 7646 - DNA, 20 bp, Artificial Sequence
  Artificially Synthesized Primer Sequence
tggaatcgagcataagggac

SEQ ID NO: 7647 - DNA, 20 bp, Artificial Sequence
  Artificially Synthesized Primer Sequence
ataccaagcacggaggtcac

SEQ ID NO: 7648 - DNA, 20 bp, Artificial Sequence
  Artificially Synthesized Primer Sequence
taacatggttgtcgacgagg

SEQ ID NO: 7649 - DNA, 20 bp, Artificial Sequence
  Artificially Synthesized Primer Sequence
tctacctcaacttcgacgcc

SEQ ID NO: 7650 - DNA, 20 bp, Artificial Sequence
  Artificially Synthesized Primer Sequence
tatcaagccacaaagggtcc

SEQ ID NO: 7651 - DNA, 20 bp, Artificial Sequence
  Artificially Synthesized Primer Sequence
tagggagcgactagcgagag

SEQ ID NO: 7652 - DNA, 19 bp, Artificial Sequence
  Artificially Synthesized Primer Sequence
cgtacaacccggacttcct

SEQ ID NO: 7653 - DNA, 20 bp, Artificial Sequence
  Artificially Synthesized Primer Sequence
aatggcgtatgctatcccag

SEQ ID NO: 7654 - DNA, 20 bp, Artificial Sequence
  Artificially Synthesized Primer Sequence
agctgccctgtcaaagaaaa

SEQ ID NO: 7655 - DNA, 20 bp, Artificial Sequence
  Artificially Synthesized Primer Sequence
gctctcgtccgactctcatc

SEQ ID NO: 7656 - DNA, 20 bp, Artificial Sequence
  Artificially Synthesized Primer Sequence
acgcccaatctagctaccct

SEQ ID NO: 7657 - DNA, 20 bp, Artificial Sequence
  Artificially Synthesized Primer Sequence
atggcaagacatggaggaag

SEQ ID NO: 7658 - DNA, 20 bp, Artificial Sequence
  Artificially Synthesized Primer Sequence
ttggatgatgagtgatcgga

SEQ ID NO: 7659 - DNA, 20 bp, Artificial Sequence
  Artificially Synthesized Primer Sequence
actaccccatgcatgcaaat

SEQ ID NO: 7660 - DNA, 20 bp, Artificial Sequence
  Artificially Synthesized Primer Sequence
tcattcgatgcttttctccc

SEQ ID NO: 7661 - DNA, 20 bp, Artificial Sequence
  Artificially Synthesized Primer Sequence
ggagagatttgcagagtggg

SEQ ID NO: 7662 - DNA, 20 bp, Artificial Sequence
  Artificially Synthesized Primer Sequence
acaccatcagctgtaagggc

SEQ ID NO: 7663 - DNA, 20 bp, Artificial Sequence
  Artificially Synthesized Primer Sequence
cccaaccaaagaagcatgag

SEQ ID NO: 7664 - DNA, 20 bp, Artificial Sequence
  Artificially Synthesized Primer Sequence
tgcagagtgggagtcatctg

SEQ ID NO: 7665 - DNA, 20 bp, Artificial Sequence
  Artificially Synthesized Primer Sequence
ggagccgtttcagtctcaag

SEQ ID NO: 7666 - DNA, 20 bp, Artificial Sequence
  Artificially Synthesized Primer Sequence
acgggaaaacagtcagatgc

SEQ ID NO: 7667 - DNA, 20 bp, Artificial Sequence
  Artificially Synthesized Primer Sequence
gctttgtaaaccccgtcaaa

SEQ ID NO: 7668 - DNA, 20 bp, Artificial Sequence
  Artificially Synthesized Primer Sequence
acacgctgaagaagattgcc

SEQ ID NO: 7669 - DNA, 20 bp, Artificial Sequence
  Artificially Synthesized Primer Sequence
cattgatgaacggtggtcag

SEQ ID NO: 7670 - DNA, 20 bp, Artificial Sequence
  Artificially Synthesized Primer Sequence
gggctccaaaagttcctacc

SEQ ID NO: 7671 - DNA, 20 bp, Artificial Sequence
  Artificially Synthesized Primer Sequence
tgtgacctggaagttggatg

SEQ ID NO: 7672 - DNA, 20 bp, Artificial Sequence
  Artificially Synthesized Primer Sequence
tttgggtcaaggaaaaggtg

SEQ ID NO: 7673 - DNA, 20 bp, Artificial Sequence
  Artificially Synthesized Primer Sequence
agacatgcggattgtccttc

SEQ ID NO: 7674 - DNA, 20 bp, Artificial Sequence
  Artificially Synthesized Primer Sequence
tggacgtgcttatcatgctc

SEQ ID NO: 7675 - DNA, 20 bp, Artificial Sequence
  Artificially Synthesized Primer Sequence
gagcatgaacacagctgcac

SEQ ID NO: 7676 - DNA, 20 bp, Artificial Sequence
  Artificially Synthesized Primer Sequence
atgcggattgtccttctgtc

SEQ ID NO: 7677 - DNA, 20 bp, Artificial Sequence
  Artificially Synthesized Primer Sequence
caggtgctcttcaacaacga

SEQ ID NO: 7678 - DNA, 20 bp, Artificial Sequence
  Artificially Synthesized Primer Sequence
ttgtagctcgtgcgtcaatc

SEQ ID NO: 7679 - DNA, 20 bp, Artificial Sequence
  Artificially Synthesized Primer Sequence
attgaccactgttcttgggc

SEQ ID NO: 7680 - DNA, 19 bp, Artificial Sequence
  Artificially Synthesized Primer Sequence
caactgcccacagacaacc

SEQ ID NO: 7681 - DNA, 20 bp, Artificial Sequence
  Artificially Synthesized Primer Sequence
gttggcctactggattgcat

SEQ ID NO: 7682 - DNA, 20 bp, Artificial Sequence
  Artificially Synthesized Primer Sequence
tcgccttgatgctgtctatg

SEQ ID NO: 7683 - DNA, 20 bp, Artificial Sequence
  Artificially Synthesized Primer Sequence
gcctttatggctttgcacat

SEQ ID NO: 7684 - DNA, 20 bp, Artificial Sequence
  Artificially Synthesized Primer Sequence
accgacaacaacgtcaacaa

SEQ ID NO: 7685 - DNA, 20 bp, Artificial Sequence
  Artificially Synthesized Primer Sequence
cttcacttcccgactgcttc

SEQ ID NO: 7686 - DNA, 20 bp, Artificial Sequence
  Artificially Synthesized Primer Sequence
ggtggtgtcgatgttagcct

SEQ ID NO: 7687 - DNA, 20 bp, Artificial Sequence
  Artificially Synthesized Primer Sequence
tacctttaccaaacgcccaa

SEQ ID NO: 7688 - DNA, 20 bp, Artificial Sequence
  Artificially Synthesized Primer Sequence
tacaccaacctcatgtccca

SEQ ID NO: 7689 - DNA, 20 bp, Artificial Sequence
  Artificially Synthesized Primer Sequence
atcgccactgatgtctaccc

SEQ ID NO: 7690 - DNA, 20 bp, Artificial Sequence
  Artificially Synthesized Primer Sequence
aagccgttgtaccaatccag

SEQ ID NO: 7691 - DNA, 20 bp, Artificial Sequence
  Artificially Synthesized Primer Sequence
aagccgttgtaccaatccag

SEQ ID NO: 7692 - DNA, 20 bp, Artificial Sequence
  Artificially Synthesized Primer Sequence
atcgccactgatgtctaccc

SEQ ID NO: 7693 - DNA, 20 bp, Artificial Sequence
  Artificially Synthesized Primer Sequence
cccaatgaggtcaacgagat

SEQ ID NO: 7694 - DNA, 20 bp, Artificial Sequence
  Artificially Synthesized Primer Sequence
ccttctcagccttggacttg

SEQ ID NO: 7695 - DNA, 20 bp, Artificial Sequence
  Artificially Synthesized Primer Sequence
catccagcagaacaaacacg

SEQ ID NO: 7696 - DNA, 20 bp, Artificial Sequence
  Artificially Synthesized Primer Sequence
caagtccaaggctgagaagg

SEQ ID NO: 7697 - DNA, 20 bp, Artificial Sequence
  Artificially Synthesized Primer Sequence
agcagtgatgtccgtcctct

SEQ ID NO: 7698 - DNA, 20 bp, Artificial Sequence
  Artificially Synthesized Primer Sequence
cgttcaaggaccaaccagat

SEQ ID NO: 7699 - DNA, 20 bp, Artificial Sequence
  Artificially Synthesized Primer Sequence
cgttcaaggaccaaccagat

SEQ ID NO: 7700 - DNA, 20 bp, Artificial Sequence
  Artificially Synthesized Primer Sequence
tattaccgctgcacatcgtc

SEQ ID NO: 7701 - DNA, 20 bp, Artificial Sequence
  Artificially Synthesized Primer Sequence
tggtaccagttgcgatgtgt

SEQ ID NO: 7702 - DNA, 20 bp, Artificial Sequence
  Artificially Synthesized Primer Sequence
tgcagagtccctctcctgtt

SEQ ID NO: 7703 - DNA, 20 bp, Artificial Sequence
  Artificially Synthesized Primer Sequence
cgcaactagacgcgatgtta

SEQ ID NO: 7704 - DNA, 20 bp, Artificial Sequence
  Artificially Synthesized Primer Sequence
agtgcgcaaagctacacaaa

SEQ ID NO: 7705 - DNA, 20 bp, Artificial Sequence
  Artificially Synthesized Primer Sequence
tgatgaggcgactgtctttg

SEQ ID NO: 7706 - DNA, 20 bp, Artificial Sequence
  Artificially Synthesized Primer Sequence
acccaaccgtttcctaatcc

SEQ ID NO: 7707 - DNA, 20 bp, Artificial Sequence
  Artificially Synthesized Primer Sequence
gaaagctcggcgacactaac

SEQ ID NO: 7708 - DNA, 20 bp, Artificial Sequence
  Artificially Synthesized Primer Sequence
tgcagtccatctacgagcag

SEQ ID NO: 7709 - DNA, 20 bp, Artificial Sequence
  Artificially Synthesized Primer Sequence
aaaggtggtgcttccatgac

SEQ ID NO: 7710 - DNA, 20 bp, Artificial Sequence
  Artificially Synthesized Primer Sequence
acaatgttccgttaaagccg

SEQ ID NO: 7711 - DNA, 20 bp, Artificial Sequence
  Artificially Synthesized Primer Sequence
attttcagctccacgcagtt

SEQ ID NO: 7712 - DNA, 20 bp, Artificial Sequence
  Artificially Synthesized Primer Sequence
tgaggacctgtttattgccc

SEQ ID NO: 7713 - DNA, 20 bp, Artificial Sequence
  Artificially Synthesized Primer Sequence
gggacttgcttctgaagtgc

SEQ ID NO: 7714 - DNA, 20 bp, Artificial Sequence
  Artificially Synthesized Primer Sequence
tttgcctattttctgggtgg

SEQ ID NO: 7715 - DNA, 20 bp, Artificial Sequence
  Artificially Synthesized Primer Sequence
tagtatgtggcaagcaagcg

SEQ ID NO: 7716 - DNA, 20 bp, Artificial Sequence
  Artificially Synthesized Primer Sequence
gggacttgcttctgaagtgc

SEQ ID NO: 7717 - DNA, 20 bp, Artificial Sequence
  Artificially Synthesized Primer Sequence
gatgccaaaacctgagccta

SEQ ID NO: 7718 - DNA, 20 bp, Artificial Sequence
  Artificially Synthesized Primer Sequence
cttcccatcaattgtcggtc

SEQ ID NO: 7719 - DNA, 20 bp, Artificial Sequence
  Artificially Synthesized Primer Sequence
tgtgcacagatgaacgcata

SEQ ID NO: 7720 - DNA, 20 bp, Artificial Sequence
  Artificially Synthesized Primer Sequence
cttacccaatgccaaaacca

SEQ ID NO: 7721 - DNA, 20 bp, Artificial Sequence
  Artificially Synthesized Primer Sequence
tgtggagaactgtttgcagg

SEQ ID NO: 7722 - DNA, 20 bp, Artificial Sequence
  Artificially Synthesized Primer Sequence
gatcaagtgcacagaaggca

SEQ ID NO: 7723 - DNA, 20 bp, Artificial Sequence
  Artificially Synthesized Primer Sequence
aaattccccaactgaaaccc

SEQ ID NO: 7724 - DNA, 20 bp, Artificial Sequence
  Artificially Synthesized Primer Sequence
tccaaactgacgtaccacca

SEQ ID NO: 7725 - DNA, 20 bp, Artificial Sequence
  Artificially Synthesized Primer Sequence
gctggttccacaaaaggaaa

SEQ ID NO: 7726 - DNA, 20 bp, Artificial Sequence
  Artificially Synthesized Primer Sequence
tcttctcgctagcatcagca

SEQ ID NO: 7727 - DNA, 20 bp, Artificial Sequence
  Artificially Synthesized Primer Sequence
tagggttcgtcgctgctagt

SEQ ID NO: 7728 - DNA, 20 bp, Artificial Sequence
  Artificially Synthesized Primer Sequence
accaaagaaggaggtggctt

SEQ ID NO: 7729 - DNA, 20 bp, Artificial Sequence
  Artificially Synthesized Primer Sequence
aattcctcgagcactgttgg

SEQ ID NO: 7730 - DNA, 20 bp, Artificial Sequence
  Artificially Synthesized Primer Sequence
cagagggtcaacgggttaaa

SEQ ID NO: 7731 - DNA, 20 bp, Artificial Sequence
  Artificially Synthesized Primer Sequence
caacggacgaagatagggaa

SEQ ID NO: 7732 - DNA, 20 bp, Artificial Sequence
  Artificially Synthesized Primer Sequence
gacagagagattcgatcgcc

SEQ ID NO: 7733 - DNA, 20 bp, Artificial Sequence
  Artificially Synthesized Primer Sequence
tgcaggccttaaagacgagt

SEQ ID NO: 7734 - DNA, 20 bp, Artificial Sequence
  Artificially Synthesized Primer Sequence
gatagccatgcccaggtaaa

SEQ ID NO: 7735 - DNA, 20 bp, Artificial Sequence
  Artificially Synthesized Primer Sequence
taagcatgcccaacccttat

SEQ ID NO: 7736 - DNA, 20 bp, Artificial Sequence
  Artificially Synthesized Primer Sequence
aaggatcggtctgcttgttg

SEQ ID NO: 7737 - DNA, 20 bp, Artificial Sequence
  Artificially Synthesized Primer Sequence
cgtgtcggaagggtagtgat

SEQ ID NO: 7738 - DNA, 20 bp, Artificial Sequence
  Artificially Synthesized Primer Sequence
gcagatgtacagccacgaga

SEQ ID NO: 7739 - DNA, 20 bp, Artificial Sequence
  Artificially Synthesized Primer Sequence
ctggttgctccacaagaaca

SEQ ID NO: 7740 - DNA, 20 bp, Artificial Sequence
  Artificially Synthesized Primer Sequence
accaatactcggacaggcac

SEQ ID NO: 7741 - DNA, 20 bp, Artificial Sequence
  Artificially Synthesized Primer Sequence
attggctggtcaaaaggatg

SEQ ID NO: 7742 - DNA, 20 bp, Artificial Sequence
  Artificially Synthesized Primer Sequence
caaggccagcttctacttgg

SEQ ID NO: 7743 - DNA, 20 bp, Artificial Sequence
  Artificially Synthesized Primer Sequence
cacttgttgtttcgggaggt

SEQ ID NO: 7744 - DNA, 20 bp, Artificial Sequence
  Artificially Synthesized Primer Sequence
taaagtccagactggggtgg

SEQ ID NO: 7745 - DNA, 20 bp, Artificial Sequence
  Artificially Synthesized Primer Sequence
tgtctcccgtcacataacca

SEQ ID NO: 7746 - DNA, 20 bp, Artificial Sequence
  Artificially Synthesized Primer Sequence
gctctgcaaactgaatggct

SEQ ID NO: 7747 - DNA, 20 bp, Artificial Sequence
  Artificially Synthesized Primer Sequence
ttgctcaaagtgtgctgacc

SEQ ID NO: 7748 - DNA, 20 bp, Artificial Sequence
  Artificially Synthesized Primer Sequence
caagaaatcatcagggcgat

SEQ ID NO: 7749 - DNA, 20 bp, Artificial Sequence
  Artificially Synthesized Primer Sequence
ctatgggccaggatctttca

SEQ ID NO: 7750 - DNA, 20 bp, Artificial Sequence
  Artificially Synthesized Primer Sequence
gaggccatacttcggtgtgt

SEQ ID NO: 7751 - DNA, 20 bp, Artificial Sequence
  Artificially Synthesized Primer Sequence
catcgcggttcttctttttc

SEQ ID NO: 7752 - DNA, 20 bp, Artificial Sequence
  Artificially Synthesized Primer Sequence
atgagcagctccatttttgg

SEQ ID NO: 7753 - DNA, 20 bp, Artificial Sequence
  Artificially Synthesized Primer Sequence
gtggacacgaggtccagatt

SEQ ID NO: 7754 - DNA, 20 bp, Artificial Sequence
  Artificially Synthesized Primer Sequence
tcatcaacatgtacgccgat

SEQ ID NO: 7755 - DNA, 20 bp, Artificial Sequence
  Artificially Synthesized Primer Sequence
caaagttttcagtgccccat

SEQ ID NO: 7756 - DNA, 20 bp, Artificial Sequence
  Artificially Synthesized Primer Sequence
atcgaggtacaactgggtgg

SEQ ID NO: 7757 - DNA, 20 bp, Artificial Sequence
  Artificially Synthesized Primer Sequence
caagaccaagcaaatgctca

SEQ ID NO: 7758 - DNA, 20 bp, Artificial Sequence
  Artificially Synthesized Primer Sequence
gctcttcttcagggtcatcg

SEQ ID NO: 7759 - DNA, 20 bp, Artificial Sequence
  Artificially Synthesized Primer Sequence
aaggatagaaccaaacgggg

SEQ ID NO: 7760 - DNA, 20 bp, Artificial Sequence
  Artificially Synthesized Primer Sequence
gacgaggagaagagggaggt

SEQ ID NO: 7761 - DNA, 20 bp, Artificial Sequence
  Artificially Synthesized Primer Sequence
cgagacaagcagtggaaaca

SEQ ID NO: 7762 - DNA, 20 bp, Artificial Sequence
  Artificially Synthesized Primer Sequence
tagcatgaatggctgctttg

SEQ ID NO: 7763 - DNA, 20 bp, Artificial Sequence
  Artificially Synthesized Primer Sequence
cctcgctgacccttcaagta

SEQ ID NO: 7764 - DNA, 20 bp, Artificial Sequence
  Artificially Synthesized Primer Sequence
cacaaacgacgtctgcagtt

SEQ ID NO: 7765 - DNA, 20 bp, Artificial Sequence
  Artificially Synthesized Primer Sequence
tggtgaaggctgtagctgtg

SEQ ID NO: 7766 - DNA, 20 bp, Artificial Sequence
  Artificially Synthesized Primer Sequence
acccttgccaagatcatcag

SEQ ID NO: 7767 - DNA, 20 bp, Artificial Sequence
  Artificially Synthesized Primer Sequence
acatgcccagagctggtaac

SEQ ID NO: 7768 - DNA, 20 bp, Artificial Sequence
  Artificially Synthesized Primer Sequence
ctgatgatcttggcaagggt

SEQ ID NO: 7769 - DNA, 20 bp, Artificial Sequence
  Artificially Synthesized Primer Sequence
tggtgaaggctgtagctgtg

SEQ ID NO: 7770 - DNA, 20 bp, Artificial Sequence
  Artificially Synthesized Primer Sequence
acccttgccaagatcatcag

SEQ ID NO: 7771 - DNA, 20 bp, Artificial Sequence
  Artificially Synthesized Primer Sequence
gcagcacataggaatcgaca

SEQ ID NO: 7772 - DNA, 20 bp, Artificial Sequence
  Artificially Synthesized Primer Sequence
tgacctcggaaatgtgacag

SEQ ID NO: 7773 - DNA, 20 bp, Artificial Sequence
  Artificially Synthesized Primer Sequence
cgaggaggacaagaaagcag

SEQ ID NO: 7774 - DNA, 20 bp, Artificial Sequence
  Artificially Synthesized Primer Sequence
tcttgatgccataacccaca

SEQ ID NO: 7775 - DNA, 20 bp, Artificial Sequence
  Artificially Synthesized Primer Sequence
agaatccagcagcaacaggt

SEQ ID NO: 7776 - DNA, 20 bp, Artificial Sequence
  Artificially Synthesized Primer Sequence
cgaggaggacaagaaagcag

SEQ ID NO: 7777 - DNA, 20 bp, Artificial Sequence
  Artificially Synthesized Primer Sequence
ccttgctctggagaaggttg

SEQ ID NO: 7778 - DNA, 20 bp, Artificial Sequence
  Artificially Synthesized Primer Sequence
gcagaagtactgcccaaagc

SEQ ID NO: 7779 - DNA, 20 bp, Artificial Sequence
  Artificially Synthesized Primer Sequence
gatgtcaccaaaacggctct

SEQ ID NO: 7780 - DNA, 20 bp, Artificial Sequence
  Artificially Synthesized Primer Sequence
agcatcagggatagccacag

SEQ ID NO: 7781 - DNA, 20 bp, Artificial Sequence
  Artificially Synthesized Primer Sequence
taggcgaaaagtatggggtg

SEQ ID NO: 7782 - DNA, 20 bp, Artificial Sequence
  Artificially Synthesized Primer Sequence
gcctcttcaggcttcacatc

SEQ ID NO: 7783 - DNA, 20 bp, Artificial Sequence
  Artificially Synthesized Primer Sequence
actgccatcagttctcgctt

SEQ ID NO: 7784 - DNA, 20 bp, Artificial Sequence
  Artificially Synthesized Primer Sequence
aagaggctgtgcatattggg

SEQ ID NO: 7785 - DNA, 20 bp, Artificial Sequence
  Artificially Synthesized Primer Sequence
agcttctccgacaccagaaa

SEQ ID NO: 7786 - DNA, 20 bp, Artificial Sequence
  Artificially Synthesized Primer Sequence
cttcatccatagcgctgtca

SEQ ID NO: 7787 - DNA, 20 bp, Artificial Sequence
  Artificially Synthesized Primer Sequence
aggacatacgagcacggttt

SEQ ID NO: 7788 - DNA, 20 bp, Artificial Sequence
  Artificially Synthesized Primer Sequence
cgaagaactgccttctaccg

SEQ ID NO: 7789 - DNA, 20 bp, Artificial Sequence
  Artificially Synthesized Primer Sequence
gattcttggcctcagcagtc

SEQ ID NO: 7790 - DNA, 20 bp, Artificial Sequence
  Artificially Synthesized Primer Sequence
cagcagcaaaattcgtttca

SEQ ID NO: 7791 - DNA, 20 bp, Artificial Sequence
  Artificially Synthesized Primer Sequence
tattacaagcaaggcacccc

SEQ ID NO: 7792 - DNA, 20 bp, Artificial Sequence
  Artificially Synthesized Primer Sequence
tactgccataccccttgctc

SEQ ID NO: 7793 - DNA, 20 bp, Artificial Sequence
  Artificially Synthesized Primer Sequence
agtcataaacccaagtgcgg

SEQ ID NO: 7794 - DNA, 20 bp, Artificial Sequence
  Artificially Synthesized Primer Sequence
gggggatatggcagtcagta

SEQ ID NO: 7795 - DNA, 20 bp, Artificial Sequence
  Artificially Synthesized Primer Sequence
attgcaagtcggtgtccttc

SEQ ID NO: 7796 - DNA, 20 bp, Artificial Sequence
  Artificially Synthesized Primer Sequence
aagtgtcacgggactcaagg

SEQ ID NO: 7797 - DNA, 20 bp, Artificial Sequence
  Artificially Synthesized Primer Sequence
cttcgctcttcacacacagc

SEQ ID NO: 7798 - DNA, 20 bp, Artificial Sequence
  Artificially Synthesized Primer Sequence
ttgtcgagcatgatgtccag

SEQ ID NO: 7799 - DNA, 20 bp, Artificial Sequence
  Artificially Synthesized Primer Sequence
ccgatgcattaacaatgacg

SEQ ID NO: 7800 - DNA, 20 bp, Artificial Sequence
  Artificially Synthesized Primer Sequence
acgaggccaagtacgtcaac

SEQ ID NO: 7801 - DNA, 20 bp, Artificial Sequence
  Artificially Synthesized Primer Sequence
gtggagaatttccctgggtt

SEQ ID NO: 7802 - DNA, 20 bp, Artificial Sequence
  Artificially Synthesized Primer Sequence
taaatgaacatggcacgcat

SEQ ID NO: 7803 - DNA, 20 bp, Artificial Sequence
  Artificially Synthesized Primer Sequence
aggatagacatgaaacgccg

SEQ ID NO: 7804 - DNA, 20 bp, Artificial Sequence
  Artificially Synthesized Primer Sequence
catcatgggaacaccttgtg

SEQ ID NO: 7805 - DNA, 20 bp, Artificial Sequence
  Artificially Synthesized Primer Sequence
gcacaactctttggtcccat

SEQ ID NO: 7806 - DNA, 20 bp, Artificial Sequence
  Artificially Synthesized Primer Sequence
caccatccaggacttcgttt

SEQ ID NO: 7807 - DNA, 20 bp, Artificial Sequence
  Artificially Synthesized Primer Sequence
caagccttgtaccggtcagt

SEQ ID NO: 7808 - DNA, 20 bp, Artificial Sequence
  Artificially Synthesized Primer Sequence
aaacgaagtcctggatggtg

SEQ ID NO: 7809 - DNA, 20 bp, Artificial Sequence
  Artificially Synthesized Primer Sequence
gtaccggaacaagcaccatt

SEQ ID NO: 7810 - DNA, 20 bp, Artificial Sequence
  Artificially Synthesized Primer Sequence
cgaaaaatacgagacgggaa

SEQ ID NO: 7811 - DNA, 20 bp, Artificial Sequence
  Artificially Synthesized Primer Sequence
aacaccatcatcaatccacg

SEQ ID NO: 7812 - DNA, 20 bp, Artificial Sequence
  Artificially Synthesized Primer Sequence
gctcttgcacggagtctctt

SEQ ID NO: 7813 - DNA, 20 bp, Artificial Sequence
  Artificially Synthesized Primer Sequence
aaggtgtccatacagggcag

SEQ ID NO: 7814 - DNA, 20 bp, Artificial Sequence
  Artificially Synthesized Primer Sequence
ctcgaacatcttcaccagca

SEQ ID NO: 7815 - DNA, 20 bp, Artificial Sequence
  Artificially Synthesized Primer Sequence
catcgatcccttctgctctc

SEQ ID NO: 7816 - DNA, 20 bp, Artificial Sequence
  Artificially Synthesized Primer Sequence
gtcatgctgatcttcgggat

SEQ ID NO: 7817 - DNA, 20 bp, Artificial Sequence
  Artificially Synthesized Primer Sequence
gggatatgagcgaagatgga

SEQ ID NO: 7818 - DNA, 20 bp, Artificial Sequence
  Artificially Synthesized Primer Sequence
tccttaacaagtcccatcgc

SEQ ID NO: 7819 - DNA, 20 bp, Artificial Sequence
  Artificially Synthesized Primer Sequence
actcctcccatgtcgcttta

SEQ ID NO: 7820 - DNA, 20 bp, Artificial Sequence
  Artificially Synthesized Primer Sequence
agtttcgaagcatcacccag

SEQ ID NO: 7821 - DNA, 20 bp, Artificial Sequence
  Artificially Synthesized Primer Sequence
atgggaagcagtatggcaac

SEQ ID NO: 7822 - DNA, 20 bp, Artificial Sequence
  Artificially Synthesized Primer Sequence
ttctcagctggtggtgtcag

SEQ ID NO: 7823 - DNA, 20 bp, Artificial Sequence
  Artificially Synthesized Primer Sequence
caagtgctggaactggttga

SEQ ID NO: 7824 - DNA, 20 bp, Artificial Sequence
  Artificially Synthesized Primer Sequence
ggtggtatgaggggatgatg

SEQ ID NO: 7825 - DNA, 20 bp, Artificial Sequence
  Artificially Synthesized Primer Sequence
cagtgacgtcttgacacgct

SEQ ID NO: 7826 - DNA, 20 bp, Artificial Sequence
  Artificially Synthesized Primer Sequence
tggcctgctcctctaacagt

SEQ ID NO: 7827 - DNA, 20 bp, Artificial Sequence
  Artificially Synthesized Primer Sequence
tgttcgcattctttgcagtc

SEQ ID NO: 7828 - DNA, 20 bp, Artificial Sequence
  Artificially Synthesized Primer Sequence
cagtgacgtcttgacacgct

SEQ ID NO: 7829 - DNA, 20 bp, Artificial Sequence
  Artificially Synthesized Primer Sequence
atttggggcgactacttcct

SEQ ID NO: 7830 - DNA, 20 bp, Artificial Sequence
  Artificially Synthesized Primer Sequence
cttctaagcaagccaaaccg

SEQ ID NO: 7831 - DNA, 20 bp, Artificial Sequence
  Artificially Synthesized Primer Sequence
gggacaaagatgatgcacaa

SEQ ID NO: 7832 - DNA, 20 bp, Artificial Sequence
  Artificially Synthesized Primer Sequence
agttgctatagcttgcggga

SEQ ID NO: 7833 - DNA, 20 bp, Artificial Sequence
  Artificially Synthesized Primer Sequence
tatcctgtcccagctgaacc

SEQ ID NO: 7834 - DNA, 20 bp, Artificial Sequence
  Artificially Synthesized Primer Sequence
cgatctagtcgtcgtcctcc

SEQ ID NO: 7835 - DNA, 20 bp, Artificial Sequence
  Artificially Synthesized Primer Sequence
agaaggaacttgcagcgtgt

SEQ ID NO: 7836 - DNA, 20 bp, Artificial Sequence
  Artificially Synthesized Primer Sequence
gcaaatgccacccatagagt

SEQ ID NO: 7837 - DNA, 20 bp, Artificial Sequence
  Artificially Synthesized Primer Sequence
gtgaatcattgctgtgggtg

SEQ ID NO: 7838 - DNA, 20 bp, Artificial Sequence
  Artificially Synthesized Primer Sequence
cgagaaaagataaaccgcca

SEQ ID NO: 7839 - DNA, 20 bp, Artificial Sequence
  Artificially Synthesized Primer Sequence
gctatcattgcacagttcgg

SEQ ID NO: 7840 - DNA, 20 bp, Artificial Sequence
  Artificially Synthesized Primer Sequence
gtgggagatctgatagggca

SEQ ID NO: 7841 - DNA, 20 bp, Artificial Sequence
  Artificially Synthesized Primer Sequence
ggaggttagcgaggctttct

SEQ ID NO: 7842 - DNA, 20 bp, Artificial Sequence
  Artificially Synthesized Primer Sequence
aggtgaaaccaaccgtcttg

SEQ ID NO: 7843 - DNA, 20 bp, Artificial Sequence
  Artificially Synthesized Primer Sequence
aacgcctatgctggttatgc

SEQ ID NO: 7844 - DNA, 20 bp, Artificial Sequence
  Artificially Synthesized Primer Sequence
ggccagttgtgaccttgatt

SEQ ID NO: 7845 - DNA, 20 bp, Artificial Sequence
  Artificially Synthesized Primer Sequence
agagaacagcaacgggaaga

SEQ ID NO: 7846 - DNA, 20 bp, Artificial Sequence
  Artificially Synthesized Primer Sequence
ggaccaggcaatgaagaaaa

SEQ ID NO: 7847 - DNA, 20 bp, Artificial Sequence
  Artificially Synthesized Primer Sequence
agacaaagttcatcagggcg

SEQ ID NO: 7848 - DNA, 20 bp, Artificial Sequence
  Artificially Synthesized Primer Sequence
ctcgccgtaggtcttgatgt

SEQ ID NO: 7849 - DNA, 20 bp, Artificial Sequence
  Artificially Synthesized Primer Sequence
acggctgacagaccaagact

SEQ ID NO: 7850 - DNA, 20 bp, Artificial Sequence
  Artificially Synthesized Primer Sequence
gcgaaggcaatgctttttag

SEQ ID NO: 7851 - DNA, 20 bp, Artificial Sequence
  Artificially Synthesized Primer Sequence
tcgacatctctcccatttcc

SEQ ID NO: 7852 - DNA, 20 bp, Artificial Sequence
  Artificially Synthesized Primer Sequence
aaccagatatggatgccagg

SEQ ID NO: 7853 - DNA, 20 bp, Artificial Sequence
  Artificially Synthesized Primer Sequence
agggtcctgttcttggtgtg

SEQ ID NO: 7854 - DNA, 20 bp, Artificial Sequence
  Artificially Synthesized Primer Sequence
ctatgcagggcaacattcct

SEQ ID NO: 7855 - DNA, 20 bp, Artificial Sequence
  Artificially Synthesized Primer Sequence
gtgagacattgtgacacggg

SEQ ID NO: 7856 - DNA, 20 bp, Artificial Sequence
  Artificially Synthesized Primer Sequence
aggaatgttgccctgcatag

SEQ ID NO: 7857 - DNA, 20 bp, Artificial Sequence
  Artificially Synthesized Primer Sequence
acgctgataagatggctgct

SEQ ID NO: 7858 - DNA, 20 bp, Artificial Sequence
  Artificially Synthesized Primer Sequence
gcgacctccatgaatcctaa

SEQ ID NO: 7859 - DNA, 20 bp, Artificial Sequence
  Artificially Synthesized Primer Sequence
gcgacctccatgaatcctaa

SEQ ID NO: 7860 - DNA, 20 bp, Artificial Sequence
  Artificially Synthesized Primer Sequence
ttggagaggtaaatggcgag

SEQ ID NO: 7861 - DNA, 20 bp, Artificial Sequence
  Artificially Synthesized Primer Sequence
cccaaactgttctcgaccat

SEQ ID NO: 7862 - DNA, 20 bp, Artificial Sequence
  Artificially Synthesized Primer Sequence
gtcttctccaaacctctgcg

SEQ ID NO: 7863 - DNA, 20 bp, Artificial Sequence
  Artificially Synthesized Primer Sequence
gcttgtttgccctcatgtct

SEQ ID NO: 7864 - DNA, 20 bp, Artificial Sequence
  Artificially Synthesized Primer Sequence
caaaatgtgacatcggcaag

SEQ ID NO: 7865 - DNA, 20 bp, Artificial Sequence
  Artificially Synthesized Primer Sequence
gtatgggtgccactttgctt

SEQ ID NO: 7866 - DNA, 20 bp, Artificial Sequence
  Artificially Synthesized Primer Sequence
gatctcacggactatcccga

SEQ ID NO: 7867 - DNA, 20 bp, Artificial Sequence
  Artificially Synthesized Primer Sequence
tcgccatgtaacaaaaacca

SEQ ID NO: 7868 - DNA, 20 bp, Artificial Sequence
  Artificially Synthesized Primer Sequence
ggttgttgaaaagcacagca

SEQ ID NO: 7869 - DNA, 20 bp, Artificial Sequence
  Artificially Synthesized Primer Sequence
ctacgatggtttgcatgtgg

SEQ ID NO: 7870 - DNA, 20 bp, Artificial Sequence
  Artificially Synthesized Primer Sequence
aattgcacgtgttgattcca

SEQ ID NO: 7871 - DNA, 20 bp, Artificial Sequence
  Artificially Synthesized Primer Sequence
acaaaaagaatggagggcac

SEQ ID NO: 7872 - DNA, 20 bp, Artificial Sequence
  Artificially Synthesized Primer Sequence
agtggcacaatgagacgaca

SEQ ID NO: 7873 - DNA, 20 bp, Artificial Sequence
  Artificially Synthesized Primer Sequence
gttagcgagacgaaggatgc

SEQ ID NO: 7874 - DNA, 20 bp, Artificial Sequence
  Artificially Synthesized Primer Sequence
gccagcctcttatacaccca

SEQ ID NO: 7875 - DNA, 20 bp, Artificial Sequence
  Artificially Synthesized Primer Sequence
gagtgaccctcttctcgtcg

SEQ ID NO: 7876 - DNA, 20 bp, Artificial Sequence
  Artificially Synthesized Primer Sequence
gttagcgagacgaaggatgc

SEQ ID NO: 7877 - DNA, 20 bp, Artificial Sequence
  Artificially Synthesized Primer Sequence
aattgctggagcttgctcat

SEQ ID NO: 7878 - DNA, 20 bp, Artificial Sequence
  Artificially Synthesized Primer Sequence
ctagatggccaaaacggaaa

SEQ ID NO: 7879 - DNA, 20 bp, Artificial Sequence
  Artificially Synthesized Primer Sequence
aaacgatcacccttcagcac

SEQ ID NO: 7880 - DNA, 20 bp, Artificial Sequence
  Artificially Synthesized Primer Sequence
ggacaactacgggagtggaa

SEQ ID NO: 7881 - DNA, 20 bp, Artificial Sequence
  Artificially Synthesized Primer Sequence
agattgttccatcggaggtg

SEQ ID NO: 7882 - DNA, 20 bp, Artificial Sequence
  Artificially Synthesized Primer Sequence
ggcaaaaatggctttgacat

SEQ ID NO: 7883 - DNA, 20 bp, Artificial Sequence
  Artificially Synthesized Primer Sequence
atgggcacaaggtctgattc

SEQ ID NO: 7884 - DNA, 20 bp, Artificial Sequence
  Artificially Synthesized Primer Sequence
tccagtttgcctgtgattga

SEQ ID NO: 7885 - DNA, 20 bp, Artificial Sequence
  Artificially Synthesized Primer Sequence
tccaagcagctggaagaact

SEQ ID NO: 7886 - DNA, 20 bp, Artificial Sequence
  Artificially Synthesized Primer Sequence
gcttggtctgtttggtccat

SEQ ID NO: 7887 - DNA, 20 bp, Artificial Sequence
  Artificially Synthesized Primer Sequence
tggtcccactaacgcatgta

SEQ ID NO: 7888 - DNA, 20 bp, Artificial Sequence
  Artificially Synthesized Primer Sequence
agtttgtggtgtgattgcca

SEQ ID NO: 7889 - DNA, 20 bp, Artificial Sequence
  Artificially Synthesized Primer Sequence
ccgagaagggtaaatgggat

SEQ ID NO: 7890 - DNA, 20 bp, Artificial Sequence
  Artificially Synthesized Primer Sequence
tgagatgcttccgtcagatg

SEQ ID NO: 7891 - DNA, 19 bp, Artificial Sequence
  Artificially Synthesized Primer Sequence
cggcatttcacacacacac

SEQ ID NO: 7892 - DNA, 20 bp, Artificial Sequence
  Artificially Synthesized Primer Sequence
agtcactccgaaagacaggc

SEQ ID NO: 7893 - DNA, 20 bp, Artificial Sequence
  Artificially Synthesized Primer Sequence
agcgaagattgaacttggga

SEQ ID NO: 7894 - DNA, 20 bp, Artificial Sequence
  Artificially Synthesized Primer Sequence
acaaaaatatgcggacgagg

SEQ ID NO: 7895 - DNA, 20 bp, Artificial Sequence
  Artificially Synthesized Primer Sequence
tggcaaagagtgcagagaga

SEQ ID NO: 7896 - DNA, 20 bp, Artificial Sequence
  Artificially Synthesized Primer Sequence
gcaataaaagcggacgacat

SEQ ID NO: 7897 - DNA, 20 bp, Artificial Sequence
  Artificially Synthesized Primer Sequence
ggacgaagccatgttcctaa

SEQ ID NO: 7898 - DNA, 20 bp, Artificial Sequence
  Artificially Synthesized Primer Sequence
gccacgcctcttgtaatcat

SEQ ID NO: 7899 - DNA, 20 bp, Artificial Sequence
  Artificially Synthesized Primer Sequence
tgcaaattctttcccgagtt

SEQ ID NO: 7900 - DNA, 20 bp, Artificial Sequence
  Artificially Synthesized Primer Sequence
cagcatgtttggcagttgat

SEQ ID NO: 7901 - DNA, 20 bp, Artificial Sequence
  Artificially Synthesized Primer Sequence
ccgttggtctctgaggttgt

SEQ ID NO: 7902 - DNA, 20 bp, Artificial Sequence
  Artificially Synthesized Primer Sequence
ttaaacgcagggttgaaagg

SEQ ID NO: 7903 - DNA, 20 bp, Artificial Sequence
  Artificially Synthesized Primer Sequence
ttctgatgaaaccagttgcg

SEQ ID NO: 7904 - DNA, 18 bp, Artificial Sequence
  Artificially Synthesized Primer Sequence
aagccgttggggaggtta

SEQ ID NO: 7905 - DNA, 20 bp, Artificial Sequence
  Artificially Synthesized Primer Sequence
ccctttccttgttcgttgaa

SEQ ID NO: 7906 - DNA, 20 bp, Artificial Sequence
  Artificially Synthesized Primer Sequence
actccaggaccctcaggttt

SEQ ID NO: 7907 - DNA, 20 bp, Artificial Sequence
  Artificially Synthesized Primer Sequence
ctcatcaaccgcgagaaaat

SEQ ID NO: 7908 - DNA, 20 bp, Artificial Sequence
  Artificially Synthesized Primer Sequence
cagctttgattcagccaaca

SEQ ID NO: 7909 - DNA, 20 bp, Artificial Sequence
  Artificially Synthesized Primer Sequence
gccatcttgctcagtgttca

SEQ ID NO: 7910 - DNA, 20 bp, Artificial Sequence
  Artificially Synthesized Primer Sequence
acgagcaaggcaagctacat

SEQ ID NO: 7911 - DNA, 20 bp, Artificial Sequence
  Artificially Synthesized Primer Sequence
ttcgtcaaactccttggctt

SEQ ID NO: 7912 - DNA, 20 bp, Artificial Sequence
  Artificially Synthesized Primer Sequence
ggtcaaggtggcagaagatt

SEQ ID NO: 7913 - DNA, 20 bp, Artificial Sequence
  Artificially Synthesized Primer Sequence
accacacctgaatctcgacc

SEQ ID NO: 7914 - DNA, 20 bp, Artificial Sequence
  Artificially Synthesized Primer Sequence
tacatgaaccctcccaggac

SEQ ID NO: 7915 - DNA, 20 bp, Artificial Sequence
  Artificially Synthesized Primer Sequence
gtttacgacggccagtgaat

SEQ ID NO: 7916 - DNA, 20 bp, Artificial Sequence
  Artificially Synthesized Primer Sequence
ggtaggaggggtcatcgttt

SEQ ID NO: 7917 - DNA, 20 bp, Artificial Sequence
  Artificially Synthesized Primer Sequence
atcgtcgtagcaggagtcgt

SEQ ID NO: 7918 - DNA, 20 bp, Artificial Sequence
  Artificially Synthesized Primer Sequence
acgagcagctctgttccatt

SEQ ID NO: 7919 - DNA, 20 bp, Artificial Sequence
  Artificially Synthesized Primer Sequence
aagtgcccaacactggaaag

SEQ ID NO: 7920 - DNA, 20 bp, Artificial Sequence
  Artificially Synthesized Primer Sequence
agcactagtcgctctcctcg

SEQ ID NO: 7921 - DNA, 20 bp, Artificial Sequence
  Artificially Synthesized Primer Sequence
gctttcattatcgccgagag

SEQ ID NO: 7922 - DNA, 20 bp, Artificial Sequence
  Artificially Synthesized Primer Sequence
tgtgggatcaccccctataa

SEQ ID NO: 7923 - DNA, 20 bp, Artificial Sequence
  Artificially Synthesized Primer Sequence
gcaacaccacgagtacgcta

SEQ ID NO: 7924 - DNA, 20 bp, Artificial Sequence
  Artificially Synthesized Primer Sequence
cattatgaacgaggtgcgtg

SEQ ID NO: 7925 - DNA, 20 bp, Artificial Sequence
  Artificially Synthesized Primer Sequence
tgatcccgttgatgctcata

SEQ ID NO: 7926 - DNA, 20 bp, Artificial Sequence
  Artificially Synthesized Primer Sequence
cggaactatggaggcgaata

SEQ ID NO: 7927 - DNA, 20 bp, Artificial Sequence
  Artificially Synthesized Primer Sequence
tggccaactcaatatcacca

SEQ ID NO: 7928 - DNA, 20 bp, Artificial Sequence
  Artificially Synthesized Primer Sequence
ctccttcagatgcaacacca

SEQ ID NO: 7929 - DNA, 20 bp, Artificial Sequence
  Artificially Synthesized Primer Sequence
attcaagaaggctggagggt

SEQ ID NO: 7930 - DNA, 20 bp, Artificial Sequence
  Artificially Synthesized Primer Sequence
taaaaggcgatttggtacgg

SEQ ID NO: 7931 - DNA, 20 bp, Artificial Sequence
  Artificially Synthesized Primer Sequence
tgtacaaccaaagacgcctg

SEQ ID NO: 7932 - DNA, 20 bp, Artificial Sequence
  Artificially Synthesized Primer Sequence
accgaaaggacacaaaggtg

SEQ ID NO: 7933 - DNA, 20 bp, Artificial Sequence
  Artificially Synthesized Primer Sequence
ctcccttcaacttcttcccc

SEQ ID NO: 7934 - DNA, 20 bp, Artificial Sequence
  Artificially Synthesized Primer Sequence
catcatccccaatcttgctt

SEQ ID NO: 7935 - DNA, 20 bp, Artificial Sequence
  Artificially Synthesized Primer Sequence
tgaacccacccaataaaagc

SEQ ID NO: 7936 - DNA, 20 bp, Artificial Sequence
  Artificially Synthesized Primer Sequence
gttgtcaaggcattcagcag

SEQ ID NO: 7937 - DNA, 20 bp, Artificial Sequence
  Artificially Synthesized Primer Sequence
agacgtttgagtgcttgcct

SEQ ID NO: 7938 - DNA, 20 bp, Artificial Sequence
  Artificially Synthesized Primer Sequence
agaaatttttccagcggctt

SEQ ID NO: 7939 - DNA, 19 bp, Artificial Sequence
  Artificially Synthesized Primer Sequence
acatcgacatgggtcatgg

SEQ ID NO: 7940 - DNA, 20 bp, Artificial Sequence
  Artificially Synthesized Primer Sequence
gcctacgcatgctacctctc

SEQ ID NO: 7941 - DNA, 20 bp, Artificial Sequence
  Artificially Synthesized Primer Sequence
cgtggtgacctacaatgtgc

SEQ ID NO: 7942 - DNA, 20 bp, Artificial Sequence
  Artificially Synthesized Primer Sequence
catcagttccatggccttct

SEQ ID NO: 7943 - DNA, 20 bp, Artificial Sequence
  Artificially Synthesized Primer Sequence
agagcaggggattcaggttt

SEQ ID NO: 7944 - DNA, 20 bp, Artificial Sequence
  Artificially Synthesized Primer Sequence
gctgattcctgatgctgtga

SEQ ID NO: 7945 - DNA, 20 bp, Artificial Sequence
  Artificially Synthesized Primer Sequence
agcgaaggcatctaccaaga

SEQ ID NO: 7946 - DNA, 20 bp, Artificial Sequence
  Artificially Synthesized Primer Sequence
atggcaacgggaaactgtag

SEQ ID NO: 7947 - DNA, 20 bp, Artificial Sequence
  Artificially Synthesized Primer Sequence
atggcaacgggaaactgtag

SEQ ID NO: 7948 - DNA, 20 bp, Artificial Sequence
  Artificially Synthesized Primer Sequence
agcgaaggcatctaccaaga

SEQ ID NO: 7949 - DNA, 20 bp, Artificial Sequence
  Artificially Synthesized Primer Sequence
ccttttctacgactgctcgg

SEQ ID NO: 7950 - DNA, 20 bp, Artificial Sequence
  Artificially Synthesized Primer Sequence
aatggagtcgaatggacgag

SEQ ID NO: 7951 - DNA, 20 bp, Artificial Sequence
  Artificially Synthesized Primer Sequence
ctctcggcgataatgaaagc

SEQ ID NO: 7952 - DNA, 20 bp, Artificial Sequence
  Artificially Synthesized Primer Sequence
aacatgagggtgaagttgcc

SEQ ID NO: 7953 - DNA, 20 bp, Artificial Sequence
  Artificially Synthesized Primer Sequence
atgggcaatgatgttggatt

SEQ ID NO: 7954 - DNA, 20 bp, Artificial Sequence
  Artificially Synthesized Primer Sequence
ccccaccaacgaactatttg

SEQ ID NO: 7955 - DNA, 20 bp, Artificial Sequence
  Artificially Synthesized Primer Sequence
cggggttgcattaccatatc

SEQ ID NO: 7956 - DNA, 20 bp, Artificial Sequence
  Artificially Synthesized Primer Sequence
acctagggacggtgatgttg

SEQ ID NO: 7957 - DNA, 20 bp, Artificial Sequence
  Artificially Synthesized Primer Sequence
atgatgtggtagggggtgaa

SEQ ID NO: 7958 - DNA, 20 bp, Artificial Sequence
  Artificially Synthesized Primer Sequence
ggaatgggaaacaagagcaa

SEQ ID NO: 7959 - DNA, 20 bp, Artificial Sequence
  Artificially Synthesized Primer Sequence
aacttgacgcttccacgagt

SEQ ID NO: 7960 - DNA, 20 bp, Artificial Sequence
  Artificially Synthesized Primer Sequence
atgaggatgagcctccagaa

SEQ ID NO: 7961 - DNA, 20 bp, Artificial Sequence
  Artificially Synthesized Primer Sequence
gttccgggtgctgataaaaa

SEQ ID NO: 7962 - DNA, 20 bp, Artificial Sequence
  Artificially Synthesized Primer Sequence
cacagtaactccacgcgcta

SEQ ID NO: 7963 - DNA, 20 bp, Artificial Sequence
  Artificially Synthesized Primer Sequence
gagctcatatcaagccctcg

SEQ ID NO: 7964 - DNA, 20 bp, Artificial Sequence
  Artificially Synthesized Primer Sequence
tagcgcgtggagttactgtg

SEQ ID NO: 7965 - DNA, 20 bp, Artificial Sequence
  Artificially Synthesized Primer Sequence
gatccaagtactggaggcca

SEQ ID NO: 7966 - DNA, 20 bp, Artificial Sequence
  Artificially Synthesized Primer Sequence
caggacgccattctgatctt

SEQ ID NO: 7967 - DNA, 20 bp, Artificial Sequence
  Artificially Synthesized Primer Sequence
aaaaccataccgcaaatcca

SEQ ID NO: 7968 - DNA, 20 bp, Artificial Sequence
  Artificially Synthesized Primer Sequence
caagctcaccgtcacctaca

SEQ ID NO: 7969 - DNA, 20 bp, Artificial Sequence
  Artificially Synthesized Primer Sequence
gcagtttgcatgtcgtgact

SEQ ID NO: 7970 - DNA, 20 bp, Artificial Sequence
  Artificially Synthesized Primer Sequence
aggccaagcaacagaagaaa

SEQ ID NO: 7971 - DNA, 20 bp, Artificial Sequence
  Artificially Synthesized Primer Sequence
agagtttcgacaagggagca

SEQ ID NO: 7972 - DNA, 20 bp, Artificial Sequence
  Artificially Synthesized Primer Sequence
cctctggcttctgtggactc

SEQ ID NO: 7973 - DNA, 20 bp, Artificial Sequence
  Artificially Synthesized Primer Sequence
cgcacgagctagtacaacca

SEQ ID NO: 7974 - DNA, 20 bp, Artificial Sequence
  Artificially Synthesized Primer Sequence
tagtctctggtgcgggaagt

SEQ ID NO: 7975 - DNA, 20 bp, Artificial Sequence
  Artificially Synthesized Primer Sequence
cgcacgagctagtacaacca

SEQ ID NO: 7976 - DNA, 20 bp, Artificial Sequence
  Artificially Synthesized Primer Sequence
ctctggcttaggtggcagat

SEQ ID NO: 7977 - DNA, 20 bp, Artificial Sequence
  Artificially Synthesized Primer Sequence
gacagcacactagcgacagc

SEQ ID NO: 7978 - DNA, 20 bp, Artificial Sequence
  Artificially Synthesized Primer Sequence
agaccctgtggatgatcgag

SEQ ID NO: 7979 - DNA, 20 bp, Artificial Sequence
  Artificially Synthesized Primer Sequence
cgttagaaaaagattgcggc

SEQ ID NO: 7980 - DNA, 20 bp, Artificial Sequence
  Artificially Synthesized Primer Sequence
caagagcaccgacctcaact

SEQ ID NO: 7981 - DNA, 20 bp, Artificial Sequence
  Artificially Synthesized Primer Sequence
tcttggcaaaggaacagctt

SEQ ID NO: 7982 - DNA, 20 bp, Artificial Sequence
  Artificially Synthesized Primer Sequence
ccggttccagtttgcagtat

SEQ ID NO: 7983 - DNA, 20 bp, Artificial Sequence
  Artificially Synthesized Primer Sequence
gacacgatcggtgaacaatg

SEQ ID NO: 7984 - DNA, 20 bp, Artificial Sequence
  Artificially Synthesized Primer Sequence
caaagcacagaaatcagcca

SEQ ID NO: 7985 - DNA, 20 bp, Artificial Sequence
  Artificially Synthesized Primer Sequence
ctcctcaatcgcacatagca

SEQ ID NO: 7986 - DNA, 20 bp, Artificial Sequence
  Artificially Synthesized Primer Sequence
ggcacaaccaccttcttgat

SEQ ID NO: 7987 - DNA, 20 bp, Artificial Sequence
  Artificially Synthesized Primer Sequence
ttgttgacgcttgaaaccag

SEQ ID NO: 7988 - DNA, 20 bp, Artificial Sequence
  Artificially Synthesized Primer Sequence
ttaactacgcttccgtggct

SEQ ID NO: 7989 - DNA, 20 bp, Artificial Sequence
  Artificially Synthesized Primer Sequence
gttttggagctggagagcac

SEQ ID NO: 7990 - DNA, 20 bp, Artificial Sequence
  Artificially Synthesized Primer Sequence
gttgaaagaacttcgagccg

SEQ ID NO: 7991 - DNA, 20 bp, Artificial Sequence
  Artificially Synthesized Primer Sequence
cagcccatcacagacgagta

SEQ ID NO: 7992 - DNA, 20 bp, Artificial Sequence
  Artificially Synthesized Primer Sequence
caagaaggctctggagatcg

SEQ ID NO: 7993 - DNA, 20 bp, Artificial Sequence
  Artificially Synthesized Primer Sequence
aagaggagtgccgacttcaa

SEQ ID NO: 7994 - DNA, 20 bp, Artificial Sequence
  Artificially Synthesized Primer Sequence
acatgccgttcacataacga

SEQ ID NO: 7995 - DNA, 20 bp, Artificial Sequence
  Artificially Synthesized Primer Sequence
aacatgcctgttccacatga

SEQ ID NO: 7996 - DNA, 20 bp, Artificial Sequence
  Artificially Synthesized Primer Sequence
aagaggagtgccgacttcaa

SEQ ID NO: 7997 - DNA, 20 bp, Artificial Sequence
  Artificially Synthesized Primer Sequence
ttccttcttgctgcgattct

SEQ ID NO: 7998 - DNA, 20 bp, Artificial Sequence
  Artificially Synthesized Primer Sequence
caggcaagcctccttgatag

SEQ ID NO: 7999 - DNA, 20 bp, Artificial Sequence
  Artificially Synthesized Primer Sequence
aggacattctgcctgtggtt

SEQ ID NO: 8000 - DNA, 20 bp, Artificial Sequence
  Artificially Synthesized Primer Sequence
tgctggaaaacgtgatgttc

SEQ ID NO: 8001 - DNA, 20 bp, Artificial Sequence
  Artificially Synthesized Primer Sequence
ggtgctagcagaagtccctg

SEQ ID NO: 8002 - DNA, 20 bp, Artificial Sequence
  Artificially Synthesized Primer Sequence
gacagttggggtgcagtttt

SEQ ID NO: 8003 - DNA, 20 bp, Artificial Sequence
  Artificially Synthesized Primer Sequence
gctagacacaaccgtcccat

SEQ ID NO: 8004 - DNA, 20 bp, Artificial Sequence
  Artificially Synthesized Primer Sequence
gggttgcagttgacaaggat

SEQ ID NO: 8005 - DNA, 20 bp, Artificial Sequence
  Artificially Synthesized Primer Sequence
cgtgccgtagtagctcatca

SEQ ID NO: 8006 - DNA, 20 bp, Artificial Sequence
  Artificially Synthesized Primer Sequence
ggtgcaatctcaactgctca

SEQ ID NO: 8007 - DNA, 20 bp, Artificial Sequence
  Artificially Synthesized Primer Sequence
ataaatgactcgctcggtgc

SEQ ID NO: 8008 - DNA, 20 bp, Artificial Sequence
  Artificially Synthesized Primer Sequence
caggaactcctcaaagccag

SEQ ID NO: 8009 - DNA, 10 bp, Artificial Sequence
  Artificially Synthesized Primer Sequence
  MISC_FEATURE (1)..(10): n stands for any base
nnnnnnnnnn

SEQ ID NO: 8010 - DNA, 10 bp, Artificial Sequence
  Artificially Synthesized Primer Sequence
  MISC_FEATURE (1)..(10): n stands for any base
nnnnnnnnnn

SEQ ID NO: 8011 - DNA, 20 bp, Artificial Sequence
  Artificially Synthesized Primer Sequence
accacagatcaaacccgaag

SEQ ID NO: 8012 - DNA, 20 bp, Artificial Sequence
  Artificially Synthesized Primer Sequence
ttgggtgtcgaaggattctc

SEQ ID NO: 8013 - DNA, 20 bp, Artificial Sequence
  Artificially Synthesized Primer Sequence
gcaagggtcaaggaaaatca

SEQ ID NO: 8014 - DNA, 20 bp, Artificial Sequence
  Artificially Synthesized Primer Sequence
gcgtaaagcgtcgagaaatc

SEQ ID NO: 8015 - DNA, 20 bp, Artificial Sequence
  Artificially Synthesized Primer Sequence
ccttcggctgctctatcttg

SEQ ID NO: 8016 - DNA, 20 bp, Artificial Sequence
  Artificially Synthesized Primer Sequence
tgctctgtctggatgtgtcc

SEQ ID NO: 8017 - DNA, 20 bp, Artificial Sequence
  Artificially Synthesized Primer Sequence
tggaggtcctaagctgctgt

SEQ ID NO: 8018 - DNA, 20 bp, Artificial Sequence
  Artificially Synthesized Primer Sequence
tacacgacgcttcttcaacg

SEQ ID NO: 8019 - DNA, 20 bp, Artificial Sequence
  Artificially Synthesized Primer Sequence
gctgatggatcgtcatgttg

SEQ ID NO: 8020 - DNA, 20 bp, Artificial Sequence
  Artificially Synthesized Primer Sequence
gcaggagagcgaattctttg

SEQ ID NO: 8021 - DNA, 20 bp, Artificial Sequence
  Artificially Synthesized Primer Sequence
ctgctgcatgcaacttgttt

SEQ ID NO: 8022 - DNA, 20 bp, Artificial Sequence
  Artificially Synthesized Primer Sequence
gaatgacgggaactgcaaat

SEQ ID NO: 8023 - DNA, 20 bp, Artificial Sequence
  Artificially Synthesized Primer Sequence
ctctctgcaacacaaggtgg

SEQ ID NO: 8024 - DNA, 20 bp, Artificial Sequence
  Artificially Synthesized Primer Sequence
agagcagcagaaagcaaacc

SEQ ID NO: 8025 - DNA, 20 bp, Artificial Sequence
  Artificially Synthesized Primer Sequence
aggatcctgtgacgaacacc

SEQ ID NO: 8026 - DNA, 20 bp, Artificial Sequence
  Artificially Synthesized Primer Sequence
agagcaatgctgctctctcc

SEQ ID NO: 8027 - DNA, 20 bp, Artificial Sequence
  Artificially Synthesized Primer Sequence
aaagcttattgcgcaggttc

SEQ ID NO: 8028 - DNA, 20 bp, Artificial Sequence
  Artificially Synthesized Primer Sequence
ttaaggagatgagcggcaat

SEQ ID NO: 8029 - DNA, 20 bp, Artificial Sequence
  Artificially Synthesized Primer Sequence
ttgagtttgagaaccccgag

SEQ ID NO: 8030 - DNA, 20 bp, Artificial Sequence
  Artificially Synthesized Primer Sequence
ccagttccatcactcccact

SEQ ID NO: 8031 - DNA, 20 bp, Artificial Sequence
  Artificially Synthesized Primer Sequence
agcagttccatcactcccac

SEQ ID NO: 8032 - DNA, 20 bp, Artificial Sequence
  Artificially Synthesized Primer Sequence
ttgagtttgagaaccccgag

SEQ ID NO: 8033 - DNA, 20 bp, Artificial Sequence
  Artificially Synthesized Primer Sequence
tgagagtggcgatgaacaag

SEQ ID NO: 8034 - DNA, 20 bp, Artificial Sequence
  Artificially Synthesized Primer Sequence
ttcacacaggtccacgtcat

SEQ ID NO: 8035 - DNA, 20 bp, Artificial Sequence
  Artificially Synthesized Primer Sequence
caagagggcaagatttcagg

SEQ ID NO: 8036 - DNA, 20 bp, Artificial Sequence
  Artificially Synthesized Primer Sequence
gacgtggacctgtgtgaatg

SEQ ID NO: 8037 - DNA, 20 bp, Artificial Sequence
  Artificially Synthesized Primer Sequence
gtttgaataagcgcacgaca

SEQ ID NO: 8038 - DNA, 20 bp, Artificial Sequence
  Artificially Synthesized Primer Sequence
cacccaaccatcgaagaact

SEQ ID NO: 8039 - DNA, 20 bp, Artificial Sequence
  Artificially Synthesized Primer Sequence
accggaatagttcaagcgac

SEQ ID NO: 8040 - DNA, 20 bp, Artificial Sequence
  Artificially Synthesized Primer Sequence
gtttgaataagcgcacgaca

SEQ ID NO: 8041 - DNA, 20 bp, Artificial Sequence
  Artificially Synthesized Primer Sequence
agatctgcgtgctctccaat

SEQ ID NO: 8042 - DNA, 20 bp, Artificial Sequence
  Artificially Synthesized Primer Sequence
gaatacgttgctcggatggt

SEQ ID NO: 8043 - DNA, 20 bp, Artificial Sequence
  Artificially Synthesized Primer Sequence
gcttatacttcgcaccaggc

SEQ ID NO: 8044 - DNA, 20 bp, Artificial Sequence
  Artificially Synthesized Primer Sequence
ccaggacacacctttcgatt

SEQ ID NO: 8045 - DNA, 20 bp, Artificial Sequence
  Artificially Synthesized Primer Sequence
gtgagaaatccactccccaa

SEQ ID NO: 8046 - DNA, 20 bp, Artificial Sequence
  Artificially Synthesized Primer Sequence
ctgacagttgactgctccca

SEQ ID NO: 8047 - DNA, 20 bp, Artificial Sequence
  Artificially Synthesized Primer Sequence
aatagcgtgagtcccaccac

SEQ ID NO: 8048 - DNA, 20 bp, Artificial Sequence
  Artificially Synthesized Primer Sequence
ggagcagtcaactgtcagca

SEQ ID NO: 8049 - DNA, 20 bp, Artificial Sequence
  Artificially Synthesized Primer Sequence
acatggttggacaaacagca

SEQ ID NO: 8050 - DNA, 20 bp, Artificial Sequence
  Artificially Synthesized Primer Sequence
agtcgttggaagtgggattg

SEQ ID NO: 8051 - DNA, 20 bp, Artificial Sequence
  Artificially Synthesized Primer Sequence
agagtgccagtgcgtatgtg

SEQ ID NO: 8052 - DNA, 20 bp, Artificial Sequence
  Artificially Synthesized Primer Sequence
atttggagcctgtgaccttg

SEQ ID NO: 8053 - DNA, 20 bp, Artificial Sequence
  Artificially Synthesized Primer Sequence
ctccgttgccttcttctttg

SEQ ID NO: 8054 - DNA, 20 bp, Artificial Sequence
  Artificially Synthesized Primer Sequence
agtgcttaatgtgctccgct

SEQ ID NO: 8055 - DNA, 20 bp, Artificial Sequence
  Artificially Synthesized Primer Sequence
cgtggttttattgcctgctt

SEQ ID NO: 8056 - DNA, 20 bp, Artificial Sequence
  Artificially Synthesized Primer Sequence
caatgaccaaccaactgtgc

SEQ ID NO: 8057 - DNA, 20 bp, Artificial Sequence
  Artificially Synthesized Primer Sequence
ctctctgactccatcccagc

SEQ ID NO: 8058 - DNA, 20 bp, Artificial Sequence
  Artificially Synthesized Primer Sequence
tagatgatgccaacgctctg

SEQ ID NO: 8059 - DNA, 20 bp, Artificial Sequence
  Artificially Synthesized Primer Sequence
gcctgggaggatacattcaa

SEQ ID NO: 8060 - DNA, 20 bp, Artificial Sequence
  Artificially Synthesized Primer Sequence
aggaagaacttgacggaggg

SEQ ID NO: 8061 - DNA, 20 bp, Artificial Sequence
  Artificially Synthesized Primer Sequence
tggtctgcgtactatgctcg

SEQ ID NO: 8062 - DNA, 20 bp, Artificial Sequence
  Artificially Synthesized Primer Sequence
gctgaaggtcttggagttcg

SEQ ID NO: 8063 - DNA, 20 bp, Artificial Sequence
  Artificially Synthesized Primer Sequence
atatcagatgctcggcttgc

SEQ ID NO: 8064 - DNA, 19 bp, Artificial Sequence
  Artificially Synthesized Primer Sequence
cccacatgtcggtgagaga

SEQ ID NO: 8065 - DNA, 20 bp, Artificial Sequence
  Artificially Synthesized Primer Sequence
ggaaagtcagttcagagcgg

SEQ ID NO: 8066 - DNA, 20 bp, Artificial Sequence
  Artificially Synthesized Primer Sequence
aaagaaagccttgctgtcca

SEQ ID NO: 8067 - DNA, 20 bp, Artificial Sequence
  Artificially Synthesized Primer Sequence
tgcctctttcaactaggcgt

SEQ ID NO: 8068 - DNA, 20 bp, Artificial Sequence
  Artificially Synthesized Primer Sequence
ctgctggagatactccctcg

SEQ ID NO: 8069 - DNA, 20 bp, Artificial Sequence
  Artificially Synthesized Primer Sequence
gggtcgattatggtcccttt

SEQ ID NO: 8070 - DNA, 20 bp, Artificial Sequence
  Artificially Synthesized Primer Sequence
ggattccaaacgcaaaaaga

SEQ ID NO: 8071 - DNA, 20 bp, Artificial Sequence
  Artificially Synthesized Primer Sequence
gtccaatccaatgtagcggt

SEQ ID NO: 8072 - DNA, 20 bp, Artificial Sequence
  Artificially Synthesized Primer Sequence
cgctcaggcttatcatgctt

SEQ ID NO: 8073 - DNA, 20 bp, Artificial Sequence
  Artificially Synthesized Primer Sequence
tctccgatatgcttgctgtg

SEQ ID NO: 8074 - DNA, 20 bp, Artificial Sequence
  Artificially Synthesized Primer Sequence
gttcgaagatgcccaacatt

SEQ ID NO: 8075 - DNA, 20 bp, Artificial Sequence
  Artificially Synthesized Primer Sequence
cacacggcaaaacgttacag

SEQ ID NO: 8076 - DNA, 20 bp, Artificial Sequence
  Artificially Synthesized Primer Sequence
tctccgatatgcttgctgtg

SEQ ID NO: 8077 - DNA, 20 bp, Artificial Sequence
  Artificially Synthesized Primer Sequence
tgggatgagccattaggaag

SEQ ID NO: 8078 - DNA, 20 bp, Artificial Sequence
  Artificially Synthesized Primer Sequence
tgcatgccacagtttgaaat

SEQ ID NO: 8079 - DNA, 20 bp, Artificial Sequence
  Artificially Synthesized Primer Sequence
tggtccctaaacttctccca

SEQ ID NO: 8080 - DNA, 20 bp, Artificial Sequence
  Artificially Synthesized Primer Sequence
ggcatcgcgttgtatatcct

SEQ ID NO: 8081 - DNA, 20 bp, Artificial Sequence
  Artificially Synthesized Primer Sequence
aactgccagtccttccaatg

SEQ ID NO: 8082 - DNA, 20 bp, Artificial Sequence
  Artificially Synthesized Primer Sequence
tggatctgttgaagctggtg

SEQ ID NO: 8083 - DNA, 20 bp, Artificial Sequence
  Artificially Synthesized Primer Sequence
cggagcttctggttgattgt

SEQ ID NO: 8084 - DNA, 20 bp, Artificial Sequence
  Artificially Synthesized Primer Sequence
aactgccagtccttccaatg

SEQ ID NO: 8085 - DNA, 20 bp, Artificial Sequence
  Artificially Synthesized Primer Sequence
ctggtgagagtcttgccaca

SEQ ID NO: 8086 - DNA, 20 bp, Artificial Sequence
  Artificially Synthesized Primer Sequence
cccttgcagaacttgtgtga

SEQ ID NO: 8087 - DNA, 20 bp, Artificial Sequence
  Artificially Synthesized Primer Sequence
tttgcatgggtgtaacagga

SEQ ID NO: 8088 - DNA, 20 bp, Artificial Sequence
  Artificially Synthesized Primer Sequence
cccacatggacatgacaaac

SEQ ID NO: 8089 - DNA, 20 bp, Artificial Sequence
  Artificially Synthesized Primer Sequence
tcccttattatgcctccacg

SEQ ID NO: 8090 - DNA, 20 bp, Artificial Sequence
  Artificially Synthesized Primer Sequence
ttagcgtgccaaaaagtgtg

SEQ ID NO: 8091 - DNA, 20 bp, Artificial Sequence
  Artificially Synthesized Primer Sequence
gcaaaaactgcgggagtaag

SEQ ID NO: 8092 - DNA, 20 bp, Artificial Sequence
  Artificially Synthesized Primer Sequence
acagctcggttttgatgacc

SEQ ID NO: 8093 - DNA, 20 bp, Artificial Sequence
  Artificially Synthesized Primer Sequence
tatcatgggcctcgaggtag

SEQ ID NO: 8094 - DNA, 20 bp, Artificial Sequence
  Artificially Synthesized Primer Sequence
cgcgaaagagctaaggaaga

SEQ ID NO: 8095 - DNA, 20 bp, Artificial Sequence
  Artificially Synthesized Primer Sequence
caggtcgcagccaagttatt

SEQ ID NO: 8096 - DNA, 20 bp, Artificial Sequence
  Artificially Synthesized Primer Sequence
ttggatgtggttgataggca

SEQ ID NO: 8097 - DNA, 20 bp, Artificial Sequence
  Artificially Synthesized Primer Sequence
cggtttggtcgtgattaggt

SEQ ID NO: 8098 - DNA, 20 bp, Artificial Sequence
  Artificially Synthesized Primer Sequence
taaacatccacagcggcata

SEQ ID NO: 8099 - DNA, 20 bp, Artificial Sequence
  Artificially Synthesized Primer Sequence
atgcctccaagattcatcca

SEQ ID NO: 8100 - DNA, 20 bp, Artificial Sequence
  Artificially Synthesized Primer Sequence
gccattttcgctcttgtgtt

SEQ ID NO: 8101 - DNA, 20 bp, Artificial Sequence
  Artificially Synthesized Primer Sequence
gggaatgagcttggttttga

SEQ ID NO: 8102 - DNA, 20 bp, Artificial Sequence
  Artificially Synthesized Primer Sequence
aaacagggtggagagtgtgc

SEQ ID NO: 8103 - DNA, 20 bp, Artificial Sequence
  Artificially Synthesized Primer Sequence
acgaaggtatccatgtcgga

SEQ ID NO: 8104 - DNA, 20 bp, Artificial Sequence
  Artificially Synthesized Primer Sequence
gggaatgagcttggttttga

SEQ ID NO: 8105 - DNA, 20 bp, Artificial Sequence
  Artificially Synthesized Primer Sequence
ggcctactggagctcatcac

SEQ ID NO: 8106 - DNA, 20 bp, Artificial Sequence
  Artificially Synthesized Primer Sequence
gatgaagacgttgttcacgc

SEQ ID NO: 8107 - DNA, 20 bp, Artificial Sequence
  Artificially Synthesized Primer Sequence
ttggacgcctctcaaaaagt

SEQ ID NO: 8108 - DNA, 20 bp, Artificial Sequence
  Artificially Synthesized Primer Sequence
gtacgagctacgaaggacgg

SEQ ID NO: 8109 - DNA, 20 bp, Artificial Sequence
  Artificially Synthesized Primer Sequence
agcatctctctagctccccc

SEQ ID NO: 8110 - DNA, 20 bp, Artificial Sequence
  Artificially Synthesized Primer Sequence
tactcctaaccgacggaacg

SEQ ID NO: 8111 - DNA, 20 bp, Artificial Sequence
  Artificially Synthesized Primer Sequence
aacacaaagaatggaacgcc

SEQ ID NO: 8112 - DNA, 20 bp, Artificial Sequence
  Artificially Synthesized Primer Sequence
gagatgagatgagatggccc

SEQ ID NO: 8113 - DNA, 20 bp, Artificial Sequence
  Artificially Synthesized Primer Sequence
gctactacttggtcagggcg

SEQ ID NO: 8114 - DNA, 20 bp, Artificial Sequence
  Artificially Synthesized Primer Sequence
gctaccggattcaccaaaaa

SEQ ID NO: 8115 - DNA, 20 bp, Artificial Sequence
  Artificially Synthesized Primer Sequence
tgccatcatggattgcttta

SEQ ID NO: 8116 - DNA, 20 bp, Artificial Sequence
  Artificially Synthesized Primer Sequence
cgatatgaaatgccccactt

SEQ ID NO: 8117 - DNA, 20 bp, Artificial Sequence
  Artificially Synthesized Primer Sequence
tggagaaatcaaaggatggc

SEQ ID NO: 8118 - DNA, 20 bp, Artificial Sequence
  Artificially Synthesized Primer Sequence
tggacacacgagtggtcatt

SEQ ID NO: 8119 - DNA, 20 bp, Artificial Sequence
  Artificially Synthesized Primer Sequence
aaagctgatggaaatgtggc

SEQ ID NO: 8120 - DNA, 20 bp, Artificial Sequence
  Artificially Synthesized Primer Sequence
tgcagcgctttgtgtatagc

SEQ ID NO: 8121 - DNA, 20 bp, Artificial Sequence
  Artificially Synthesized Primer Sequence
ccggggaaaacacctaaaat

SEQ ID NO: 8122 - DNA, 20 bp, Artificial Sequence
  Artificially Synthesized Primer Sequence
ttcccatgagaaaatgaggc

SEQ ID NO: 8123 - DNA, 20 bp, Artificial Sequence
  Artificially Synthesized Primer Sequence
gacgatgcttcagttcggtt

SEQ ID NO: 8124 - DNA, 20 bp, Artificial Sequence
  Artificially Synthesized Primer Sequence
gcgagatgagaagcaaaagc

SEQ ID NO: 8125 - DNA, 20 bp, Artificial Sequence
  Artificially Synthesized Primer Sequence
tttattccctccccctcatc

SEQ ID NO: 8126 - DNA, 20 bp, Artificial Sequence
  Artificially Synthesized Primer Sequence
cggcggtagttaggattcaa

SEQ ID NO: 8127 - DNA, 20 bp, Artificial Sequence
  Artificially Synthesized Primer Sequence
caagtgttttctgtgggcaa

SEQ ID NO: 8128 - DNA, 20 bp, Artificial Sequence
  Artificially Synthesized Primer Sequence
acacaggtctcgccaagagt

SEQ ID NO: 8129 - DNA, 20 bp, Artificial Sequence
  Artificially Synthesized Primer Sequence
ctttgggagatcgtcctctg

SEQ ID NO: 8130 - DNA, 20 bp, Artificial Sequence
  Artificially Synthesized Primer Sequence
attcttcccagctgatccct

SEQ ID NO: 8131 - DNA, 20 bp, Artificial Sequence
  Artificially Synthesized Primer Sequence
cagcgctatgagtgaaccaa

SEQ ID NO: 8132 - DNA, 20 bp, Artificial Sequence
  Artificially Synthesized Primer Sequence
ttgtggcgagtactttgctg

SEQ ID NO: 8133 - DNA, 20 bp, Artificial Sequence
  Artificially Synthesized Primer Sequence
ctgaaacggttgggcttaaa

SEQ ID NO: 8134 - DNA, 20 bp, Artificial Sequence
  Artificially Synthesized Primer Sequence
gcctccaccaaattcctaca

SEQ ID NO: 8135 - DNA, 20 bp, Artificial Sequence
  Artificially Synthesized Primer Sequence
gttaagataatgcagccccg

SEQ ID NO: 8136 - DNA, 20 bp, Artificial Sequence
  Artificially Synthesized Primer Sequence
gaaggccattccatggttta

SEQ ID NO: 8137 - DNA, 20 bp, Artificial Sequence
  Artificially Synthesized Primer Sequence
gtcattggcatggtcttgtg

SEQ ID NO: 8138 - DNA, 20 bp, Artificial Sequence
  Artificially Synthesized Primer Sequence
ccattaaagagcccctttcc

SEQ ID NO: 8139 - DNA, 20 bp, Artificial Sequence
  Artificially Synthesized Primer Sequence
gtggcacaaattgccttctt

SEQ ID NO: 8140 - DNA, 20 bp, Artificial Sequence
  Artificially Synthesized Primer Sequence
tctgggggataagttgcttg

SEQ ID NO: 8141 - DNA, 20 bp, Artificial Sequence
  Artificially Synthesized Primer Sequence
accatacaccttcgccactc

SEQ ID NO: 8142 - DNA, 20 bp, Artificial Sequence
  Artificially Synthesized Primer Sequence
aaaaagccagacgcagaaaa

SEQ ID NO: 8143 - DNA, 20 bp, Artificial Sequence
  Artificially Synthesized Primer Sequence
aaaagccagacgcagaaaaa

SEQ ID NO: 8144 - DNA, 20 bp, Artificial Sequence
  Artificially Synthesized Primer Sequence
accatacaccttcgccactc

SEQ ID NO: 8145 - DNA, 20 bp, Artificial Sequence
  Artificially Synthesized Primer Sequence
aattgggtgtggctcagttc

SEQ ID NO: 8146 - DNA, 20 bp, Artificial Sequence
  Artificially Synthesized Primer Sequence
agaaccacacgtctccatcc

SEQ ID NO: 8147 - DNA, 20 bp, Artificial Sequence
  Artificially Synthesized Primer Sequence
aacattcggtagatggcagc

SEQ ID NO: 8148 - DNA, 20 bp, Artificial Sequence
  Artificially Synthesized Primer Sequence
gtggcaagtatggccttgtt

SEQ ID NO: 8149 - DNA, 20 bp, Artificial Sequence
  Artificially Synthesized Primer Sequence
catgttgagtggacaaacgg

SEQ ID NO: 8150 - DNA, 20 bp, Artificial Sequence
  Artificially Synthesized Primer Sequence
gccgagaactccctgtcata

SEQ ID NO: 8151 - DNA, 20 bp, Artificial Sequence
  Artificially Synthesized Primer Sequence
cacacaataccgtcgattgg

SEQ ID NO: 8152 - DNA, 20 bp, Artificial Sequence
  Artificially Synthesized Primer Sequence
tcgttcccttccctctttct

SEQ ID NO: 8153 - DNA, 20 bp, Artificial Sequence
  Artificially Synthesized Primer Sequence
tggagcgtggagaagaagtt

SEQ ID NO: 8154 - DNA, 20 bp, Artificial Sequence
  Artificially Synthesized Primer Sequence
cccagaagtggtttgtcgat

SEQ ID NO: 8155 - DNA, 20 bp, Artificial Sequence
  Artificially Synthesized Primer Sequence
gcaccgtcgattgatctgta

SEQ ID NO: 8156 - DNA, 20 bp, Artificial Sequence
  Artificially Synthesized Primer Sequence
tctggtgtaatggaggggag

SEQ ID NO: 8157 - DNA, 20 bp, Artificial Sequence
  Artificially Synthesized Primer Sequence
catgagcgaagatgactgga

SEQ ID NO: 8158 - DNA, 20 bp, Artificial Sequence
  Artificially Synthesized Primer Sequence
ttaaggcaatgactccctgg

SEQ ID NO: 8159 - DNA, 20 bp, Artificial Sequence
  Artificially Synthesized Primer Sequence
tcagtatacgcgtgctttcg

SEQ ID NO: 8160 - DNA, 20 bp, Artificial Sequence
  Artificially Synthesized Primer Sequence
gctgcagttttccgtacaca

SEQ ID NO: 8161 - DNA, 20 bp, Artificial Sequence
  Artificially Synthesized Primer Sequence
ggcgtcgttatgttggaact

SEQ ID NO: 8162 - DNA, 20 bp, Artificial Sequence
  Artificially Synthesized Primer Sequence
gctaaagggcacgctctatg

SEQ ID NO: 8163 - DNA, 20 bp, Artificial Sequence
  Artificially Synthesized Primer Sequence
gaagctctcctaatggcacg

SEQ ID NO: 8164 - DNA, 20 bp, Artificial Sequence
  Artificially Synthesized Primer Sequence
ggcgtcgttatgttggaact

SEQ ID NO: 8165 - DNA, 20 bp, Artificial Sequence
  Artificially Synthesized Primer Sequence
aaccaaaacacctcagacgg

SEQ ID NO: 8166 - DNA, 20 bp, Artificial Sequence
  Artificially Synthesized Primer Sequence
aggtggtcatgtagcttggg

SEQ ID NO: 8167 - DNA, 20 bp, Artificial Sequence
  Artificially Synthesized Primer Sequence
atctatcctgtatccggggc

SEQ ID NO: 8168 - DNA, 20 bp, Artificial Sequence
  Artificially Synthesized Primer Sequence
tgtgaagaagcaagtggtgc

SEQ ID NO: 8169 - DNA, 20 bp, Artificial Sequence
  Artificially Synthesized Primer Sequence
ttctgatgatgatgaggcca

SEQ ID NO: 8170 - DNA, 20 bp, Artificial Sequence
  Artificially Synthesized Primer Sequence
gcaccagcacaataagagca

SEQ ID NO: 8171 - DNA, 20 bp, Artificial Sequence
  Artificially Synthesized Primer Sequence
agaacctgggtcactgcaac

SEQ ID NO: 8172 - DNA, 20 bp, Artificial Sequence
  Artificially Synthesized Primer Sequence
ggcccagtggtttattctga

SEQ ID NO: 8173 - DNA, 20 bp, Artificial Sequence
  Artificially Synthesized Primer Sequence
ctccaaaggcagctatccag

SEQ ID NO: 8174 - DNA, 20 bp, Artificial Sequence
  Artificially Synthesized Primer Sequence
tcacaagagtgggatagggc

SEQ ID NO: 8175 - DNA, 21 bp, Artificial Sequence
  Artificially Synthesized Primer Sequence
cgtctcagacacggtacttcc

SEQ ID NO: 8176 - DNA, 20 bp, Artificial Sequence
  Artificially Synthesized Primer Sequence
gctagacatccggtctttcg

SEQ ID NO: 8177 - DNA, 20 bp, Artificial Sequence
  Artificially Synthesized Primer Sequence
gtgtgggggatgaataccag

SEQ ID NO: 8178 - DNA, 20 bp, Artificial Sequence
  Artificially Synthesized Primer Sequence
ctggataaacgctgtgctga

SEQ ID NO: 8179 - DNA, 20 bp, Artificial Sequence
  Artificially Synthesized Primer Sequence
cctaacaacgagggcatgat

SEQ ID NO: 8180 - DNA, 20 bp, Artificial Sequence
  Artificially Synthesized Primer Sequence
taatgagctacatgcgcagc

SEQ ID NO: 8181 - DNA, 20 bp, Artificial Sequence
  Artificially Synthesized Primer Sequence
ccagaggagttgcctttcag

SEQ ID NO: 8182 - DNA, 20 bp, Artificial Sequence
  Artificially Synthesized Primer Sequence
ggggcagttgtgaagtgaat

SEQ ID NO: 8183 - DNA, 20 bp, Artificial Sequence
  Artificially Synthesized Primer Sequence
tcctggattacggaacaagc

SEQ ID NO: 8184 - DNA, 20 bp, Artificial Sequence
  Artificially Synthesized Primer Sequence
ccagaggagttgcctttcag

SEQ ID NO: 8185 - DNA, 10 bp, Artificial Sequence
  Artificially Synthesized Primer Sequence
  MISC_FEATURE (1)..(10): n stands for any base
nnnnnnnnnn

SEQ ID NO: 8186 - DNA, 10 bp, Artificial Sequence
  Artificially Synthesized Primer Sequence
  MISC_FEATURE (1)..(10): n stands for any base
nnnnnnnnnn

SEQ ID NO: 8187 - DNA, 20 bp, Artificial Sequence
  Artificially Synthesized Primer Sequence
tggccaatgtaagcaaaaca

SEQ ID NO: 8188 - DNA, 20 bp, Artificial Sequence
  Artificially Synthesized Primer Sequence
agcaaggcttcttgtccaaa

SEQ ID NO: 8189 - DNA, 20 bp, Artificial Sequence
  Artificially Synthesized Primer Sequence
cttccggacaaagttttgga

SEQ ID NO: 8190 - DNA, 20 bp, Artificial Sequence
  Artificially Synthesized Primer Sequence
tccaacgagggtgatactcc

SEQ ID NO: 8191 - DNA, 20 bp, Artificial Sequence
  Artificially Synthesized Primer Sequence
atcattagcaatgccggttc

SEQ ID NO: 8192 - DNA, 20 bp, Artificial Sequence
  Artificially Synthesized Primer Sequence
ttccggacaaagttttggag

SEQ ID NO: 8193 - DNA, 20 bp, Artificial Sequence
  Artificially Synthesized Primer Sequence
ggctacttcagcaccgtctt

SEQ ID NO: 8194 - DNA, 20 bp, Artificial Sequence
  Artificially Synthesized Primer Sequence
ggatattgccgctgagattc

SEQ ID NO: 8195 - DNA, 20 bp, Artificial Sequence
  Artificially Synthesized Primer Sequence
accatcttctccacccagtg

SEQ ID NO: 8196 - DNA, 20 bp, Artificial Sequence
  Artificially Synthesized Primer Sequence
tacttcagcaccgtcttccc

SEQ ID NO: 8197 - DNA, 20 bp, Artificial Sequence
  Artificially Synthesized Primer Sequence
tggctgctgttgtaatttgc

SEQ ID NO: 8198 - DNA, 20 bp, Artificial Sequence
  Artificially Synthesized Primer Sequence
gatggtgtcgaggcttttgt

SEQ ID NO: 8199 - DNA, 20 bp, Artificial Sequence
  Artificially Synthesized Primer Sequence
cggacttatctcggctcaag

SEQ ID NO: 8200 - DNA, 20 bp, Artificial Sequence
  Artificially Synthesized Primer Sequence
agtgtcgcatatgactccga

SEQ ID NO: 8201 - DNA, 20 bp, Artificial Sequence
  Artificially Synthesized Primer Sequence
cacaccaccatcttcgacac

SEQ ID NO: 8202 - DNA, 20 bp, Artificial Sequence
  Artificially Synthesized Primer Sequence
gcattgagtcacccttggtt

SEQ ID NO: 8203 - DNA, 20 bp, Artificial Sequence
  Artificially Synthesized Primer Sequence
accaaagcacgttcgttaca

SEQ ID NO: 8204 - DNA, 20 bp, Artificial Sequence
  Artificially Synthesized Primer Sequence
gtgctggtgatcgggtacat

SEQ ID NO: 8205 - DNA, 20 bp, Artificial Sequence
  Artificially Synthesized Primer Sequence
gagatgtgcaacaaggggtt

SEQ ID NO: 8206 - DNA, 20 bp, Artificial Sequence
  Artificially Synthesized Primer Sequence
aagttacaacatttgggcgg

SEQ ID NO: 8207 - DNA, 20 bp, Artificial Sequence
  Artificially Synthesized Primer Sequence
accaatgtgacaacgatgga

SEQ ID NO: 8208 - DNA, 20 bp, Artificial Sequence
  Artificially Synthesized Primer Sequence
ctgtggtaggggattgtgct

SEQ ID NO: 8209 - DNA, 20 bp, Artificial Sequence
  Artificially Synthesized Primer Sequence
cacggcatcctccactctat

SEQ ID NO: 8210 - DNA, 20 bp, Artificial Sequence
  Artificially Synthesized Primer Sequence
ttcgacgagacatcacttgg

SEQ ID NO: 8211 - DNA, 20 bp, Artificial Sequence
  Artificially Synthesized Primer Sequence
ttacaatctgtgagcggcac

SEQ ID NO: 8212 - DNA, 20 bp, Artificial Sequence
  Artificially Synthesized Primer Sequence
ctcgtgtcattgctccaaaa

SEQ ID NO: 8213 - DNA, 20 bp, Artificial Sequence
  Artificially Synthesized Primer Sequence
aagatggtcacaaagcaccc

SEQ ID NO: 8214 - DNA, 20 bp, Artificial Sequence
  Artificially Synthesized Primer Sequence
tctaagctagtcccagccca

SEQ ID NO: 8215 - DNA, 20 bp, Artificial Sequence
  Artificially Synthesized Primer Sequence
gttcgatcagacattccggt

SEQ ID NO: 8216 - DNA, 20 bp, Artificial Sequence
  Artificially Synthesized Primer Sequence
ttttctctaaaccccctcgc

SEQ ID NO: 8217 - DNA, 20 bp, Artificial Sequence
  Artificially Synthesized Primer Sequence
atctcgtggtcgttttgagg

SEQ ID NO: 8218 - DNA, 20 bp, Artificial Sequence
  Artificially Synthesized Primer Sequence
ttcactcgtcttcatcgtcg

SEQ ID NO: 8219 - DNA, 20 bp, Artificial Sequence
  Artificially Synthesized Primer Sequence
tttggcagcagagacaaatg

SEQ ID NO: 8220 - DNA, 20 bp, Artificial Sequence
  Artificially Synthesized Primer Sequence
atctcgtggtcgttttgagg

SEQ ID NO: 8221 - DNA, 20 bp, Artificial Sequence
  Artificially Synthesized Primer Sequence
acggatggttatgatgggaa

SEQ ID NO: 8222 - DNA, 20 bp, Artificial Sequence
  Artificially Synthesized Primer Sequence
ccctagctgcatctccaaag

SEQ ID NO: 8223 - DNA, 20 bp, Artificial Sequence
  Artificially Synthesized Primer Sequence
cattccgataaacgttggct

SEQ ID NO: 8224 - DNA, 20 bp, Artificial Sequence
  Artificially Synthesized Primer Sequence
gtcaaagcttgacgcacaga

SEQ ID NO: 8225 - DNA, 20 bp, Artificial Sequence
  Artificially Synthesized Primer Sequence
accatgtactgcatccgtca

SEQ ID NO: 8226 - DNA, 20 bp, Artificial Sequence
  Artificially Synthesized Primer Sequence
cctgctttcatggcttcttc

SEQ ID NO: 8227 - DNA, 20 bp, Artificial Sequence
  Artificially Synthesized Primer Sequence
cgaactagtggcagagggag

SEQ ID NO: 8228 - DNA, 20 bp, Artificial Sequence
  Artificially Synthesized Primer Sequence
gatgaagcttccgtagccag

SEQ ID NO: 8229 - DNA, 20 bp, Artificial Sequence
  Artificially Synthesized Primer Sequence
aattcggcacgaggataatg

SEQ ID NO: 8230 - DNA, 20 bp, Artificial Sequence
  Artificially Synthesized Primer Sequence
ctttcgcaaaagcctcaaac

SEQ ID NO: 8231 - DNA, 20 bp, Artificial Sequence
  Artificially Synthesized Primer Sequence
acagatgtgctgcaatggaa

SEQ ID NO: 8232 - DNA, 20 bp, Artificial Sequence
  Artificially Synthesized Primer Sequence
tgatgtggagagcatggaag

SEQ ID NO: 8233 - DNA, 20 bp, Artificial Sequence
  Artificially Synthesized Primer Sequence
gagggaacatcctacagcca

SEQ ID NO: 8234 - DNA, 20 bp, Artificial Sequence
  Artificially Synthesized Primer Sequence
ccaaacaaaacagcacatgg

SEQ ID NO: 8235 - DNA, 20 bp, Artificial Sequence
  Artificially Synthesized Primer Sequence
ccaaacaaaacagcacatgg

SEQ ID NO: 8236 - DNA, 20 bp, Artificial Sequence
  Artificially Synthesized Primer Sequence
gagggaacatcctacagcca

SEQ ID NO: 8237 - DNA, 20 bp, Artificial Sequence
  Artificially Synthesized Primer Sequence
taatcgaaactccaccagcc

SEQ ID NO: 8238 - DNA, 20 bp, Artificial Sequence
  Artificially Synthesized Primer Sequence
ttttgctttggagatgcctt

SEQ ID NO: 8239 - DNA, 20 bp, Artificial Sequence
  Artificially Synthesized Primer Sequence
tttggcgaaaagacacacac

SEQ ID NO: 8240 - DNA, 20 bp, Artificial Sequence
  Artificially Synthesized Primer Sequence
taatcgaaactccaccagcc

SEQ ID NO: 8241 - DNA, 20 bp, Artificial Sequence
  Artificially Synthesized Primer Sequence
aaatggtgaacgttccgaag

SEQ ID NO: 8242 - DNA, 20 bp, Artificial Sequence
  Artificially Synthesized Primer Sequence
ccaccgatctcaaaatgctt

SEQ ID NO: 8243 - DNA, 20 bp, Artificial Sequence
  Artificially Synthesized Primer Sequence
ccaccgatctcaaaatgctt

SEQ ID NO: 8244 - DNA, 20 bp, Artificial Sequence
  Artificially Synthesized Primer Sequence
tgcaaaaacaaggagtgcaa

SEQ ID NO: 8245 - DNA, 20 bp, Artificial Sequence
  Artificially Synthesized Primer Sequence
agagaggccacaggtgaaga

SEQ ID NO: 8246 - DNA, 20 bp, Artificial Sequence
  Artificially Synthesized Primer Sequence
gggtgtcctctttaccgaca

SEQ ID NO: 8247 - DNA, 20 bp, Artificial Sequence
  Artificially Synthesized Primer Sequence
cgctgacaaggctttcaaat

SEQ ID NO: 8248 - DNA, 20 bp, Artificial Sequence
  Artificially Synthesized Primer Sequence
agagaggccacaggtgaaga

SEQ ID NO: 8249 - DNA, 20 bp, Artificial Sequence
  Artificially Synthesized Primer Sequence
gggaactgctagaggtgctg

SEQ ID NO: 8250 - DNA, 20 bp, Artificial Sequence
  Artificially Synthesized Primer Sequence
gctccagcattgtcagtgaa

SEQ ID NO: 8251 - DNA, 20 bp, Artificial Sequence
  Artificially Synthesized Primer Sequence
ccccggtgttagaaagaaca

SEQ ID NO: 8252 - DNA, 20 bp, Artificial Sequence
  Artificially Synthesized Primer Sequence
atctgtgggaccaactccag

SEQ ID NO: 8253 - DNA, 20 bp, Artificial Sequence
  Artificially Synthesized Primer Sequence
gatcggtctgggatgcttta

SEQ ID NO: 8254 - DNA, 20 bp, Artificial Sequence
  Artificially Synthesized Primer Sequence
ccatcattaggctcacagca

SEQ ID NO: 8255 - DNA, 20 bp, Artificial Sequence
  Artificially Synthesized Primer Sequence
ccatcattaggctcacagca

SEQ ID NO: 8256 - DNA, 20 bp, Artificial Sequence
  Artificially Synthesized Primer Sequence
gatcggtctgggatgcttta

SEQ ID NO: 8257 - DNA, 20 bp, Artificial Sequence
  Artificially Synthesized Primer Sequence
tcatggtcgtcatggtcagt

SEQ ID NO: 8258 - DNA, 20 bp, Artificial Sequence
  Artificially Synthesized Primer Sequence
tcaaagcagccaacagaatg

SEQ ID NO: 8259 - DNA, 20 bp, Artificial Sequence
  Artificially Synthesized Primer Sequence
aacaacaactgaggggccta

SEQ ID NO: 8260 - DNA, 20 bp, Artificial Sequence
  Artificially Synthesized Primer Sequence
tgcagagaagactggctgaa

SEQ ID NO: 8261 - DNA, 20 bp, Artificial Sequence
  Artificially Synthesized Primer Sequence
catcccctatacgcactcgt

SEQ ID NO: 8262 - DNA, 20 bp, Artificial Sequence
  Artificially Synthesized Primer Sequence
ggaacaacacaggggagaaa

SEQ ID NO: 8263 - DNA, 20 bp, Artificial Sequence
  Artificially Synthesized Primer Sequence
gttgcacaaacatggcctaa

SEQ ID NO: 8264 - DNA, 19 bp, Artificial Sequence
  Artificially Synthesized Primer Sequence
aaatgggcaaaaggtccat

SEQ ID NO: 8265 - DNA, 20 bp, Artificial Sequence
  Artificially Synthesized Primer Sequence
attacgcctttaacggggac

SEQ ID NO: 8266 - DNA, 20 bp, Artificial Sequence
  Artificially Synthesized Primer Sequence
atgcccgaagaaggaatttt

SEQ ID NO: 8267 - DNA, 20 bp, Artificial Sequence
  Artificially Synthesized Primer Sequence
gtcaacaaccagtcattgcg

SEQ ID NO: 8268 - DNA, 20 bp, Artificial Sequence
  Artificially Synthesized Primer Sequence
aaacagttcagtggccttgc

SEQ ID NO: 8269 - DNA, 20 bp, Artificial Sequence
  Artificially Synthesized Primer Sequence
cgagaacaagttcctctgcc

SEQ ID NO: 8270 - DNA, 20 bp, Artificial Sequence
  Artificially Synthesized Primer Sequence
tgtgtcgcttatttccacca

SEQ ID NO: 8271 - DNA, 20 bp, Artificial Sequence
  Artificially Synthesized Primer Sequence
taggactggcaggaggctta

SEQ ID NO: 8272 - DNA, 20 bp, Artificial Sequence
  Artificially Synthesized Primer Sequence
gtcgaggattggctcaagac

SEQ ID NO: 8273 - DNA, 20 bp, Artificial Sequence
  Artificially Synthesized Primer Sequence
ctgcctctacaaatctcgcc

SEQ ID NO: 8274 - DNA, 20 bp, Artificial Sequence
  Artificially Synthesized Primer Sequence
agtaccaacagcgaccaacc

SEQ ID NO: 8275 - DNA, 20 bp, Artificial Sequence
  Artificially Synthesized Primer Sequence
tcagcaagcaaacattcagg

SEQ ID NO: 8276 - DNA, 20 bp, Artificial Sequence
  Artificially Synthesized Primer Sequence
ggttggtcgctgttggtact

SEQ ID NO: 8277 - DNA, 20 bp, Artificial Sequence
  Artificially Synthesized Primer Sequence
gaaacgaaggatgattccga

SEQ ID NO: 8278 - DNA, 20 bp, Artificial Sequence
  Artificially Synthesized Primer Sequence
tggaatgcaacagcaacttc

SEQ ID NO: 8279 - DNA, 20 bp, Artificial Sequence
  Artificially Synthesized Primer Sequence
tgcattggcaactcaaaaac

SEQ ID NO: 8280 - DNA, 20 bp, Artificial Sequence
  Artificially Synthesized Primer Sequence
caagttggcatgactcctga

SEQ ID NO: 8281 - DNA, 20 bp, Artificial Sequence
  Artificially Synthesized Primer Sequence
tccgttgtgtcgatcctgta

SEQ ID NO: 8282 - DNA, 20 bp, Artificial Sequence
  Artificially Synthesized Primer Sequence
catcatccaccatgcttacg

SEQ ID NO: 8283 - DNA, 20 bp, Artificial Sequence
  Artificially Synthesized Primer Sequence
ccggacccatttacagacac

SEQ ID NO: 8284 - DNA, 20 bp, Artificial Sequence
  Artificially Synthesized Primer Sequence
atcatctggaacatcctcgg

SEQ ID NO: 8285 - DNA, 20 bp, Artificial Sequence
  Artificially Synthesized Primer Sequence
taccggtcatgtggagacaa

SEQ ID NO: 8286 - DNA, 20 bp, Artificial Sequence
  Artificially Synthesized Primer Sequence
ggcaacaaagaaatgctggt

SEQ ID NO: 8287 - DNA, 21 bp, Artificial Sequence
  Artificially Synthesized Primer Sequence
actttaccggtcatgtggaga

SEQ ID NO: 8288 - DNA, 19 bp, Artificial Sequence
  Artificially Synthesized Primer Sequence
gcaatcaacagccatgtcc

SEQ ID NO: 8289 - DNA, 20 bp, Artificial Sequence
  Artificially Synthesized Primer Sequence
tttggcatggcatttgagta

SEQ ID NO: 8290 - DNA, 20 bp, Artificial Sequence
  Artificially Synthesized Primer Sequence
cgggcaccagataaacaagt

SEQ ID NO: 8291 - DNA, 20 bp, Artificial Sequence
  Artificially Synthesized Primer Sequence
acaaaattttatgcggctgg

SEQ ID NO: 8292 - DNA, 20 bp, Artificial Sequence
  Artificially Synthesized Primer Sequence
atttgtgcagtccgccttac

SEQ ID NO: 8293 - DNA, 20 bp, Artificial Sequence
  Artificially Synthesized Primer Sequence
agtattgtccaggcggtgac

SEQ ID NO: 8294 - DNA, 20 bp, Artificial Sequence
  Artificially Synthesized Primer Sequence
aagaagagttggcccaggat

SEQ ID NO: 8295 - DNA, 20 bp, Artificial Sequence
  Artificially Synthesized Primer Sequence
gcacaacacccgaccttact

SEQ ID NO: 8296 - DNA, 20 bp, Artificial Sequence
  Artificially Synthesized Primer Sequence
gagggttgcttgtgaaggag

SEQ ID NO: 8297 - DNA, 20 bp, Artificial Sequence
  Artificially Synthesized Primer Sequence
cgctgggaaagaataagctg

SEQ ID NO: 8298 - DNA, 20 bp, Artificial Sequence
  Artificially Synthesized Primer Sequence
tcaccgtaggaatcgtcaca

SEQ ID NO: 8299 - DNA, 20 bp, Artificial Sequence
  Artificially Synthesized Primer Sequence
atatcctgctgggcatcatc

SEQ ID NO: 8300 - DNA, 20 bp, Artificial Sequence
  Artificially Synthesized Primer Sequence
ccagcaacaaggcttatcgt

SEQ ID NO: 8301 - DNA, 20 bp, Artificial Sequence
  Artificially Synthesized Primer Sequence
cacgtctatccctgatccgt

SEQ ID NO: 8302 - DNA, 20 bp, Artificial Sequence
  Artificially Synthesized Primer Sequence
acgttgatgccctcaaagac

SEQ ID NO: 8303 - DNA, 20 bp, Artificial Sequence
  Artificially Synthesized Primer Sequence
ctcgacgatagaggcacaca

SEQ ID NO: 8304 - DNA, 20 bp, Artificial Sequence
  Artificially Synthesized Primer Sequence
agcttgaccctcagcttgaa

SEQ ID NO: 8305 - DNA, 20 bp, Artificial Sequence
  Artificially Synthesized Primer Sequence
ccatcagaaacgcacagcta

SEQ ID NO: 8306 - DNA, 20 bp, Artificial Sequence
  Artificially Synthesized Primer Sequence
acaaattggcatccttgtcc

SEQ ID NO: 8307 - DNA, 20 bp, Artificial Sequence
  Artificially Synthesized Primer Sequence
caaattggcatccttgtcct

SEQ ID NO: 8308 - DNA, 20 bp, Artificial Sequence
  Artificially Synthesized Primer Sequence
gcagtagagcgagcgaagac

SEQ ID NO: 8309 - DNA, 20 bp, Artificial Sequence
  Artificially Synthesized Primer Sequence
aacaagtttgggcaagttgg

SEQ ID NO: 8310 - DNA, 20 bp, Artificial Sequence
  Artificially Synthesized Primer Sequence
tgcaaatggaatagctgctg

SEQ ID NO: 8311 - DNA, 20 bp, Artificial Sequence
  Artificially Synthesized Primer Sequence
gaacaatgcgcaaggttttt

SEQ ID NO: 8312 - DNA, 20 bp, Artificial Sequence
  Artificially Synthesized Primer Sequence
ggaggcacactcttgctttc

SEQ ID NO: 8313 - DNA, 20 bp, Artificial Sequence
  Artificially Synthesized Primer Sequence
atgcttattgaagcgctcgt

SEQ ID NO: 8314 - DNA, 20 bp, Artificial Sequence
  Artificially Synthesized Primer Sequence
aactcgcctgctttgtagga

SEQ ID NO: 8315 - DNA, 20 bp, Artificial Sequence
  Artificially Synthesized Primer Sequence
aatgactggagctggaggtg

SEQ ID NO: 8316 - DNA, 20 bp, Artificial Sequence
  Artificially Synthesized Primer Sequence
tcctggcactctcacaaaga

SEQ ID NO: 8317 - DNA, 20 bp, Artificial Sequence
  Artificially Synthesized Primer Sequence
gctcacttcctttgtcctcg

SEQ ID NO: 8318 - DNA, 20 bp, Artificial Sequence
  Artificially Synthesized Primer Sequence
aggagtgttatccccatccc

SEQ ID NO: 8319 - DNA, 20 bp, Artificial Sequence
  Artificially Synthesized Primer Sequence
ttgtttgcaagtcgtttcca

SEQ ID NO: 8320 - DNA, 20 bp, Artificial Sequence
  Artificially Synthesized Primer Sequence
agatgggccctacacttcct

SEQ ID NO: 8321 - DNA, 20 bp, Artificial Sequence
  Artificially Synthesized Primer Sequence
tccagttcgacaagggattc

SEQ ID NO: 8322 - DNA, 20 bp, Artificial Sequence
  Artificially Synthesized Primer Sequence
ggggattttgatcatgttgg

SEQ ID NO: 8323 - DNA, 20 bp, Artificial Sequence
  Artificially Synthesized Primer Sequence
cgggacatgacttccaaact

SEQ ID NO: 8324 - DNA, 20 bp, Artificial Sequence
  Artificially Synthesized Primer Sequence
ccaacatgatcaaaatcccc

SEQ ID NO: 8325 - DNA, 20 bp, Artificial Sequence
  Artificially Synthesized Primer Sequence
gctgctggagggagtatgtc

SEQ ID NO: 8326 - DNA, 20 bp, Artificial Sequence
  Artificially Synthesized Primer Sequence
tgaaaggaaaaatgcgaagg

SEQ ID NO: 8327 - DNA, 20 bp, Artificial Sequence
  Artificially Synthesized Primer Sequence
ggcgcataggatagtcaagg

SEQ ID NO: 8328 - DNA, 20 bp, Artificial Sequence
  Artificially Synthesized Primer Sequence
agctggagaaagacgagcag

SEQ ID NO: 8329 - DNA, 20 bp, Artificial Sequence
  Artificially Synthesized Primer Sequence
tgtcgctgcacctcatagtc

SEQ ID NO: 8330 - DNA, 20 bp, Artificial Sequence
  Artificially Synthesized Primer Sequence
aatggaccacactgggagag

SEQ ID NO: 8331 - DNA, 20 bp, Artificial Sequence
  Artificially Synthesized Primer Sequence
atacacacacacccaaggca

SEQ ID NO: 8332 - DNA, 19 bp, Artificial Sequence
  Artificially Synthesized Primer Sequence
aaggtcttgaatgcagggg

SEQ ID NO: 8333 - DNA, 20 bp, Artificial Sequence
  Artificially Synthesized Primer Sequence
agaggagatggagacggaca

SEQ ID NO: 8334 - DNA, 20 bp, Artificial Sequence
  Artificially Synthesized Primer Sequence
accacattgcaataccagca

SEQ ID NO: 8335 - DNA, 20 bp, Artificial Sequence
  Artificially Synthesized Primer Sequence
gggggaggagcaaaagataa

SEQ ID NO: 8336 - DNA, 20 bp, Artificial Sequence
  Artificially Synthesized Primer Sequence
accatctccaggagcaacac

SEQ ID NO: 8337 - DNA, 20 bp, Artificial Sequence
  Artificially Synthesized Primer Sequence
ttttcctcctcatcgtcgtc

SEQ ID NO: 8338 - DNA, 20 bp, Artificial Sequence
  Artificially Synthesized Primer Sequence
gctgctcacttggtctttcc

SEQ ID NO: 8339 - DNA, 20 bp, Artificial Sequence
  Artificially Synthesized Primer Sequence
aggccatctccttcaggttt

SEQ ID NO: 8340 - DNA, 20 bp, Artificial Sequence
  Artificially Synthesized Primer Sequence
cgatgatgccctaggagaaa

SEQ ID NO: 8341 - DNA, 20 bp, Artificial Sequence
  Artificially Synthesized Primer Sequence
acatggcaagcacctacctc

SEQ ID NO: 8342 - DNA, 20 bp, Artificial Sequence
  Artificially Synthesized Primer Sequence
gccatgtagatgccgttctt

SEQ ID NO: 8343 - DNA, 20 bp, Artificial Sequence
  Artificially Synthesized Primer Sequence
tgaggctatcctggatggag

SEQ ID NO: 8344 - DNA, 20 bp, Artificial Sequence
  Artificially Synthesized Primer Sequence
cgtgaagaacggcatctaca

SEQ ID NO: 8345 - DNA, 20 bp, Artificial Sequence
  Artificially Synthesized Primer Sequence
gtcagcgagggagagaacag

SEQ ID NO: 8346 - DNA, 20 bp, Artificial Sequence
  Artificially Synthesized Primer Sequence
tctggacagcgctaaggaat

SEQ ID NO: 8347 - DNA, 20 bp, Artificial Sequence
  Artificially Synthesized Primer Sequence
tctggacagcgctaaggaat

SEQ ID NO: 8348 - DNA, 20 bp, Artificial Sequence
  Artificially Synthesized Primer Sequence
gagcaggaggagatcattgc

SEQ ID NO: 8349 - DNA, 20 bp, Artificial Sequence
  Artificially Synthesized Primer Sequence
ccgatggtttcaatctgctt

SEQ ID NO: 8350 - DNA, 20 bp, Artificial Sequence
  Artificially Synthesized Primer Sequence
ctcccggtagattgtggaga

SEQ ID NO: 8351 - DNA, 20 bp, Artificial Sequence
  Artificially Synthesized Primer Sequence
gcacaaaaattctgctgggt

SEQ ID NO: 8352 - DNA, 20 bp, Artificial Sequence
  Artificially Synthesized Primer Sequence
ccgatggtttcaatctgctt

SEQ ID NO: 8353 - DNA, 20 bp, Artificial Sequence
  Artificially Synthesized Primer Sequence
ccatgcagagcctaacacaa

SEQ ID NO: 8354 - DNA, 20 bp, Artificial Sequence
  Artificially Synthesized Primer Sequence
taccagaaccactccttggc

SEQ ID NO: 8355 - DNA, 20 bp, Artificial Sequence
  Artificially Synthesized Primer Sequence
ggagttacaatcactcggcg

SEQ ID NO: 8356 - DNA, 20 bp, Artificial Sequence
  Artificially Synthesized Primer Sequence
tagacgtgctgtgagcttcg

SEQ ID NO: 8357 - DNA, 20 bp, Artificial Sequence
  Artificially Synthesized Primer Sequence
gctcctgagtgttttgagcc

SEQ ID NO: 8358 - DNA, 20 bp, Artificial Sequence
  Artificially Synthesized Primer Sequence
gaaggcaagcgaggagtatg

SEQ ID NO: 8359 - DNA, 20 bp, Artificial Sequence
  Artificially Synthesized Primer Sequence
aggatcaactgcgacctgac

SEQ ID NO: 8360 - DNA, 20 bp, Artificial Sequence
  Artificially Synthesized Primer Sequence
gcatcctcttgctgttgtga

SEQ ID NO: 8361 - DNA, 20 bp, Artificial Sequence
  Artificially Synthesized Primer Sequence
gagtgtgattggcatgttgc

SEQ ID NO: 8362 - DNA, 20 bp, Artificial Sequence
  Artificially Synthesized Primer Sequence
aagggggagaagggaaaaat

SEQ ID NO: 8363 - DNA, 20 bp, Artificial Sequence
  Artificially Synthesized Primer Sequence
caccacccatccgataattt

SEQ ID NO: 8364 - DNA, 19 bp, Artificial Sequence
  Artificially Synthesized Primer Sequence
agaacaagggcaagtcgct

SEQ ID NO: 8365 - DNA, 20 bp, Artificial Sequence
  Artificially Synthesized Primer Sequence
cgaggagagagagcgagaga

SEQ ID NO: 8366 - DNA, 20 bp, Artificial Sequence
  Artificially Synthesized Primer Sequence
aaaccatttttaccaagcgg

SEQ ID NO: 8367 - DNA, 20 bp, Artificial Sequence
  Artificially Synthesized Primer Sequence
tgactcccaccagatccttc

SEQ ID NO: 8368 - DNA, 20 bp, Artificial Sequence
  Artificially Synthesized Primer Sequence
tgcaactacgtcgaggtcac

SEQ ID NO: 8369 - DNA, 20 bp, Artificial Sequence
  Artificially Synthesized Primer Sequence
gtatctccaagcaggcaagc

SEQ ID NO: 8370 - DNA, 20 bp, Artificial Sequence
  Artificially Synthesized Primer Sequence
aaacccagcatatcgaccag

SEQ ID NO: 8371 - DNA, 20 bp, Artificial Sequence
  Artificially Synthesized Primer Sequence
cctctccaatctccagcaac

SEQ ID NO: 8372 - DNA, 20 bp, Artificial Sequence
  Artificially Synthesized Primer Sequence
cccaacagactcaagcttcc

SEQ ID NO: 8373 - DNA, 20 bp, Artificial Sequence
  Artificially Synthesized Primer Sequence
ttcgcagaacccagagaagt

SEQ ID NO: 8374 - DNA, 20 bp, Artificial Sequence
  Artificially Synthesized Primer Sequence
tgaccagtggaaacacggta

SEQ ID NO: 8375 - DNA, 20 bp, Artificial Sequence
  Artificially Synthesized Primer Sequence
aagggaaaacgggactagga

SEQ ID NO: 8376 - DNA, 20 bp, Artificial Sequence
  Artificially Synthesized Primer Sequence
taccgtgtttccactggtca

SEQ ID NO: 8377 - DNA, 20 bp, Artificial Sequence
  Artificially Synthesized Primer Sequence
ataacaccgagtttcaccgc

SEQ ID NO: 8378 - DNA, 20 bp, Artificial Sequence
  Artificially Synthesized Primer Sequence
agtgtacaaccgaacccagg

SEQ ID NO: 8379 - DNA, 20 bp, Artificial Sequence
  Artificially Synthesized Primer Sequence
agtgtacaaccgaacccagg

SEQ ID NO: 8380 - DNA, 20 bp, Artificial Sequence
  Artificially Synthesized Primer Sequence
ataacaccgagtttcaccgc

SEQ ID NO: 8381 - DNA, 20 bp, Artificial Sequence
  Artificially Synthesized Primer Sequence
ctttaccttttgcgtctcgc

SEQ ID NO: 8382 - DNA, 20 bp, Artificial Sequence
  Artificially Synthesized Primer Sequence
cgagcgcgaatatagacaca

SEQ ID NO: 8383 - DNA, 20 bp, Artificial Sequence
  Artificially Synthesized Primer Sequence
gaagttcactccattgggct

SEQ ID NO: 8384 - DNA, 20 bp, Artificial Sequence
  Artificially Synthesized Primer Sequence
accaacgatggcattgagtt

SEQ ID NO: 8385 - DNA, 20 bp, Artificial Sequence
  Artificially Synthesized Primer Sequence
aaactttcagaacatgggcg

SEQ ID NO: 8386 - DNA, 20 bp, Artificial Sequence
  Artificially Synthesized Primer Sequence
tcatgagcatcaagctgacc

SEQ ID NO: 8387 - DNA, 20 bp, Artificial Sequence
  Artificially Synthesized Primer Sequence
ctctctccaaagccgaaaca

SEQ ID NO: 8388 - DNA, 20 bp, Artificial Sequence
  Artificially Synthesized Primer Sequence
ggggctagatgcagtcgtta

SEQ ID NO: 8389 - DNA, 20 bp, Artificial Sequence
  Artificially Synthesized Primer Sequence
aatggccaggtcagcataac

SEQ ID NO: 8390 - DNA, 20 bp, Artificial Sequence
  Artificially Synthesized Primer Sequence
tttggcatgctcacagctac

SEQ ID NO: 8391 - DNA, 20 bp, Artificial Sequence
  Artificially Synthesized Primer Sequence
gagtcaaattcgcaggaagc

SEQ ID NO: 8392 - DNA, 20 bp, Artificial Sequence
  Artificially Synthesized Primer Sequence
atctcgttgatccaaatgcc

SEQ ID NO: 8393 - DNA, 20 bp, Artificial Sequence
  Artificially Synthesized Primer Sequence
cagggtccatgattattggg

SEQ ID NO: 8394 - DNA, 20 bp, Artificial Sequence
  Artificially Synthesized Primer Sequence
atgaatagtggttccgccag

SEQ ID NO: 8395 - DNA, 21 bp, Artificial Sequence
  Artificially Synthesized Primer Sequence
ccatcctctatgaccaaacca

SEQ ID NO: 8396 - DNA, 20 bp, Artificial Sequence
  Artificially Synthesized Primer Sequence
ttacacgtttcctggtggtg

SEQ ID NO: 8397 - DNA, 20 bp, Artificial Sequence
  Artificially Synthesized Primer Sequence
gatgactgaccaatgcaacg

SEQ ID NO: 8398 - DNA, 20 bp, Artificial Sequence
  Artificially Synthesized Primer Sequence
cttcagctccatggggaata

SEQ ID NO: 8399 - DNA, 20 bp, Artificial Sequence
  Artificially Synthesized Primer Sequence
tggtaagaatgtcggtgcaa

SEQ ID NO: 8400 - DNA, 20 bp, Artificial Sequence
  Artificially Synthesized Primer Sequence
ttcgatgatgaaaacgtgga

SEQ ID NO: 8401 - DNA, 20 bp, Artificial Sequence
  Artificially Synthesized Primer Sequence
cactagtggcagcacaggaa

SEQ ID NO: 8402 - DNA, 20 bp, Artificial Sequence
  Artificially Synthesized Primer Sequence
ggctcacccacacttcctaa

SEQ ID NO: 8403 - DNA, 20 bp, Artificial Sequence
  Artificially Synthesized Primer Sequence
tctccatcgtcacaggctaa

SEQ ID NO: 8404 - DNA, 20 bp, Artificial Sequence
  Artificially Synthesized Primer Sequence
gtttgcagcacctgacaaga

SEQ ID NO: 8405 - DNA, 20 bp, Artificial Sequence
  Artificially Synthesized Primer Sequence
gcgtctacctgctgtccttc

SEQ ID NO: 8406 - DNA, 20 bp, Artificial Sequence
  Artificially Synthesized Primer Sequence
cttctgggtgttccaccagt

SEQ ID NO: 8407 - DNA, 20 bp, Artificial Sequence
  Artificially Synthesized Primer Sequence
ctccaaaacctcctgtggtc

SEQ ID NO: 8408 - DNA, 20 bp, Artificial Sequence
  Artificially Synthesized Primer Sequence
gtacatcagcgagaggctcc

SEQ ID NO: 8409 - DNA, 20 bp, Artificial Sequence
  Artificially Synthesized Primer Sequence
tacaaccggaagtacagggg

SEQ ID NO: 8410 - DNA, 20 bp, Artificial Sequence
  Artificially Synthesized Primer Sequence
ccgaacctaccgtgtcagat

SEQ ID NO: 8411 - DNA, 20 bp, Artificial Sequence
  Artificially Synthesized Primer Sequence
taatgctggaatcggtaggc

SEQ ID NO: 8412 - DNA, 20 bp, Artificial Sequence
  Artificially Synthesized Primer Sequence
gtgaagcctcggaagatgtc

SEQ ID NO: 8413 - DNA, 20 bp, Artificial Sequence
  Artificially Synthesized Primer Sequence
gcatccctgttgttcaggtt

SEQ ID NO: 8414 - DNA, 20 bp, Artificial Sequence
  Artificially Synthesized Primer Sequence
gacgggtgagattgacgatt

SEQ ID NO: 8415 - DNA, 20 bp, Artificial Sequence
  Artificially Synthesized Primer Sequence
tgatcggatcctttggacat

SEQ ID NO: 8416 - DNA, 20 bp, Artificial Sequence
  Artificially Synthesized Primer Sequence
ggacacgaccttgatcacct

SEQ ID NO: 8417 - DNA, 20 bp, Artificial Sequence
  Artificially Synthesized Primer Sequence
taacgccacttttgctgttg

SEQ ID NO: 8418 - DNA, 20 bp, Artificial Sequence
  Artificially Synthesized Primer Sequence
gaagtgccagttcagaagcc

SEQ ID NO: 8419 - DNA, 20 bp, Artificial Sequence
  Artificially Synthesized Primer Sequence
cgatgctgtacacggtgaat

SEQ ID NO: 8420 - DNA, 20 bp, Artificial Sequence
  Artificially Synthesized Primer Sequence
tggcttcaagagggctttta

SEQ ID NO: 8421 - DNA, 20 bp, Artificial Sequence
  Artificially Synthesized Primer Sequence
gtaattcggcgtttccacat

SEQ ID NO: 8422 - DNA, 20 bp, Artificial Sequence
  Artificially Synthesized Primer Sequence
gaatctgcacttctcagccc

SEQ ID NO: 8423 - DNA, 20 bp, Artificial Sequence
  Artificially Synthesized Primer Sequence
gcccatgagactcaagcaat

SEQ ID NO: 8424 - DNA, 20 bp, Artificial Sequence
  Artificially Synthesized Primer Sequence
gccgaggcactaatccataa

SEQ ID NO: 8425 - DNA, 20 bp, Artificial Sequence
  Artificially Synthesized Primer Sequence
tggaactgttgctcttcgtg

SEQ ID NO: 8426 - DNA, 20 bp, Artificial Sequence
  Artificially Synthesized Primer Sequence
tcctagccagctgaatgtcc

SEQ ID NO: 8427 - DNA, 20 bp, Artificial Sequence
  Artificially Synthesized Primer Sequence
gtgttcagcagcaaaagcag

SEQ ID NO: 8428 - DNA, 20 bp, Artificial Sequence
  Artificially Synthesized Primer Sequence
gagtgaagaagcctcaccgt

SEQ ID NO: 8429 - DNA, 20 bp, Artificial Sequence
  Artificially Synthesized Primer Sequence
gcgaaatgcactcaactgaa

SEQ ID NO: 8430 - DNA, 20 bp, Artificial Sequence
  Artificially Synthesized Primer Sequence
tcaacttgtggtcagggaca

SEQ ID NO: 8431 - DNA, 20 bp, Artificial Sequence
  Artificially Synthesized Primer Sequence
gacgggagccgttataaaca

SEQ ID NO: 8432 - DNA, 20 bp, Artificial Sequence
  Artificially Synthesized Primer Sequence
cggaagctgtccttcaacat

SEQ ID NO: 8433 - DNA, 20 bp, Artificial Sequence
  Artificially Synthesized Primer Sequence
tgtacaacaaagcaggctgg

SEQ ID NO: 8434 - DNA, 20 bp, Artificial Sequence
  Artificially Synthesized Primer Sequence
ttggcggattaaaggaagtg

SEQ ID NO: 8435 - DNA, 20 bp, Artificial Sequence
  Artificially Synthesized Primer Sequence
ttgcagcacccatgtactgt

SEQ ID NO: 8436 - DNA, 20 bp, Artificial Sequence
  Artificially Synthesized Primer Sequence
aagaaggtgacgagagcgaa

SEQ ID NO: 8437 - DNA, 20 bp, Artificial Sequence
  Artificially Synthesized Primer Sequence
ggcaagggtactctcaccaa

SEQ ID NO: 8438 - DNA, 20 bp, Artificial Sequence
  Artificially Synthesized Primer Sequence
tataacatcgttcacggcca

SEQ ID NO: 8439 - DNA, 20 bp, Artificial Sequence
  Artificially Synthesized Primer Sequence
cagactgcctgcaaatcaaa

SEQ ID NO: 8440 - DNA, 20 bp, Artificial Sequence
  Artificially Synthesized Primer Sequence
agatgggcttcacatatggc

SEQ ID NO: 8441 - DNA, 20 bp, Artificial Sequence
  Artificially Synthesized Primer Sequence
ttatcacattggaccgcgta

SEQ ID NO: 8442 - DNA, 20 bp, Artificial Sequence
  Artificially Synthesized Primer Sequence
tctgtatgcgattcagcagg

SEQ ID NO: 8443 - DNA, 20 bp, Artificial Sequence
  Artificially Synthesized Primer Sequence
tagggtagggttgtgccaag

SEQ ID NO: 8444 - DNA, 20 bp, Artificial Sequence
  Artificially Synthesized Primer Sequence
gcaaccacatttccgctact

SEQ ID NO: 8445 - DNA, 20 bp, Artificial Sequence
  Artificially Synthesized Primer Sequence
agaaggctttcgtagtgcca

SEQ ID NO: 8446 - DNA, 20 bp, Artificial Sequence
  Artificially Synthesized Primer Sequence
tttgtagcagcagcatggac

SEQ ID NO: 8447 - DNA, 20 bp, Artificial Sequence
  Artificially Synthesized Primer Sequence
tttgtagcagcagcatggac

SEQ ID NO: 8448 - DNA, 20 bp, Artificial Sequence
  Artificially Synthesized Primer Sequence
agaaggctttcgtagtgcca

SEQ ID NO: 8449 - DNA, 20 bp, Artificial Sequence
  Artificially Synthesized Primer Sequence
aacgaggatggattggtgag

SEQ ID NO: 8450 - DNA, 20 bp, Artificial Sequence
  Artificially Synthesized Primer Sequence
tgcctcttgtcagaaacgtg

SEQ ID NO: 8451 - DNA, 20 bp, Artificial Sequence
  Artificially Synthesized Primer Sequence
ttgcttttcctcactagggc

SEQ ID NO: 8452 - DNA, 20 bp, Artificial Sequence
  Artificially Synthesized Primer Sequence
taggtttgaggaatcgacgg

SEQ ID NO: 8453 - DNA, 20 bp, Artificial Sequence
  Artificially Synthesized Primer Sequence
aaggcttgttgttgctgctt

SEQ ID NO: 8454 - DNA, 20 bp, Artificial Sequence
  Artificially Synthesized Primer Sequence
tgccagtgacgagatttctg

SEQ ID NO: 8455 - DNA, 20 bp, Artificial Sequence
  Artificially Synthesized Primer Sequence
gcgagagcaaatcacacaga

SEQ ID NO: 8456 - DNA, 20 bp, Artificial Sequence
  Artificially Synthesized Primer Sequence
ttcattcatacgatgccgtg

SEQ ID NO: 8457 - DNA, 20 bp, Artificial Sequence
  Artificially Synthesized Primer Sequence
ttggctattgggttttgagg

SEQ ID NO: 8458 - DNA, 20 bp, Artificial Sequence
  Artificially Synthesized Primer Sequence
cttatggcaagcagcaacaa

SEQ ID NO: 8459 - DNA, 20 bp, Artificial Sequence
  Artificially Synthesized Primer Sequence
tacacttctttgccgcattg

SEQ ID NO: 8460 - DNA, 20 bp, Artificial Sequence
  Artificially Synthesized Primer Sequence
ccttcgaatttccacctcag

SEQ ID NO: 8461 - DNA, 20 bp, Artificial Sequence
  Artificially Synthesized Primer Sequence
cgtccacctaccccctattt

SEQ ID NO: 8462 - DNA, 20 bp, Artificial Sequence
  Artificially Synthesized Primer Sequence
acaaagtgggacgcaaaaac

SEQ ID NO: 8463 - DNA, 20 bp, Artificial Sequence
  Artificially Synthesized Primer Sequence
aatcggacgaacagatgacc

SEQ ID NO: 8464 - DNA, 20 bp, Artificial Sequence
  Artificially Synthesized Primer Sequence
ccgcaaagatggtctcaaat

SEQ ID NO: 8465 - DNA, 20 bp, Artificial Sequence
  Artificially Synthesized Primer Sequence
agcaacatttggacgtgtga

SEQ ID NO: 8466 - DNA, 20 bp, Artificial Sequence
  Artificially Synthesized Primer Sequence
gttctctggtggagcacaca

SEQ ID NO: 8467 - DNA, 20 bp, Artificial Sequence
  Artificially Synthesized Primer Sequence
tgttctctggtggagcacac

SEQ ID NO: 8468 - DNA, 20 bp, Artificial Sequence
  Artificially Synthesized Primer Sequence
tatgtaaaccccagatcggc

SEQ ID NO: 8469 - DNA, 20 bp, Artificial Sequence
  Artificially Synthesized Primer Sequence
acggcgaattcgtgaaatac

SEQ ID NO: 8470 - DNA, 20 bp, Artificial Sequence
  Artificially Synthesized Primer Sequence
gggaatgaagagggggaata

SEQ ID NO: 8471 - DNA, 20 bp, Artificial Sequence
  Artificially Synthesized Primer Sequence
agcttcatatgttccacggc

SEQ ID NO: 8472 - DNA, 20 bp, Artificial Sequence
  Artificially Synthesized Primer Sequence
gttcccgatcttggatgaga

SEQ ID NO: 8473 - DNA, 20 bp, Artificial Sequence
  Artificially Synthesized Primer Sequence
gaatactgcgacgacagcaa

SEQ ID NO: 8474 - DNA, 20 bp, Artificial Sequence
  Artificially Synthesized Primer Sequence
gcgtcgatcaattcagacct

SEQ ID NO: 8475 - DNA, 20 bp, Artificial Sequence
  Artificially Synthesized Primer Sequence
gcgtcgatcaattcagacct

SEQ ID NO: 8476 - DNA, 20 bp, Artificial Sequence
  Artificially Synthesized Primer Sequence
gaatactgcgacgacagcaa

SEQ ID NO: 8477 - DNA, 20 bp, Artificial Sequence
  Artificially Synthesized Primer Sequence
ctctccgttcctcacaaagc

SEQ ID NO: 8478 - DNA, 20 bp, Artificial Sequence
  Artificially Synthesized Primer Sequence
gccatcaggaactttgaagc

SEQ ID NO: 8479 - DNA, 20 bp, Artificial Sequence
  Artificially Synthesized Primer Sequence
taacggcatccctcatcttc

SEQ ID NO: 8480 - DNA, 20 bp, Artificial Sequence
  Artificially Synthesized Primer Sequence
gcttcaaagttcctgatggc

SEQ ID NO: 8481 - DNA, 20 bp, Artificial Sequence
  Artificially Synthesized Primer Sequence
gctttaccgcgaatgaagag

SEQ ID NO: 8482 - DNA, 20 bp, Artificial Sequence
  Artificially Synthesized Primer Sequence
accaaaacgacaaacggaag

SEQ ID NO: 8483 - DNA, 20 bp, Artificial Sequence
  Artificially Synthesized Primer Sequence
agctttaccgcgaatgaaga

SEQ ID NO: 8484 - DNA, 20 bp, Artificial Sequence
  Artificially Synthesized Primer Sequence
accaaaacgacaaacggaag

SEQ ID NO: 8485 - DNA, 20 bp, Artificial Sequence
  Artificially Synthesized Primer Sequence
ccgcagccagataagaaaag

SEQ ID NO: 8486 - DNA, 20 bp, Artificial Sequence
  Artificially Synthesized Primer Sequence
cgattatcgtgaagcagcaa

SEQ ID NO: 8487 - DNA, 20 bp, Artificial Sequence
  Artificially Synthesized Primer Sequence
acagtacgctcattgtggca

SEQ ID NO: 8488 - DNA, 20 bp, Artificial Sequence
  Artificially Synthesized Primer Sequence
gcgtcctcatctaccagagc

SEQ ID NO: 8489 - DNA, 20 bp, Artificial Sequence
  Artificially Synthesized Primer Sequence
aatagctccggtgagctgaa

SEQ ID NO: 8490 - DNA, 20 bp, Artificial Sequence
  Artificially Synthesized Primer Sequence
aaaggatgcatcacctcctg

SEQ ID NO: 8491 - DNA, 20 bp, Artificial Sequence
  Artificially Synthesized Primer Sequence
cctccgagtggctcaaataa

SEQ ID NO: 8492 - DNA, 20 bp, Artificial Sequence
  Artificially Synthesized Primer Sequence
aaaacagtgcaaccgtcctc

SEQ ID NO: 8493 - DNA, 20 bp, Artificial Sequence
  Artificially Synthesized Primer Sequence
ccctactactcggagcacca

SEQ ID NO: 8494 - DNA, 20 bp, Artificial Sequence
  Artificially Synthesized Primer Sequence
ctagatgtctggatcgccgt

SEQ ID NO: 8495 - DNA, 20 bp, Artificial Sequence
  Artificially Synthesized Primer Sequence
gaatcaaaaagcccttccgt

SEQ ID NO: 8496 - DNA, 20 bp, Artificial Sequence
  Artificially Synthesized Primer Sequence
acctggagactactcgctgc

SEQ ID NO: 8497 - DNA, 20 bp, Artificial Sequence
  Artificially Synthesized Primer Sequence
ccacaaatgcaatgttcctg

SEQ ID NO: 8498 - DNA, 20 bp, Artificial Sequence
  Artificially Synthesized Primer Sequence
cctcaccttggtgtcgaaat

SEQ ID NO: 8499 - DNA, 20 bp, Artificial Sequence
  Artificially Synthesized Primer Sequence
caaggatccaacgaggagaa

SEQ ID NO: 8500 - DNA, 20 bp, Artificial Sequence
  Artificially Synthesized Primer Sequence
gcagcgaggatggaataaaa

SEQ ID NO: 8501 - DNA, 20 bp, Artificial Sequence
  Artificially Synthesized Primer Sequence
cccgtaggaatcccgtatct

SEQ ID NO: 8502 - DNA, 20 bp, Artificial Sequence
  Artificially Synthesized Primer Sequence
aagccgtctgtgtcaggtct

SEQ ID NO: 8503 - DNA, 20 bp, Artificial Sequence
  Artificially Synthesized Primer Sequence
actgaaaccacatgctgctg

SEQ ID NO: 8504 - DNA, 20 bp, Artificial Sequence
  Artificially Synthesized Primer Sequence
gcttgtaagccaagtccacg

SEQ ID NO: 8505 - DNA, 20 bp, Artificial Sequence
  Artificially Synthesized Primer Sequence
aaagcaaccaaccaaccaac

SEQ ID NO: 8506 - DNA, 20 bp, Artificial Sequence
  Artificially Synthesized Primer Sequence
aaacacacggcaggaaaaac

SEQ ID NO: 8507 - DNA, 20 bp, Artificial Sequence
  Artificially Synthesized Primer Sequence
tagcagctgcccctaacagt

SEQ ID NO: 8508 - DNA, 20 bp, Artificial Sequence
  Artificially Synthesized Primer Sequence
atacgcttgagtacgggacg

SEQ ID NO: 8509 - DNA, 20 bp, Artificial Sequence
  Artificially Synthesized Primer Sequence
ttccaaggggacgtgtctac

SEQ ID NO: 8510 - DNA, 20 bp, Artificial Sequence
  Artificially Synthesized Primer Sequence
gcaaccttggacttgagagc

SEQ ID NO: 8511 - DNA, 20 bp, Artificial Sequence
  Artificially Synthesized Primer Sequence
ataggcagagagaccaggca

SEQ ID NO: 8512 - DNA, 20 bp, Artificial Sequence
  Artificially Synthesized Primer Sequence
acgatacttggggaaagcct

SEQ ID NO: 8513 - DNA, 20 bp, Artificial Sequence
  Artificially Synthesized Primer Sequence
tttttcacggcatcgttaca

SEQ ID NO: 8514 - DNA, 20 bp, Artificial Sequence
  Artificially Synthesized Primer Sequence
cactaagggcgaattgggta

SEQ ID NO: 8515 - DNA, 20 bp, Artificial Sequence
  Artificially Synthesized Primer Sequence
cagatcaccgttcatcgcta

SEQ ID NO: 8516 - DNA, 20 bp, Artificial Sequence
  Artificially Synthesized Primer Sequence
tacctttcacggaccgctac

SEQ ID NO: 8517 - DNA, 20 bp, Artificial Sequence
  Artificially Synthesized Primer Sequence
cctttccccgttcttctttc

SEQ ID NO: 8518 - DNA, 20 bp, Artificial Sequence
  Artificially Synthesized Primer Sequence
tccgataaaagagtgggacg

SEQ ID NO: 8519 - DNA, 20 bp, Artificial Sequence
  Artificially Synthesized Primer Sequence
aggaagcacgacgcatttac

SEQ ID NO: 8520 - DNA, 20 bp, Artificial Sequence
  Artificially Synthesized Primer Sequence
tctttggtctcgctgaacct

SEQ ID NO: 8521 - DNA, 20 bp, Artificial Sequence
  Artificially Synthesized Primer Sequence
cttcagatacatcgctgcca

SEQ ID NO: 8522 - DNA, 20 bp, Artificial Sequence
  Artificially Synthesized Primer Sequence
cattgctcgttgagctttga

SEQ ID NO: 8523 - DNA, 20 bp, Artificial Sequence
  Artificially Synthesized Primer Sequence
aaacttggcacacgctctct

SEQ ID NO: 8524 - DNA, 20 bp, Artificial Sequence
  Artificially Synthesized Primer Sequence
tgtttggtagggtgtgggat

SEQ ID NO: 8525 - DNA, 20 bp, Artificial Sequence
  Artificially Synthesized Primer Sequence
atcgtgcagatcctcgtcat

SEQ ID NO: 8526 - DNA, 20 bp, Artificial Sequence
  Artificially Synthesized Primer Sequence
agaactgaaaggcgaacgaa

SEQ ID NO: 8527 - DNA, 20 bp, Artificial Sequence
  Artificially Synthesized Primer Sequence
aacagcaccggaaaatatcg

SEQ ID NO: 8528 - DNA, 20 bp, Artificial Sequence
  Artificially Synthesized Primer Sequence
atcgtgcagatcctcgtcat

SEQ ID NO: 8529 - DNA, 20 bp, Artificial Sequence
  Artificially Synthesized Primer Sequence
ctcgttcgaggagctgtacg

SEQ ID NO: 8530 - DNA, 20 bp, Artificial Sequence
  Artificially Synthesized Primer Sequence
ggcttattgctcgctaatgg

SEQ ID NO: 8531 - DNA, 20 bp, Artificial Sequence
  Artificially Synthesized Primer Sequence
tgatttgtttgcagctcctg

SEQ ID NO: 8532 - DNA, 21 bp, Artificial Sequence
  Artificially Synthesized Primer Sequence
agtgaggaaccacgtgctcta

SEQ ID NO: 8533 - DNA, 20 bp, Artificial Sequence
  Artificially Synthesized Primer Sequence
ctgtgaccaaccatgtccag

SEQ ID NO: 8534 - DNA, 20 bp, Artificial Sequence
  Artificially Synthesized Primer Sequence
cacaagaactgcacgcatct

SEQ ID NO: 8535 - DNA, 20 bp, Artificial Sequence
  Artificially Synthesized Primer Sequence
acaacccggcagctctataa

SEQ ID NO: 8536 - DNA, 20 bp, Artificial Sequence
  Artificially Synthesized Primer Sequence
acggtactgccacacaacaa

SEQ ID NO: 8537 - DNA, 20 bp, Artificial Sequence
  Artificially Synthesized Primer Sequence
gaactcaaccgggactacga

SEQ ID NO: 8538 - DNA, 20 bp, Artificial Sequence
  Artificially Synthesized Primer Sequence
ttcgaggttttatgtcgtgc

SEQ ID NO: 8539 - DNA, 20 bp, Artificial Sequence
  Artificially Synthesized Primer Sequence
tttctacaagcaagcaggca

SEQ ID NO: 8540 - DNA, 22 bp, Artificial Sequence
  Artificially Synthesized Primer Sequence
tggagagataacgtgtctagcg

SEQ ID NO: 8541 - DNA, 20 bp, Artificial Sequence
  Artificially Synthesized Primer Sequence
gtgttgttgtgtttgcagcc

SEQ ID NO: 8542 - DNA, 20 bp, Artificial Sequence
  Artificially Synthesized Primer Sequence
ttcatgaccccactgagaaa

SEQ ID NO: 8543 - DNA, 20 bp, Artificial Sequence
  Artificially Synthesized Primer Sequence
cgacggggctagatttacag

SEQ ID NO: 8544 - DNA, 20 bp, Artificial Sequence
  Artificially Synthesized Primer Sequence
gggagcgctacctcttcaat

SEQ ID NO: 8545 - DNA, 20 bp, Artificial Sequence
  Artificially Synthesized Primer Sequence
gcactgttggcctactggat

SEQ ID NO: 8546 - DNA, 20 bp, Artificial Sequence
  Artificially Synthesized Primer Sequence
tacgattcacgatccaacca

SEQ ID NO: 8547 - DNA, 20 bp, Artificial Sequence
  Artificially Synthesized Primer Sequence
ctgcaagctggatgtcaact

SEQ ID NO: 8548 - DNA, 20 bp, Artificial Sequence
  Artificially Synthesized Primer Sequence
cggtgcatcttgctatctca

SEQ ID NO: 8549 - DNA, 20 bp, Artificial Sequence
  Artificially Synthesized Primer Sequence
aggaagccttggaaaagctc

SEQ ID NO: 8550 - DNA, 20 bp, Artificial Sequence
  Artificially Synthesized Primer Sequence
aacccctgcagtttctgcta

SEQ ID NO: 8551 - DNA, 22 bp, Artificial Sequence
  Artificially Synthesized Primer Sequence
tgtgcactgttttaatcccttg

SEQ ID NO: 8552 - DNA, 20 bp, Artificial Sequence
  Artificially Synthesized Primer Sequence
aaacggagcacttgttccac

SEQ ID NO: 8553 - DNA, 20 bp, Artificial Sequence
  Artificially Synthesized Primer Sequence
acaacgcacgtttctgtgag

SEQ ID NO: 8554 - DNA, 20 bp, Artificial Sequence
  Artificially Synthesized Primer Sequence
aacgaacaccctgtccactc

SEQ ID NO: 8555 - DNA, 20 bp, Artificial Sequence
  Artificially Synthesized Primer Sequence
tggctacccaacactaccaa

SEQ ID NO: 8556 - DNA, 20 bp, Artificial Sequence
  Artificially Synthesized Primer Sequence
gacgtcaagtgtttgccaag

SEQ ID NO: 8557 - DNA, 20 bp, Artificial Sequence
  Artificially Synthesized Primer Sequence
agaagccgacaggctcaata

SEQ ID NO: 8558 - DNA, 20 bp, Artificial Sequence
  Artificially Synthesized Primer Sequence
ttctctatgtggcgatgcag

SEQ ID NO: 8559 - DNA, 20 bp, Artificial Sequence
  Artificially Synthesized Primer Sequence
attttgagtggagcacccag

SEQ ID NO: 8560 - DNA, 20 bp, Artificial Sequence
  Artificially Synthesized Primer Sequence
gcatagatgcaagggggtta

SEQ ID NO: 8561 - DNA, 20 bp, Artificial Sequence
  Artificially Synthesized Primer Sequence
attctgacttgcctgtcgct

SEQ ID NO: 8562 - DNA, 20 bp, Artificial Sequence
  Artificially Synthesized Primer Sequence
cgcggatgtcttggatagtt

SEQ ID NO: 8563 - DNA, 20 bp, Artificial Sequence
  Artificially Synthesized Primer Sequence
atggtcctatctgcaatccg

SEQ ID NO: 8564 - DNA, 20 bp, Artificial Sequence
  Artificially Synthesized Primer Sequence
aagacgatttacgggtgagg

SEQ ID NO: 8565 - DNA, 20 bp, Artificial Sequence
  Artificially Synthesized Primer Sequence
caccttcgtgctcgtctaca

SEQ ID NO: 8566 - DNA, 20 bp, Artificial Sequence
  Artificially Synthesized Primer Sequence
acccagaacatccagtggtc

SEQ ID NO: 8567 - DNA, 20 bp, Artificial Sequence
  Artificially Synthesized Primer Sequence
acctggatgcgtacatgaca

SEQ ID NO: 8568 - DNA, 20 bp, Artificial Sequence
  Artificially Synthesized Primer Sequence
gctgccgtgatctacaacaa

SEQ ID NO: 8569 - DNA, 20 bp, Artificial Sequence
  Artificially Synthesized Primer Sequence
gaccgtggagtagagaagcg

SEQ ID NO: 8570 - DNA, 20 bp, Artificial Sequence
  Artificially Synthesized Primer Sequence
ctccatctcagtctttccgc

SEQ ID NO: 8571 - DNA, 20 bp, Artificial Sequence
  Artificially Synthesized Primer Sequence
cccacccttaccactaggct

SEQ ID NO: 8572 - DNA, 20 bp, Artificial Sequence
  Artificially Synthesized Primer Sequence
gaccgtggagtagagaagcg

SEQ ID NO: 8573 - DNA, 20 bp, Artificial Sequence
  Artificially Synthesized Primer Sequence
cgctgttggtgacgctacta

SEQ ID NO: 8574 - DNA, 20 bp, Artificial Sequence
  Artificially Synthesized Primer Sequence
gcacgttcatggacttgatg

SEQ ID NO: 8575 - DNA, 20 bp, Artificial Sequence
  Artificially Synthesized Primer Sequence
tggaatgttagccagggaag

SEQ ID NO: 8576 - DNA, 20 bp, Artificial Sequence
  Artificially Synthesized Primer Sequence
gaaatggcgagaagcagaac

SEQ ID NO: 8577 - DNA, 20 bp, Artificial Sequence
  Artificially Synthesized Primer Sequence
cgacctcttcaacaacgtca

SEQ ID NO: 8578 - DNA, 20 bp, Artificial Sequence
  Artificially Synthesized Primer Sequence
tcgagcagtgatggtttcag

SEQ ID NO: 8579 - DNA, 20 bp, Artificial Sequence
  Artificially Synthesized Primer Sequence
ggataaaatggttgggcctt

SEQ ID NO: 8580 - DNA, 20 bp, Artificial Sequence
  Artificially Synthesized Primer Sequence
ctttgatgttcgggaggaaa

SEQ ID NO: 8581 - DNA, 20 bp, Artificial Sequence
  Artificially Synthesized Primer Sequence
acgaaggaaacagcgagaaa

SEQ ID NO: 8582 - DNA, 20 bp, Artificial Sequence
  Artificially Synthesized Primer Sequence
cagtagtgcagagccttccc

SEQ ID NO: 8583 - DNA, 20 bp, Artificial Sequence
  Artificially Synthesized Primer Sequence
cagtagtgccagagccttcc

SEQ ID NO: 8584 - DNA, 20 bp, Artificial Sequence
  Artificially Synthesized Primer Sequence
atctaggagccccactccat

SEQ ID NO: 8585 - DNA, 20 bp, Artificial Sequence
  Artificially Synthesized Primer Sequence
ggtggattgcttgtcgtttt

SEQ ID NO: 8586 - DNA, 20 bp, Artificial Sequence
  Artificially Synthesized Primer Sequence
aagaggggaggagtgggtaa

SEQ ID NO: 8587 - DNA, 20 bp, Artificial Sequence
  Artificially Synthesized Primer Sequence
aagcaatccaccatgaaacc

SEQ ID NO: 8588 - DNA, 20 bp, Artificial Sequence
  Artificially Synthesized Primer Sequence
agtgctacctgtccaccacc

SEQ ID NO: 8589 - DNA, 20 bp, Artificial Sequence
  Artificially Synthesized Primer Sequence
gcaaggagtgaggactgagg

SEQ ID NO: 8590 - DNA, 20 bp, Artificial Sequence
  Artificially Synthesized Primer Sequence
taaatggtttatcggggcaa

SEQ ID NO: 8591 - DNA, 20 bp, Artificial Sequence
  Artificially Synthesized Primer Sequence
ttaaatggcattgcagtgga

SEQ ID NO: 8592 - DNA, 20 bp, Artificial Sequence
  Artificially Synthesized Primer Sequence
gattggtaggtgctggaagc

SEQ ID NO: 8593 - DNA, 20 bp, Artificial Sequence
  Artificially Synthesized Primer Sequence
tgcaagctgaagttggattg

SEQ ID NO: 8594 - DNA, 20 bp, Artificial Sequence
  Artificially Synthesized Primer Sequence
gacaccctccctcactgtgt

SEQ ID NO: 8595 - DNA, 20 bp, Artificial Sequence
  Artificially Synthesized Primer Sequence
caccctccatgatatttggg

SEQ ID NO: 8596 - DNA, 20 bp, Artificial Sequence
  Artificially Synthesized Primer Sequence
atccaactgcaagggatgag

SEQ ID NO: 8597 - DNA, 20 bp, Artificial Sequence
  Artificially Synthesized Primer Sequence
aaggaaggcttgcagacaaa

SEQ ID NO: 8598 - DNA, 20 bp, Artificial Sequence
  Artificially Synthesized Primer Sequence
cttcgaggaacttgtccagc

SEQ ID NO: 8599 - DNA, 20 bp, Artificial Sequence
  Artificially Synthesized Primer Sequence
tccaattcatcagcggaaat

SEQ ID NO: 8600 - DNA, 19 bp, Artificial Sequence
  Artificially Synthesized Primer Sequence
ccgccattaacgcctactc

SEQ ID NO: 8601 - DNA, 20 bp, Artificial Sequence
  Artificially Synthesized Primer Sequence
gggatagttggcatgcttgt

SEQ ID NO: 8602 - DNA, 20 bp, Artificial Sequence
  Artificially Synthesized Primer Sequence
gaatgcgccaagcatatttt

SEQ ID NO: 8603 - DNA, 20 bp, Artificial Sequence
  Artificially Synthesized Primer Sequence
tgcataaaacacctcacccc

SEQ ID NO: 8604 - DNA, 20 bp, Artificial Sequence
  Artificially Synthesized Primer Sequence
cacactagcgggttccattt

SEQ ID NO: 8605 - DNA, 20 bp, Artificial Sequence
  Artificially Synthesized Primer Sequence
gcattgcgatgcactaagaa

SEQ ID NO: 8606 - DNA, 20 bp, Artificial Sequence
  Artificially Synthesized Primer Sequence
gtcggccataaggaaaaaca

SEQ ID NO: 8607 - DNA, 20 bp, Artificial Sequence
  Artificially Synthesized Primer Sequence
gcagtcgcaggattcaaagt

SEQ ID NO: 8608 - DNA, 20 bp, Artificial Sequence
  Artificially Synthesized Primer Sequence
agccgcatctaccattcatc

SEQ ID NO: 8609 - DNA, 20 bp, Artificial Sequence
  Artificially Synthesized Primer Sequence
aaggaactgctcttgccaaa

SEQ ID NO: 8610 - DNA, 20 bp, Artificial Sequence
  Artificially Synthesized Primer Sequence
tcctgataagttccatcgcc

SEQ ID NO: 8611 - DNA, 20 bp, Artificial Sequence
  Artificially Synthesized Primer Sequence
gaggcaaattaacccccaat

SEQ ID NO: 8612 - DNA, 20 bp, Artificial Sequence
  Artificially Synthesized Primer Sequence
aggagctgctcgatggtgta

SEQ ID NO: 8613 - DNA, 20 bp, Artificial Sequence
  Artificially Synthesized Primer Sequence
tcaggctagggctcctgata

SEQ ID NO: 8614 - DNA, 20 bp, Artificial Sequence
  Artificially Synthesized Primer Sequence
tctgcctgtgttgagaatgc

SEQ ID NO: 8615 - DNA, 20 bp, Artificial Sequence
  Artificially Synthesized Primer Sequence
ttgctttgcatccacttgag

SEQ ID NO: 8616 - DNA, 20 bp, Artificial Sequence
  Artificially Synthesized Primer Sequence
tgaaaatgctcgaactgtgg

SEQ ID NO: 8617 - DNA, 20 bp, Artificial Sequence
  Artificially Synthesized Primer Sequence
cttcctacacagcctcctcg

SEQ ID NO: 8618 - DNA, 20 bp, Artificial Sequence
  Artificially Synthesized Primer Sequence
gcgtaggcgtagtgaacaca

SEQ ID NO: 8619 - DNA, 20 bp, Artificial Sequence
  Artificially Synthesized Primer Sequence
gggcttatgcattctagcca

SEQ ID NO: 8620 - DNA, 21 bp, Artificial Sequence
  Artificially Synthesized Primer Sequence
gggcatgttgatagctagtgg

SEQ ID NO: 8621 - DNA, 20 bp, Artificial Sequence
  Artificially Synthesized Primer Sequence
gagcataccgggtaccttca

SEQ ID NO: 8622 - DNA, 20 bp, Artificial Sequence
  Artificially Synthesized Primer Sequence
caacaattgggtgggaaatc

SEQ ID NO: 8623 - DNA, 20 bp, Artificial Sequence
  Artificially Synthesized Primer Sequence
aacatctggcatacccttcg

SEQ ID NO: 8624 - DNA, 20 bp, Artificial Sequence
  Artificially Synthesized Primer Sequence
cccaaaggaggggacataat

SEQ ID NO: 8625 - DNA, 20 bp, Artificial Sequence
  Artificially Synthesized Primer Sequence
aacatggccttcaactacgg

SEQ ID NO: 8626 - DNA, 20 bp, Artificial Sequence
  Artificially Synthesized Primer Sequence
accattttgcatacttcggc

SEQ ID NO: 8627 - DNA, 20 bp, Artificial Sequence
  Artificially Synthesized Primer Sequence
atacggtaattcaccgctgc

SEQ ID NO: 8628 - DNA, 20 bp, Artificial Sequence
  Artificially Synthesized Primer Sequence
gccaagatcactccaccaat

SEQ ID NO: 8629 - DNA, 20 bp, Artificial Sequence
  Artificially Synthesized Primer Sequence
cccacctactctcgcttctg

SEQ ID NO: 8630 - DNA, 20 bp, Artificial Sequence
  Artificially Synthesized Primer Sequence
tagtcgacatttcccttggc

SEQ ID NO: 8631 - DNA, 20 bp, Artificial Sequence
  Artificially Synthesized Primer Sequence
aagcaggtcgtgagtcatca

SEQ ID NO: 8632 - DNA, 21 bp, Artificial Sequence
  Artificially Synthesized Primer Sequence
agagacaaggagagaccgagg

SEQ ID NO: 8633 - DNA, 20 bp, Artificial Sequence
  Artificially Synthesized Primer Sequence
aaggcagaagaatgcctgaa

SEQ ID NO: 8634 - DNA, 20 bp, Artificial Sequence
  Artificially Synthesized Primer Sequence
ggttcccacctttctcaaca

SEQ ID NO: 8635 - DNA, 20 bp, Artificial Sequence
  Artificially Synthesized Primer Sequence
ggggttcttccaacattcag

SEQ ID NO: 8636 - DNA, 19 bp, Artificial Sequence
  Artificially Synthesized Primer Sequence
aaaggtgggaaccccaaac

SEQ ID NO: 8637 - DNA, 20 bp, Artificial Sequence
  Artificially Synthesized Primer Sequence
accgattacgtcagtttggc

SEQ ID NO: 8638 - DNA, 20 bp, Artificial Sequence
  Artificially Synthesized Primer Sequence
caccagaagactcagtggca

SEQ ID NO: 8639 - DNA, 20 bp, Artificial Sequence
  Artificially Synthesized Primer Sequence
cacactatcagcgcatttgg

SEQ ID NO: 8640 - DNA, 20 bp, Artificial Sequence
  Artificially Synthesized Primer Sequence
tgccactgagtcttctggtg

SEQ ID NO: 8641 - DNA, 20 bp, Artificial Sequence
  Artificially Synthesized Primer Sequence
gtttcgaagtctacgctggc

SEQ ID NO: 8642 - DNA, 20 bp, Artificial Sequence
  Artificially Synthesized Primer Sequence
tctctgcggagttctggatt

SEQ ID NO: 8643 - DNA, 20 bp, Artificial Sequence
  Artificially Synthesized Primer Sequence
ctcaaaaacccgtgaagctc

SEQ ID NO: 8644 - DNA, 20 bp, Artificial Sequence
  Artificially Synthesized Primer Sequence
aaggggcactttcttggtgt

SEQ ID NO: 8645 - DNA, 20 bp, Artificial Sequence
  Artificially Synthesized Primer Sequence
accacagcgtcccatagttc

SEQ ID NO: 8646 - DNA, 20 bp, Artificial Sequence
  Artificially Synthesized Primer Sequence
tattgcgaaagttgtcgctg

SEQ ID NO: 8647 - DNA, 20 bp, Artificial Sequence
  Artificially Synthesized Primer Sequence
accagacaacctccaagcaa

SEQ ID NO: 8648 - DNA, 20 bp, Artificial Sequence
  Artificially Synthesized Primer Sequence
taagggcccaaaacaacaag

SEQ ID NO: 8649 - DNA, 20 bp, Artificial Sequence
  Artificially Synthesized Primer Sequence
cctccgtgtactaccgcttc

SEQ ID NO: 8650 - DNA, 20 bp, Artificial Sequence
  Artificially Synthesized Primer Sequence
atgtatgccatcccgaaaag

SEQ ID NO: 8651 - DNA, 20 bp, Artificial Sequence
  Artificially Synthesized Primer Sequence
tggacgtggtgagactacga

SEQ ID NO: 8652 - DNA, 20 bp, Artificial Sequence
  Artificially Synthesized Primer Sequence
taccgtatgggctcttcctg

SEQ ID NO: 8653 - DNA, 20 bp, Artificial Sequence
  Artificially Synthesized Primer Sequence
gagggagggcagtgttgtaa

SEQ ID NO: 8654 - DNA, 20 bp, Artificial Sequence
  Artificially Synthesized Primer Sequence
cttttggggttgttgatgct

SEQ ID NO: 8655 - DNA, 20 bp, Artificial Sequence
  Artificially Synthesized Primer Sequence
tagagagtccacgcgaattg

SEQ ID NO: 8656 - DNA, 20 bp, Artificial Sequence
  Artificially Synthesized Primer Sequence
gtggttacgttaggagggca

SEQ ID NO: 8657 - DNA, 20 bp, Artificial Sequence
  Artificially Synthesized Primer Sequence
gaatgtgttggacacgaacg

SEQ ID NO: 8658 - DNA, 20 bp, Artificial Sequence
  Artificially Synthesized Primer Sequence
acaatacggacaaactcggc

SEQ ID NO: 8659 - DNA, 20 bp, Artificial Sequence
  Artificially Synthesized Primer Sequence
tccagaacctgcacctcttt

SEQ ID NO: 8660 - DNA, 20 bp, Artificial Sequence
  Artificially Synthesized Primer Sequence
cgagtgaagtgctacaccga

SEQ ID NO: 8661 - DNA, 20 bp, Artificial Sequence
  Artificially Synthesized Primer Sequence
gcataagtatcgccgctctc

SEQ ID NO: 8662 - DNA, 20 bp, Artificial Sequence
  Artificially Synthesized Primer Sequence
gtcaaagctcgcatcatcaa

SEQ ID NO: 8663 - DNA, 20 bp, Artificial Sequence
  Artificially Synthesized Primer Sequence
tggttcttttccaatcgagg

SEQ ID NO: 8664 - DNA, 20 bp, Artificial Sequence
  Artificially Synthesized Primer Sequence
aagagaccctcgtcaacctg

SEQ ID NO: 8665 - DNA, 20 bp, Artificial Sequence
  Artificially Synthesized Primer Sequence
cgatcatcctccctgaccta

SEQ ID NO: 8666 - DNA, 20 bp, Artificial Sequence
  Artificially Synthesized Primer Sequence
atggagaacggatacgcaac

SEQ ID NO: 8667 - DNA, 19 bp, Artificial Sequence
  Artificially Synthesized Primer Sequence
cgaacaagtactcggagcg

SEQ ID NO: 8668 - DNA, 20 bp, Artificial Sequence
  Artificially Synthesized Primer Sequence
gatgatgtagaacaccgccc

SEQ ID NO: 8669 - DNA, 20 bp, Artificial Sequence
  Artificially Synthesized Primer Sequence
gtgatcagctcacccacaga

SEQ ID NO: 8670 - DNA, 20 bp, Artificial Sequence
  Artificially Synthesized Primer Sequence
gtgtccgggtagaggaaacc

SEQ ID NO: 8671 - DNA, 20 bp, Artificial Sequence
  Artificially Synthesized Primer Sequence
acgggttcacaacttccatt

SEQ ID NO: 8672 - DNA, 20 bp, Artificial Sequence
  Artificially Synthesized Primer Sequence
cggctccatttggatatctg

SEQ ID NO: 8673 - DNA, 20 bp, Artificial Sequence
  Artificially Synthesized Primer Sequence
ttgccctagcggaaaatatg

SEQ ID NO: 8674 - DNA, 20 bp, Artificial Sequence
  Artificially Synthesized Primer Sequence
agccgatccattgtaccaac

SEQ ID NO: 8675 - DNA, 20 bp, Artificial Sequence
  Artificially Synthesized Primer Sequence
aaccactggagcgaggacta

SEQ ID NO: 8676 - DNA, 20 bp, Artificial Sequence
  Artificially Synthesized Primer Sequence
gaatcagttccagacgctcc

SEQ ID NO: 8677 - DNA, 20 bp, Artificial Sequence
  Artificially Synthesized Primer Sequence
gtgtgtgtggacagtgggag

SEQ ID NO: 8678 - DNA, 20 bp, Artificial Sequence
  Artificially Synthesized Primer Sequence
ccattttcgtcggttgagtt

SEQ ID NO: 8679 - DNA, 20 bp, Artificial Sequence
  Artificially Synthesized Primer Sequence
aacagtgttcgttccgttcc

SEQ ID NO: 8680 - DNA, 20 bp, Artificial Sequence
  Artificially Synthesized Primer Sequence
agatccgtggtgtagggttg

SEQ ID NO: 8681 - DNA, 20 bp, Artificial Sequence
  Artificially Synthesized Primer Sequence
gcccttttcttctccgtttg

SEQ ID NO: 8682 - DNA, 20 bp, Artificial Sequence
  Artificially Synthesized Primer Sequence
ctctggttccattgatgcct

SEQ ID NO: 8683 - DNA, 20 bp, Artificial Sequence
  Artificially Synthesized Primer Sequence
cagcttttgcagccatgtta

SEQ ID NO: 8684 - DNA, 20 bp, Artificial Sequence
  Artificially Synthesized Primer Sequence
ctatggctgaaccatgagca

SEQ ID NO: 8685 - DNA, 20 bp, Artificial Sequence
  Artificially Synthesized Primer Sequence
gctaacctagcctcctccgt

SEQ ID NO: 8686 - DNA, 20 bp, Artificial Sequence
  Artificially Synthesized Primer Sequence
gtttgcctagaagcagccac

SEQ ID NO: 8687 - DNA, 20 bp, Artificial Sequence
  Artificially Synthesized Primer Sequence
agcagcgggtactcatgtct

SEQ ID NO: 8688 - DNA, 20 bp, Artificial Sequence
  Artificially Synthesized Primer Sequence
acagaagctcggaaggttca

SEQ ID NO: 8689 - DNA, 20 bp, Artificial Sequence
  Artificially Synthesized Primer Sequence
ggagctgaacaaagcaaagc

SEQ ID NO: 8690 - DNA, 20 bp, Artificial Sequence
  Artificially Synthesized Primer Sequence
gttgtccagtgggagcttgt

SEQ ID NO: 8691 - DNA, 20 bp, Artificial Sequence
  Artificially Synthesized Primer Sequence
gacacaggacctgaagcaca

SEQ ID NO: 8692 - DNA, 20 bp, Artificial Sequence
  Artificially Synthesized Primer Sequence
cggcaggctctactatgagg

SEQ ID NO: 8693 - DNA, 20 bp, Artificial Sequence
  Artificially Synthesized Primer Sequence
cacgtgctgtccgacatact

SEQ ID NO: 8694 - DNA, 20 bp, Artificial Sequence
  Artificially Synthesized Primer Sequence
ccatcaaaggtgttctccgt

SEQ ID NO: 8695 - DNA, 20 bp, Artificial Sequence
  Artificially Synthesized Primer Sequence
tataagcacccccgtctcag

SEQ ID NO: 8696 - DNA, 20 bp, Artificial Sequence
  Artificially Synthesized Primer Sequence
gtccccaaggaacacaaaga

SEQ ID NO: 8697 - DNA, 20 bp, Artificial Sequence
  Artificially Synthesized Primer Sequence
gctatcggatccacaccaac

SEQ ID NO: 8698 - DNA, 20 bp, Artificial Sequence
  Artificially Synthesized Primer Sequence
ggtggctcaagaaacactgg

SEQ ID NO: 8699 - DNA, 20 bp, Artificial Sequence
  Artificially Synthesized Primer Sequence
ggcagaaccagcaatacgtt

SEQ ID NO: 8700 - DNA, 20 bp, Artificial Sequence
  Artificially Synthesized Primer Sequence
gacttcagcaacttcccgac

SEQ ID NO: 8701 - DNA, 20 bp, Artificial Sequence
  Artificially Synthesized Primer Sequence
tgaatcaagtcgcaaacagc

SEQ ID NO: 8702 - DNA, 20 bp, Artificial Sequence
  Artificially Synthesized Primer Sequence
aagtcggagcagcatcagtt

SEQ ID NO: 8703 - DNA, 20 bp, Artificial Sequence
  Artificially Synthesized Primer Sequence
tgtgcaacactgcttcttcc

SEQ ID NO: 8704 - DNA, 20 bp, Artificial Sequence
  Artificially Synthesized Primer Sequence
gcctgaagcttgagcagttc

SEQ ID NO: 8705 - DNA, 20 bp, Artificial Sequence
  Artificially Synthesized Primer Sequence
tgctgcaagagaagaagcaa

SEQ ID NO: 8706 - DNA, 20 bp, Artificial Sequence
  Artificially Synthesized Primer Sequence
atatccgggcatagcatcag

SEQ ID NO: 8707 - DNA, 20 bp, Artificial Sequence
  Artificially Synthesized Primer Sequence
gaaaatcagggggctttctc

SEQ ID NO: 8708 - DNA, 20 bp, Artificial Sequence
  Artificially Synthesized Primer Sequence
cgccttccacttatgatggt

SEQ ID NO: 8709 - DNA, 20 bp, Artificial Sequence
  Artificially Synthesized Primer Sequence
gcctggtacagttcaccgtt

SEQ ID NO: 8710 - DNA, 20 bp, Artificial Sequence
  Artificially Synthesized Primer Sequence
gcttatggcttctgctggac

SEQ ID NO: 8711 - DNA, 20 bp, Artificial Sequence
  Artificially Synthesized Primer Sequence
acgactgaccctcctcttca

SEQ ID NO: 8712 - DNA, 20 bp, Artificial Sequence
  Artificially Synthesized Primer Sequence
ctcgtcgtggaaattgtcag

SEQ ID NO: 8713 - DNA, 20 bp, Artificial Sequence
  Artificially Synthesized Primer Sequence
ttactgttccctgggattgg

SEQ ID NO: 8714 - DNA, 20 bp, Artificial Sequence
  Artificially Synthesized Primer Sequence
tcacttaggccgactttcgt

SEQ ID NO: 8715 - DNA, 20 bp, Artificial Sequence
  Artificially Synthesized Primer Sequence
cacacccaacaccacaactc

SEQ ID NO: 8716 - DNA, 20 bp, Artificial Sequence
  Artificially Synthesized Primer Sequence
ccgcatcaaggtaagttcgt

SEQ ID NO: 8717 - DNA, 20 bp, Artificial Sequence
  Artificially Synthesized Primer Sequence
gtgtgagttgtggtgttggg

SEQ ID NO: 8718 - DNA, 20 bp, Artificial Sequence
  Artificially Synthesized Primer Sequence
atcgggattgtggtgatgat

SEQ ID NO: 8719 - DNA, 20 bp, Artificial Sequence
  Artificially Synthesized Primer Sequence
acccaacaccacaactcaca

SEQ ID NO: 8720 - DNA, 20 bp, Artificial Sequence
  Artificially Synthesized Primer Sequence
cttaacgtcagcctcgtgct

SEQ ID NO: 8721 - DNA, 20 bp, Artificial Sequence
  Artificially Synthesized Primer Sequence
ctcaacatttgccgtctgaa

SEQ ID NO: 8722 - DNA, 20 bp, Artificial Sequence
  Artificially Synthesized Primer Sequence
ttggatcggagggagtatca

SEQ ID NO: 8723 - DNA, 20 bp, Artificial Sequence
  Artificially Synthesized Primer Sequence
ttagattggatcggagggag

SEQ ID NO: 8724 - DNA, 20 bp, Artificial Sequence
  Artificially Synthesized Primer Sequence
catttgccgtctgaacattg

SEQ ID NO: 8725 - DNA, 20 bp, Artificial Sequence
  Artificially Synthesized Primer Sequence
ctttttgggactgccatgtt

SEQ ID NO: 8726 - DNA, 20 bp, Artificial Sequence
  Artificially Synthesized Primer Sequence
aagctgcagggccatatcta

SEQ ID NO: 8727 - DNA, 20 bp, Artificial Sequence
  Artificially Synthesized Primer Sequence
tatgtttcggcaccgtacaa

SEQ ID NO: 8728 - DNA, 20 bp, Artificial Sequence
  Artificially Synthesized Primer Sequence
cccatagtcaaagccaggaa

SEQ ID NO: 8729 - DNA, 20 bp, Artificial Sequence
  Artificially Synthesized Primer Sequence
catggtgatggactactgcg

SEQ ID NO: 8730 - DNA, 20 bp, Artificial Sequence
  Artificially Synthesized Primer Sequence
ttgctacgcctacacgtcac

SEQ ID NO: 8731 - DNA, 20 bp, Artificial Sequence
  Artificially Synthesized Primer Sequence
agtgagacgacctagcaggc

SEQ ID NO: 8732 - DNA, 20 bp, Artificial Sequence
  Artificially Synthesized Primer Sequence
catggtgatggactactgcg

SEQ ID NO: 8733 - DNA, 20 bp, Artificial Sequence
  Artificially Synthesized Primer Sequence
tgttggcctactggaaaagg

SEQ ID NO: 8734 - DNA, 20 bp, Artificial Sequence
  Artificially Synthesized Primer Sequence
gttatcgggggtaattccgt

SEQ ID NO: 8735 - DNA, 20 bp, Artificial Sequence
  Artificially Synthesized Primer Sequence
cagcaacattgcaggaaaga

SEQ ID NO: 8736 - DNA, 19 bp, Artificial Sequence
  Artificially Synthesized Primer Sequence
gagtcaccaaagtgggcag

SEQ ID NO: 8737 - DNA, 20 bp, Artificial Sequence
  Artificially Synthesized Primer Sequence
ctgggaggtggtgtattgct

SEQ ID NO: 8738 - DNA, 20 bp, Artificial Sequence
  Artificially Synthesized Primer Sequence
gtgccatacgtgcctaacct

SEQ ID NO: 8739 - DNA, 20 bp, Artificial Sequence
  Artificially Synthesized Primer Sequence
gcgtcgagcacatgaaagta

SEQ ID NO: 8740 - DNA, 20 bp, Artificial Sequence
  Artificially Synthesized Primer Sequence
gaggtggtgtattgctcggt

SEQ ID NO: 8741 - DNA, 20 bp, Artificial Sequence
  Artificially Synthesized Primer Sequence
ccagttcttctggtgggtgt

SEQ ID NO: 8742 - DNA, 20 bp, Artificial Sequence
  Artificially Synthesized Primer Sequence
ccagtaccgcttgagtctcc

SEQ ID NO: 8743 - DNA, 20 bp, Artificial Sequence
  Artificially Synthesized Primer Sequence
ccactggaccttgtgaactg

SEQ ID NO: 8744 - DNA, 20 bp, Artificial Sequence
  Artificially Synthesized Primer Sequence
cgctgtacaagtgcctgaaa

SEQ ID NO: 8745 - DNA, 20 bp, Artificial Sequence
  Artificially Synthesized Primer Sequence
agtgacaaggaccaacgacc

SEQ ID NO: 8746 - DNA, 20 bp, Artificial Sequence
  Artificially Synthesized Primer Sequence
gcttgtgtcttccctaagcg

SEQ ID NO: 8747 - DNA, 20 bp, Artificial Sequence
  Artificially Synthesized Primer Sequence
gtcggccagatctttgtagc

SEQ ID NO: 8748 - DNA, 20 bp, Artificial Sequence
  Artificially Synthesized Primer Sequence
gtgcccagttcatcacattg

SEQ ID NO: 8749 - DNA, 20 bp, Artificial Sequence
  Artificially Synthesized Primer Sequence
gatggaggctgatttccaga

SEQ ID NO: 8750 - DNA, 20 bp, Artificial Sequence
  Artificially Synthesized Primer Sequence
ccgcgtttgaaagaagaaag

SEQ ID NO: 8751 - DNA, 20 bp, Artificial Sequence
  Artificially Synthesized Primer Sequence
cataatatgcagggccgact

SEQ ID NO: 8752 - DNA, 20 bp, Artificial Sequence
  Artificially Synthesized Primer Sequence
aattgtaaatgctgccaggg

SEQ ID NO: 8753 - DNA, 20 bp, Artificial Sequence
  Artificially Synthesized Primer Sequence
cgaggaaggacagcaagaac

SEQ ID NO: 8754 - DNA, 20 bp, Artificial Sequence
  Artificially Synthesized Primer Sequence
tcaggagcccagctaacact

SEQ ID NO: 8755 - DNA, 20 bp, Artificial Sequence
  Artificially Synthesized Primer Sequence
gagcatcaggagtcccaaac

SEQ ID NO: 8756 - DNA, 20 bp, Artificial Sequence
  Artificially Synthesized Primer Sequence
gaccactcagctgctgtgaa

SEQ ID NO: 8757 - DNA, 20 bp, Artificial Sequence
  Artificially Synthesized Primer Sequence
agcccacaacacttcctcag

SEQ ID NO: 8758 - DNA, 20 bp, Artificial Sequence
  Artificially Synthesized Primer Sequence
cagcacatgcacacaagatg

SEQ ID NO: 8759 - DNA, 20 bp, Artificial Sequence
  Artificially Synthesized Primer Sequence
ttgaggaacgtggacatgag

SEQ ID NO: 8760 - DNA, 20 bp, Artificial Sequence
  Artificially Synthesized Primer Sequence
agctagcaatggcgaagtgt

SEQ ID NO: 8761 - DNA, 20 bp, Artificial Sequence
  Artificially Synthesized Primer Sequence
ttgagaaggcttcgaaagga

SEQ ID NO: 8762 - DNA, 20 bp, Artificial Sequence
  Artificially Synthesized Primer Sequence
ctaatctaaagccgcaaccg

SEQ ID NO: 8763 - DNA, 20 bp, Artificial Sequence
  Artificially Synthesized Primer Sequence
ttgattgtgcttcttgctgg

SEQ ID NO: 8764 - DNA, 20 bp, Artificial Sequence
  Artificially Synthesized Primer Sequence
gataagtgcaatgccgtcaa

SEQ ID NO: 8765 - DNA, 20 bp, Artificial Sequence
  Artificially Synthesized Primer Sequence
tcgtcccttgatgtggtaca

SEQ ID NO: 8766 - DNA, 20 bp, Artificial Sequence
  Artificially Synthesized Primer Sequence
gtagaggctctcgcgaaaaa

SEQ ID NO: 8767 - DNA, 20 bp, Artificial Sequence
  Artificially Synthesized Primer Sequence
tgtaccacatcaagggacga

SEQ ID NO: 8768 - DNA, 20 bp, Artificial Sequence
  Artificially Synthesized Primer Sequence
gagctgaaccagaaggacca

SEQ ID NO: 8769 - DNA, 20 bp, Artificial Sequence
  Artificially Synthesized Primer Sequence
gtgcaagtgggtgactctga

SEQ ID NO: 8770 - DNA, 20 bp, Artificial Sequence
  Artificially Synthesized Primer Sequence
caattgctctggcagtttga

SEQ ID NO: 8771 - DNA, 20 bp, Artificial Sequence
  Artificially Synthesized Primer Sequence
gcaaatccccaaaagtgaga

SEQ ID NO: 8772 - DNA, 20 bp, Artificial Sequence
  Artificially Synthesized Primer Sequence
cgcctcttcattgccattat

SEQ ID NO: 8773 - DNA, 20 bp, Artificial Sequence
  Artificially Synthesized Primer Sequence
gggagccatctatgtcgtgt

SEQ ID NO: 8774 - DNA, 20 bp, Artificial Sequence
  Artificially Synthesized Primer Sequence
ctcccacccaaaagagaaca

SEQ ID NO: 8775 - DNA, 20 bp, Artificial Sequence
  Artificially Synthesized Primer Sequence
cttggagtttttcagtgccc

SEQ ID NO: 8776 - DNA, 20 bp, Artificial Sequence
  Artificially Synthesized Primer Sequence
gggtggacaagctgctgtat

SEQ ID NO: 8777 - DNA, 20 bp, Artificial Sequence
  Artificially Synthesized Primer Sequence
tgtgatcgttgagaaggctg

SEQ ID NO: 8778 - DNA, 20 bp, Artificial Sequence
  Artificially Synthesized Primer Sequence
aagatcctacgacgaggcaa

SEQ ID NO: 8779 - DNA, 20 bp, Artificial Sequence
  Artificially Synthesized Primer Sequence
agatcctacgacgaggcaaa

SEQ ID NO: 8780 - DNA, 20 bp, Artificial Sequence
  Artificially Synthesized Primer Sequence
tgtgatcgttgagaaggctg

SEQ ID NO: 8781 - DNA, 20 bp, Artificial Sequence
  Artificially Synthesized Primer Sequence
tggcatgttactgaagcagc

SEQ ID NO: 8782 - DNA, 20 bp, Artificial Sequence
  Artificially Synthesized Primer Sequence
tggagatgatgaaaaagggc

SEQ ID NO: 8783 - DNA, 20 bp, Artificial Sequence
  Artificially Synthesized Primer Sequence
atccatgctttcatccttgg

SEQ ID NO: 8784 - DNA, 20 bp, Artificial Sequence
  Artificially Synthesized Primer Sequence
atcgagctactgacgaggga

SEQ ID NO: 8785 - DNA, 20 bp, Artificial Sequence
  Artificially Synthesized Primer Sequence
cacccacacccactcttctt

SEQ ID NO: 8786 - DNA, 20 bp, Artificial Sequence
  Artificially Synthesized Primer Sequence
agatgatgatgtgatggcga

SEQ ID NO: 8787 - DNA, 20 bp, Artificial Sequence
  Artificially Synthesized Primer Sequence
cacccacacccactcttctt

SEQ ID NO: 8788 - DNA, 20 bp, Artificial Sequence
  Artificially Synthesized Primer Sequence
gagagcagcaaaaggaacca

SEQ ID NO: 8789 - DNA, 20 bp, Artificial Sequence
  Artificially Synthesized Primer Sequence
gctgcacttgtgtcttggaa

SEQ ID NO: 8790 - DNA, 20 bp, Artificial Sequence
  Artificially Synthesized Primer Sequence
tcgaagcccagactgaaagt

SEQ ID NO: 8791 - DNA, 20 bp, Artificial Sequence
  Artificially Synthesized Primer Sequence
cacagattaaccagcagcca

SEQ ID NO: 8792 - DNA, 20 bp, Artificial Sequence
  Artificially Synthesized Primer Sequence
agcactgtgagtgtgatggg

SEQ ID NO: 8793 - DNA, 20 bp, Artificial Sequence
  Artificially Synthesized Primer Sequence
tttgttgaatccttggctcc

SEQ ID NO: 8794 - DNA, 20 bp, Artificial Sequence
  Artificially Synthesized Primer Sequence
tgccaacagaccgagtacag

SEQ ID NO: 8795 - DNA, 20 bp, Artificial Sequence
  Artificially Synthesized Primer Sequence
agaactcggctccatgattg

SEQ ID NO: 8796 - DNA, 20 bp, Artificial Sequence
  Artificially Synthesized Primer Sequence
gggggtgtagccgtatatca

SEQ ID NO: 8797 - DNA, 20 bp, Artificial Sequence
  Artificially Synthesized Primer Sequence
cctcttgcccctctctttct

SEQ ID NO: 8798 - DNA, 20 bp, Artificial Sequence
  Artificially Synthesized Primer Sequence
gaaagggaaaaacggaaacg

SEQ ID NO: 8799 - DNA, 20 bp, Artificial Sequence
  Artificially Synthesized Primer Sequence
ttcagagacgggaatccttg

SEQ ID NO: 8800 - DNA, 20 bp, Artificial Sequence
  Artificially Synthesized Primer Sequence
tcaggaagaaggagaaggca

SEQ ID NO: 8801 - DNA, 20 bp, Artificial Sequence
  Artificially Synthesized Primer Sequence
tataccgattgccgagttcc

SEQ ID NO: 8802 - DNA, 20 bp, Artificial Sequence
  Artificially Synthesized Primer Sequence
acccataaatccatccgaca

SEQ ID NO: 8803 - DNA, 20 bp, Artificial Sequence
  Artificially Synthesized Primer Sequence
gaacatggacatgagcgaaa

SEQ ID NO: 8804 - DNA, 20 bp, Artificial Sequence
  Artificially Synthesized Primer Sequence
cttctcagtgagcaatggca

SEQ ID NO: 8805 - DNA, 20 bp, Artificial Sequence
  Artificially Synthesized Primer Sequence
ggaaagaacggtcctgtgaa

SEQ ID NO: 8806 - DNA, 20 bp, Artificial Sequence
  Artificially Synthesized Primer Sequence
ttttccattcgaagaccctg

SEQ ID NO: 8807 - DNA, 20 bp, Artificial Sequence
  Artificially Synthesized Primer Sequence
tataccagcgctgcactttg

SEQ ID NO: 8808 - DNA, 20 bp, Artificial Sequence
  Artificially Synthesized Primer Sequence
acccaaacgcaaacagactc

SEQ ID NO: 8809 - DNA, 20 bp, Artificial Sequence
  Artificially Synthesized Primer Sequence
tgcttacaaccaaactcccc

SEQ ID NO: 8810 - DNA, 20 bp, Artificial Sequence
  Artificially Synthesized Primer Sequence
agctctgttctccccctagc

SEQ ID NO: 8811 - DNA, 20 bp, Artificial Sequence
  Artificially Synthesized Primer Sequence
tctcgtaggccgtagctcat

SEQ ID NO: 8812 - DNA, 20 bp, Artificial Sequence
  Artificially Synthesized Primer Sequence
gaagttcagggagctggaca

SEQ ID NO: 8813 - DNA, 20 bp, Artificial Sequence
  Artificially Synthesized Primer Sequence
tcaggtgcagacaagaccag

SEQ ID NO: 8814 - DNA, 20 bp, Artificial Sequence
  Artificially Synthesized Primer Sequence
tcagcgacttttgtggtacg

SEQ ID NO: 8815 - DNA, 20 bp, Artificial Sequence
  Artificially Synthesized Primer Sequence
ttgatccgacaacatcgaaa

SEQ ID NO: 8816 - DNA, 20 bp, Artificial Sequence
  Artificially Synthesized Primer Sequence
gagctggaatcccttcaaca

SEQ ID NO: 8817 - DNA, 20 bp, Artificial Sequence
  Artificially Synthesized Primer Sequence
tgctgttgtaaggcaggttg

SEQ ID NO: 8818 - DNA, 20 bp, Artificial Sequence
  Artificially Synthesized Primer Sequence
ctgatatgcatgtgatcgcc

SEQ ID NO: 8819 - DNA, 20 bp, Artificial Sequence
  Artificially Synthesized Primer Sequence
ggctcaggctctaacattgg

SEQ ID NO: 8820 - DNA, 20 bp, Artificial Sequence
  Artificially Synthesized Primer Sequence
atgtttggcaaggagtaccg

SEQ ID NO: 8821 - DNA, 20 bp, Artificial Sequence
  Artificially Synthesized Primer Sequence
taagtgggggacatcaaagc

SEQ ID NO: 8822 - DNA, 20 bp, Artificial Sequence
  Artificially Synthesized Primer Sequence
atggacaccttcctggactg

SEQ ID NO: 8823 - DNA, 21 bp, Artificial Sequence
  Artificially Synthesized Primer Sequence
tccatggcgtttacttttctg

SEQ ID NO: 8824 - DNA, 21 bp, Artificial Sequence
  Artificially Synthesized Primer Sequence
gaatgtctaggtctctccggc

SEQ ID NO: 8825 - DNA, 20 bp, Artificial Sequence
  Artificially Synthesized Primer Sequence
aattttccaaagccatgctg

SEQ ID NO: 8826 - DNA, 20 bp, Artificial Sequence
  Artificially Synthesized Primer Sequence
tgccagttgcaagtgagaac

SEQ ID NO: 8827 - DNA, 20 bp, Artificial Sequence
  Artificially Synthesized Primer Sequence
ataatgcaatgtcgccatca

SEQ ID NO: 8828 - DNA, 20 bp, Artificial Sequence
  Artificially Synthesized Primer Sequence
agtgaacgaagcgacaggtt

SEQ ID NO: 8829 - DNA, 20 bp, Artificial Sequence
  Artificially Synthesized Primer Sequence
ggagaggacacgagaagcac

SEQ ID NO: 8830 - DNA, 20 bp, Artificial Sequence
  Artificially Synthesized Primer Sequence
tatactcgtccggagaaccg

SEQ ID NO: 8831 - DNA, 20 bp, Artificial Sequence
  Artificially Synthesized Primer Sequence
caagacacaacccaaaagca

SEQ ID NO: 8832 - DNA, 20 bp, Artificial Sequence
  Artificially Synthesized Primer Sequence
gatagcgtccaaggacaagg

SEQ ID NO: 8833 - DNA, 20 bp, Artificial Sequence
  Artificially Synthesized Primer Sequence
acctgaaccaatgtacccca

SEQ ID NO: 8834 - DNA, 20 bp, Artificial Sequence
  Artificially Synthesized Primer Sequence
acgcattcgctcatctttct

SEQ ID NO: 8835 - DNA, 20 bp, Artificial Sequence
  Artificially Synthesized Primer Sequence
tgacttctttcgggcactct

SEQ ID NO: 8836 - DNA, 20 bp, Artificial Sequence
  Artificially Synthesized Primer Sequence
cagccacatctcagactcca

SEQ ID NO: 8837 - DNA, 20 bp, Artificial Sequence
  Artificially Synthesized Primer Sequence
agatcatgcaccacctctcc

SEQ ID NO: 8838 - DNA, 20 bp, Artificial Sequence
  Artificially Synthesized Primer Sequence
tttttgcacagcacttctgg

SEQ ID NO: 8839 - DNA, 20 bp, Artificial Sequence
  Artificially Synthesized Primer Sequence
acacacatccacacaggcat

SEQ ID NO: 8840 - DNA, 20 bp, Artificial Sequence
  Artificially Synthesized Primer Sequence
taaactggagcgtgaggagc

SEQ ID NO: 8841 - DNA, 20 bp, Artificial Sequence
  Artificially Synthesized Primer Sequence
taactcggactcggacaacc

SEQ ID NO: 8842 - DNA, 20 bp, Artificial Sequence
  Artificially Synthesized Primer Sequence
gggagaggcgaataggaaac

SEQ ID NO: 8843 - DNA, 20 bp, Artificial Sequence
  Artificially Synthesized Primer Sequence
acgacatagctgggttgtcc

SEQ ID NO: 8844 - DNA, 20 bp, Artificial Sequence
  Artificially Synthesized Primer Sequence
acgaggtcaagagccatttg

SEQ ID NO: 8845 - DNA, 20 bp, Artificial Sequence
  Artificially Synthesized Primer Sequence
tctcatgttatgctcctgcg

SEQ ID NO: 8846 - DNA, 20 bp, Artificial Sequence
  Artificially Synthesized Primer Sequence
catgatttggcacacgaaac

SEQ ID NO: 8847 - DNA, 20 bp, Artificial Sequence
  Artificially Synthesized Primer Sequence
tctttcaaggagcagcgatt

SEQ ID NO: 8848 - DNA, 20 bp, Artificial Sequence
  Artificially Synthesized Primer Sequence
taaatcagcacacccaccaa

SEQ ID NO: 8849 - DNA, 20 bp, Artificial Sequence
  Artificially Synthesized Primer Sequence
aagacgctgtcggtgtacct

SEQ ID NO: 8850 - DNA, 20 bp, Artificial Sequence
  Artificially Synthesized Primer Sequence
ccattgcctgtgtgtttcac

SEQ ID NO: 8851 - DNA, 20 bp, Artificial Sequence
  Artificially Synthesized Primer Sequence
acaggagggaggaaccctta

SEQ ID NO: 8852 - DNA, 20 bp, Artificial Sequence
  Artificially Synthesized Primer Sequence
tcaactctaattgggtgggc

SEQ ID NO: 8853 - DNA, 20 bp, Artificial Sequence
  Artificially Synthesized Primer Sequence
atttctccgatccttcggtt

SEQ ID NO: 8854 - DNA, 20 bp, Artificial Sequence
  Artificially Synthesized Primer Sequence
tgaaacgatcctgtgtgagc

SEQ ID NO: 8855 - DNA, 20 bp, Artificial Sequence
  Artificially Synthesized Primer Sequence
gatggtcacagccatcagtg

SEQ ID NO: 8856 - DNA, 20 bp, Artificial Sequence
  Artificially Synthesized Primer Sequence
gccttggttaaggatggtga

SEQ ID NO: 8857 - DNA, 20 bp, Artificial Sequence
  Artificially Synthesized Primer Sequence
gacaatgcgttcaaagggtt

SEQ ID NO: 8858 - DNA, 20 bp, Artificial Sequence
  Artificially Synthesized Primer Sequence
aggacgggacacacaagaac

SEQ ID NO: 8859 - DNA, 20 bp, Artificial Sequence
  Artificially Synthesized Primer Sequence
atgaggcgatcaaaatcagg

SEQ ID NO: 8860 - DNA, 20 bp, Artificial Sequence
  Artificially Synthesized Primer Sequence
caagatccctgttgggaaga

SEQ ID NO: 8861 - DNA, 20 bp, Artificial Sequence
  Artificially Synthesized Primer Sequence
tgaatcactctcacaagccg

SEQ ID NO: 8862 - DNA, 20 bp, Artificial Sequence
  Artificially Synthesized Primer Sequence
aacctttaccggcagttcct

SEQ ID NO: 8863 - DNA, 20 bp, Artificial Sequence
  Artificially Synthesized Primer Sequence
ggaaggcaatggataccaaa

SEQ ID NO: 8864 - DNA, 20 bp, Artificial Sequence
  Artificially Synthesized Primer Sequence
cctgcatgttccagaggttt

SEQ ID NO: 8865 - DNA, 20 bp, Artificial Sequence
  Artificially Synthesized Primer Sequence
ccgacatgctcttcctcttc

SEQ ID NO: 8866 - DNA, 20 bp, Artificial Sequence
  Artificially Synthesized Primer Sequence
gtttcagggactacggcaaa

SEQ ID NO: 8867 - DNA, 20 bp, Artificial Sequence
  Artificially Synthesized Primer Sequence
tcacacgccctactctcctc

SEQ ID NO: 8868 - DNA, 19 bp, Artificial Sequence
  Artificially Synthesized Primer Sequence
gtcacgtccctgtccatga

SEQ ID NO: 8869 - DNA, 20 bp, Artificial Sequence
  Artificially Synthesized Primer Sequence
ggccgtacaagaaaggatca

SEQ ID NO: 8870 - DNA, 20 bp, Artificial Sequence
  Artificially Synthesized Primer Sequence
aacaagagaacggcaggcta

SEQ ID NO: 8871 - DNA, 20 bp, Artificial Sequence
  Artificially Synthesized Primer Sequence
gggcattgcagaacaagttt

SEQ ID NO: 8872 - DNA, 20 bp, Artificial Sequence
  Artificially Synthesized Primer Sequence
gcggtttggtgagagagaag

SEQ ID NO: 8873 - DNA, 20 bp, Artificial Sequence
  Artificially Synthesized Primer Sequence
cccttagccaaaaatgcaaa

SEQ ID NO: 8874 - DNA, 20 bp, Artificial Sequence
  Artificially Synthesized Primer Sequence
tggctcaataaccaagggtc

SEQ ID NO: 8875 - DNA, 20 bp, Artificial Sequence
  Artificially Synthesized Primer Sequence
tatggccaccaaatctgtca

SEQ ID NO: 8876 - DNA, 20 bp, Artificial Sequence
  Artificially Synthesized Primer Sequence
ttccctatgcagaagggttg

SEQ ID NO: 8877 - DNA, 20 bp, Artificial Sequence
  Artificially Synthesized Primer Sequence
cgcatctgcaagttagtcca

SEQ ID NO: 8878 - DNA, 20 bp, Artificial Sequence
  Artificially Synthesized Primer Sequence
tgtggtaaagatggaagccc

SEQ ID NO: 8879 - DNA, 20 bp, Artificial Sequence
  Artificially Synthesized Primer Sequence
ttccactgctgtgtgatggt

SEQ ID NO: 8880 - DNA, 20 bp, Artificial Sequence
  Artificially Synthesized Primer Sequence
caattcgaggatggcaactt

SEQ ID NO: 8881 - DNA, 20 bp, Artificial Sequence
  Artificially Synthesized Primer Sequence
aattcctcgagcactgttgg

SEQ ID NO: 8882 - DNA, 20 bp, Artificial Sequence
  Artificially Synthesized Primer Sequence
tctatcaagctgtgcgatgg

SEQ ID NO: 8883 - DNA, 20 bp, Artificial Sequence
  Artificially Synthesized Primer Sequence
ggcgtgattcaacattcaaa

SEQ ID NO: 8884 - DNA, 20 bp, Artificial Sequence
  Artificially Synthesized Primer Sequence
gaacagtagcgcacaagcaa

SEQ ID NO: 8885 - DNA, 20 bp, Artificial Sequence
  Artificially Synthesized Primer Sequence
ggcccccttttggaataata

SEQ ID NO: 8886 - DNA, 20 bp, Artificial Sequence
  Artificially Synthesized Primer Sequence
ccctttaaagtcccccaaag

SEQ ID NO: 8887 - DNA, 20 bp, Artificial Sequence
  Artificially Synthesized Primer Sequence
aagaaaacaaacgcatggct

SEQ ID NO: 8888 - DNA, 20 bp, Artificial Sequence
  Artificially Synthesized Primer Sequence
caaggagaaggagaacgacg

SEQ ID NO: 8889 - DNA, 20 bp, Artificial Sequence
  Artificially Synthesized Primer Sequence
ggtccggtgttcagactgtt

SEQ ID NO: 8890 - DNA, 20 bp, Artificial Sequence
  Artificially Synthesized Primer Sequence
gcaccctggtactgtcgttt

SEQ ID NO: 8891 - DNA, 20 bp, Artificial Sequence
  Artificially Synthesized Primer Sequence
gggcatgcgtgctatacttt

SEQ ID NO: 8892 - DNA, 20 bp, Artificial Sequence
  Artificially Synthesized Primer Sequence
tacgtgttcaacaacggcac

SEQ ID NO: 8893 - DNA, 20 bp, Artificial Sequence
  Artificially Synthesized Primer Sequence
cgacttctggactccctttg

SEQ ID NO: 8894 - DNA, 20 bp, Artificial Sequence
  Artificially Synthesized Primer Sequence
tgatgcaagcctaacaacca

SEQ ID NO: 8895 - DNA, 20 bp, Artificial Sequence
  Artificially Synthesized Primer Sequence
aaccaatcatacgaacccga

SEQ ID NO: 8896 - DNA, 20 bp, Artificial Sequence
  Artificially Synthesized Primer Sequence
cgacttctggactccctttg

SEQ ID NO: 8897 - DNA, 20 bp, Artificial Sequence
  Artificially Synthesized Primer Sequence
tcgactacatcgaggggttc

SEQ ID NO: 8898 - DNA, 20 bp, Artificial Sequence
  Artificially Synthesized Primer Sequence
ctttgaggatcttgccgaag

SEQ ID NO: 8899 - DNA, 20 bp, Artificial Sequence
  Artificially Synthesized Primer Sequence
aatggaactacgacggatcg

SEQ ID NO: 8900 - DNA, 20 bp, Artificial Sequence
  Artificially Synthesized Primer Sequence
tctgatatgtcacggccaaa

SEQ ID NO: 8901 - DNA, 20 bp, Artificial Sequence
  Artificially Synthesized Primer Sequence
ggtcatgcagaggtggattt

SEQ ID NO: 8902 - DNA, 20 bp, Artificial Sequence
  Artificially Synthesized Primer Sequence
cgtcattcccatcttttgct

SEQ ID NO: 8903 - DNA, 20 bp, Artificial Sequence
  Artificially Synthesized Primer Sequence
cagcatgtcacgacgaaact

SEQ ID NO: 8904 - DNA, 20 bp, Artificial Sequence
  Artificially Synthesized Primer Sequence
gagatccagaactccggtca

SEQ ID NO: 8905 - DNA, 20 bp, Artificial Sequence
  Artificially Synthesized Primer Sequence
gttggcctactggacgtcat

SEQ ID NO: 8906 - DNA, 20 bp, Artificial Sequence
  Artificially Synthesized Primer Sequence
tgtcgtagtcgatgtagccg

SEQ ID NO: 8907 - DNA, 20 bp, Artificial Sequence
  Artificially Synthesized Primer Sequence
actcgacattccatgatccc

SEQ ID NO: 8908 - DNA, 20 bp, Artificial Sequence
  Artificially Synthesized Primer Sequence
gaacatccagaaggagcacg

SEQ ID NO: 8909 - DNA, 20 bp, Artificial Sequence
  Artificially Synthesized Primer Sequence
tggcatccgcttcatacata

SEQ ID NO: 8910 - DNA, 20 bp, Artificial Sequence
  Artificially Synthesized Primer Sequence
atgaggttattcccccaagg

SEQ ID NO: 8911 - DNA, 20 bp, Artificial Sequence
  Artificially Synthesized Primer Sequence
cagcaagtaccgcaagatga

SEQ ID NO: 8912 - DNA, 20 bp, Artificial Sequence
  Artificially Synthesized Primer Sequence
tcctccaaggtgaggatctg

SEQ ID NO: 8913 - DNA, 20 bp, Artificial Sequence
  Artificially Synthesized Primer Sequence
gtttgcctagaagcagccac

SEQ ID NO: 8914 - DNA, 20 bp, Artificial Sequence
  Artificially Synthesized Primer Sequence
gctaacctagcctcctccgt

SEQ ID NO: 8915 - DNA, 20 bp, Artificial Sequence
  Artificially Synthesized Primer Sequence
ggttttgtcgttgacctcgt

SEQ ID NO: 8916 - DNA, 20 bp, Artificial Sequence
  Artificially Synthesized Primer Sequence
cccactgaaccacgagattt

SEQ ID NO: 8917 - DNA, 20 bp, Artificial Sequence
  Artificially Synthesized Primer Sequence
gaggtgtgaggagtcgaagc

SEQ ID NO: 8918 - DNA, 20 bp, Artificial Sequence
  Artificially Synthesized Primer Sequence
catccgctgaagcatactga

SEQ ID NO: 8919 - DNA, 20 bp, Artificial Sequence
  Artificially Synthesized Primer Sequence
cccaaacgtccttgttccta

SEQ ID NO: 8920 - DNA, 20 bp, Artificial Sequence
  Artificially Synthesized Primer Sequence
cgcaggtagccaaaaatagc

SEQ ID NO: 8921 - DNA, 20 bp, Artificial Sequence
  Artificially Synthesized Primer Sequence
agtacaacgggatttgcctg

SEQ ID NO: 8922 - DNA, 20 bp, Artificial Sequence
  Artificially Synthesized Primer Sequence
gcacatgtccctgttcaatg

SEQ ID NO: 8923 - DNA, 20 bp, Artificial Sequence
  Artificially Synthesized Primer Sequence
tgatcttcgaggaatccacc

SEQ ID NO: 8924 - DNA, 20 bp, Artificial Sequence
  Artificially Synthesized Primer Sequence
agtacaacgggatttgcctg

SEQ ID NO: 8925 - DNA, 20 bp, Artificial Sequence
  Artificially Synthesized Primer Sequence
caaagcctccaaaacagctc

SEQ ID NO: 8926 - DNA, 20 bp, Artificial Sequence
  Artificially Synthesized Primer Sequence
attttgttgggggaaagacc

SEQ ID NO: 8927 - DNA, 20 bp, Artificial Sequence
  Artificially Synthesized Primer Sequence
cgaaagcagattcccaagag

SEQ ID NO: 8928 - DNA, 20 bp, Artificial Sequence
  Artificially Synthesized Primer Sequence
ggccttgcgtttgttatgat

SEQ ID NO: 8929 - DNA, 20 bp, Artificial Sequence
  Artificially Synthesized Primer Sequence
tttctcaggccaaaggagaa

SEQ ID NO: 8930 - DNA, 20 bp, Artificial Sequence
  Artificially Synthesized Primer Sequence
cctgccaaatgcctttacat

SEQ ID NO: 8931 - DNA, 20 bp, Artificial Sequence
  Artificially Synthesized Primer Sequence
cctgccaaatgcctttacat

SEQ ID NO: 8932 - DNA, 20 bp, Artificial Sequence
  Artificially Synthesized Primer Sequence
acctgttgcggcttcaatac

SEQ ID NO: 8933 - DNA, 20 bp, Artificial Sequence
  Artificially Synthesized Primer Sequence
acgaggtttctttccccagt

SEQ ID NO: 8934 - DNA, 20 bp, Artificial Sequence
  Artificially Synthesized Primer Sequence
tcgaatttcatctgtgcagc

SEQ ID NO: 8935 - DNA, 20 bp, Artificial Sequence
  Artificially Synthesized Primer Sequence
agctgctgctcttctccatc

SEQ ID NO: 8936 - DNA, 20 bp, Artificial Sequence
  Artificially Synthesized Primer Sequence
gaatctgcaagagcaaaggc

SEQ ID NO: 8937 - DNA, 20 bp, Artificial Sequence
  Artificially Synthesized Primer Sequence
tactcccctcctgatgatcg

SEQ ID NO: 8938 - DNA, 20 bp, Artificial Sequence
  Artificially Synthesized Primer Sequence
acaagaggttggtgctgctt

SEQ ID NO: 8939 - DNA, 20 bp, Artificial Sequence
  Artificially Synthesized Primer Sequence
acaagaggttggtgctgctt

SEQ ID NO: 8940 - DNA, 20 bp, Artificial Sequence
  Artificially Synthesized Primer Sequence
tactcccctcctgatgatcg

SEQ ID NO: 8941 - DNA, 20 bp, Artificial Sequence
  Artificially Synthesized Primer Sequence
tccagatcctcaccttggag

SEQ ID NO: 8942 - DNA, 20 bp, Artificial Sequence
  Artificially Synthesized Primer Sequence
ccttcttctcgtacttgccg

SEQ ID NO: 8943 - DNA, 20 bp, Artificial Sequence
  Artificially Synthesized Primer Sequence
ctcgatcgggatgctaatgt

SEQ ID NO: 8944 - DNA, 20 bp, Artificial Sequence
  Artificially Synthesized Primer Sequence
tgaacggccttgagacctac

SEQ ID NO: 8945 - DNA, 20 bp, Artificial Sequence
  Artificially Synthesized Primer Sequence
actacagacatccaacgccc

SEQ ID NO: 8946 - DNA, 20 bp, Artificial Sequence
  Artificially Synthesized Primer Sequence
ttataccgccccctctctct

SEQ ID NO: 8947 - DNA, 20 bp, Artificial Sequence
  Artificially Synthesized Primer Sequence
tccaacaccatccactacga

SEQ ID NO: 8948 - DNA, 20 bp, Artificial Sequence
  Artificially Synthesized Primer Sequence
atgacccggtcgatacaaga

SEQ ID NO: 8949 - DNA, 20 bp, Artificial Sequence
  Artificially Synthesized Primer Sequence
cctggacgacaagtactccg

SEQ ID NO: 8950 - DNA, 20 bp, Artificial Sequence
  Artificially Synthesized Primer Sequence
ggctatggaccgaacgtaga

SEQ ID NO: 8951 - DNA, 20 bp, Artificial Sequence
  Artificially Synthesized Primer Sequence
gtttttcgccaccttctttg

SEQ ID NO: 8952 - DNA, 20 bp, Artificial Sequence
  Artificially Synthesized Primer Sequence
aataaagaggatgcgcgtgt

SEQ ID NO: 8953 - DNA, 20 bp, Artificial Sequence
  Artificially Synthesized Primer Sequence
atagccgcatatggtgaagg

SEQ ID NO: 8954 - DNA, 20 bp, Artificial Sequence
  Artificially Synthesized Primer Sequence
cagcgagtgtacagacccaa

SEQ ID NO: 8955 - DNA, 20 bp, Artificial Sequence
  Artificially Synthesized Primer Sequence
ggatcaacaagaatggacgg

SEQ ID NO: 8956 - DNA, 20 bp, Artificial Sequence
  Artificially Synthesized Primer Sequence
atagccgcatatggtgaagg

SEQ ID NO: 8957 - DNA, 20 bp, Artificial Sequence
  Artificially Synthesized Primer Sequence
acgtgttcgacaaggacaca

SEQ ID NO: 8958 - DNA, 20 bp, Artificial Sequence
  Artificially Synthesized Primer Sequence
ccctgccatcagttcattct

SEQ ID NO: 8959 - DNA, 20 bp, Artificial Sequence
  Artificially Synthesized Primer Sequence
tctgccaagagcagagagtg

SEQ ID NO: 8960 - DNA, 20 bp, Artificial Sequence
  Artificially Synthesized Primer Sequence
tcaaactggacgtgttcgac

SEQ ID NO: 8961 - DNA, 20 bp, Artificial Sequence
  Artificially Synthesized Primer Sequence
tctgtctgcgataaacgacg

SEQ ID NO: 8962 - DNA, 20 bp, Artificial Sequence
  Artificially Synthesized Primer Sequence
atgtctgttccaaccttgcc

SEQ ID NO: 8963 - DNA, 20 bp, Artificial Sequence
  Artificially Synthesized Primer Sequence
ggttgaaaccaggtgcttgt

SEQ ID NO: 8964 - DNA, 20 bp, Artificial Sequence
  Artificially Synthesized Primer Sequence
agatgctggacctcatcacc

SEQ ID NO: 8965 - DNA, 20 bp, Artificial Sequence
  Artificially Synthesized Primer Sequence
aggtcgttcagcaaatccat

SEQ ID NO: 8966 - DNA, 20 bp, Artificial Sequence
  Artificially Synthesized Primer Sequence
tgcttgaacgtgtagatccg

SEQ ID NO: 8967 - DNA, 20 bp, Artificial Sequence
  Artificially Synthesized Primer Sequence
ttaagacccattccatccca

SEQ ID NO: 8968 - DNA, 20 bp, Artificial Sequence
  Artificially Synthesized Primer Sequence
tctatttcggtcgtgtgtgc

SEQ ID NO: 8969 - DNA, 20 bp, Artificial Sequence
  Artificially Synthesized Primer Sequence
ctccgatggtacaggaggaa

SEQ ID NO: 8970 - DNA, 20 bp, Artificial Sequence
  Artificially Synthesized Primer Sequence
gctctgcagcctgctatctt

SEQ ID NO: 8971 - DNA, 20 bp, Artificial Sequence
  Artificially Synthesized Primer Sequence
taagccgctttggaccttta

SEQ ID NO: 8972 - DNA, 20 bp, Artificial Sequence
  Artificially Synthesized Primer Sequence
ttttcaacagggaccaggac

SEQ ID NO: 8973 - DNA, 20 bp, Artificial Sequence
  Artificially Synthesized Primer Sequence
gcccaagcaatcatgcttat

SEQ ID NO: 8974 - DNA, 20 bp, Artificial Sequence
  Artificially Synthesized Primer Sequence
ggtggggctatctttcttcc

SEQ ID NO: 8975 - DNA, 20 bp, Artificial Sequence
  Artificially Synthesized Primer Sequence
cttccaaacacatcaggggt

SEQ ID NO: 8976 - DNA, 20 bp, Artificial Sequence
  Artificially Synthesized Primer Sequence
ctgcagcctcaaaaagcaat

SEQ ID NO: 8977 - DNA, 20 bp, Artificial Sequence
  Artificially Synthesized Primer Sequence
gtcagcttgaaggacaaggc

SEQ ID NO: 8978 - DNA, 20 bp, Artificial Sequence
  Artificially Synthesized Primer Sequence
cccgagaagatgaagtcgag

SEQ ID NO: 8979 - DNA, 20 bp, Artificial Sequence
  Artificially Synthesized Primer Sequence
acctaccgaggacaaaacca

SEQ ID NO: 8980 - DNA, 19 bp, Artificial Sequence
  Artificially Synthesized Primer Sequence
atacggagtgggaagcagc

SEQ ID NO: 8981 - DNA, 20 bp, Artificial Sequence
  Artificially Synthesized Primer Sequence
ctggtgctgttcttcgttca

SEQ ID NO: 8982 - DNA, 20 bp, Artificial Sequence
  Artificially Synthesized Primer Sequence
attggttcctgtccatctgc

SEQ ID NO: 8983 - DNA, 20 bp, Artificial Sequence
  Artificially Synthesized Primer Sequence
ctggtgctgttcttcgttca

SEQ ID NO: 8984 - DNA, 20 bp, Artificial Sequence
  Artificially Synthesized Primer Sequence
acggaagatatgcaggcaac

SEQ ID NO: 8985 - DNA, 20 bp, Artificial Sequence
  Artificially Synthesized Primer Sequence
tgaattgagctgacaaaccg

SEQ ID NO: 8986 - DNA, 20 bp, Artificial Sequence
  Artificially Synthesized Primer Sequence
aagaggggtgtaggggagaa

SEQ ID NO: 8987 - DNA, 20 bp, Artificial Sequence
  Artificially Synthesized Primer Sequence
tgaaaatcggctgggaatag

SEQ ID NO: 8988 - DNA, 20 bp, Artificial Sequence
  Artificially Synthesized Primer Sequence
gaagaacttcggccatctca

SEQ ID NO: 8989 - DNA, 20 bp, Artificial Sequence
  Artificially Synthesized Primer Sequence
cgggattaagcaggtggtaa

SEQ ID NO: 8990 - DNA, 20 bp, Artificial Sequence
  Artificially Synthesized Primer Sequence
ttttccaacaaggaggttgc

SEQ ID NO: 8991 - DNA, 20 bp, Artificial Sequence
  Artificially Synthesized Primer Sequence
ttttctcctctgacccctcc

SEQ ID NO: 8992 - DNA, 20 bp, Artificial Sequence
  Artificially Synthesized Primer Sequence
gaggctgaggaccgagtttt

SEQ ID NO: 8993 - DNA, 20 bp, Artificial Sequence
  Artificially Synthesized Primer Sequence
cgtgtgcaatttgcttatgg

SEQ ID NO: 8994 - DNA, 20 bp, Artificial Sequence
  Artificially Synthesized Primer Sequence
ggattacgggtggaggactt

SEQ ID NO: 8995 - DNA, 20 bp, Artificial Sequence
  Artificially Synthesized Primer Sequence
ctgatgagaaggcaatgcaa

SEQ ID NO: 8996 - DNA, 20 bp, Artificial Sequence
  Artificially Synthesized Primer Sequence
tttaccggaacctccatcag

SEQ ID NO: 8997 - DNA, 20 bp, Artificial Sequence
  Artificially Synthesized Primer Sequence
ggctaccagatccacgacat

SEQ ID NO: 8998 - DNA, 20 bp, Artificial Sequence
  Artificially Synthesized Primer Sequence
gaccaggcaagcctacaaaa

SEQ ID NO: 8999 - DNA, 20 bp, Artificial Sequence
  Artificially Synthesized Primer Sequence
gaccaggcaagcctacaaaa

SEQ ID NO: 9000 - DNA, 20 bp, Artificial Sequence
  Artificially Synthesized Primer Sequence
ggctaccagatccacgacat

SEQ ID NO: 9001 - DNA, 20 bp, Artificial Sequence
  Artificially Synthesized Primer Sequence
gtcttcctcctcttcctgcc

SEQ ID NO: 9002 - DNA, 20 bp, Artificial Sequence
  Artificially Synthesized Primer Sequence
agttgccaggatcacaggtc

SEQ ID NO: 9003 - DNA, 20 bp, Artificial Sequence
  Artificially Synthesized Primer Sequence
gcaggctgatctttcacctc

SEQ ID NO: 9004 - DNA, 20 bp, Artificial Sequence
  Artificially Synthesized Primer Sequence
tacggctggtctgatctgtg

SEQ ID NO: 9005 - DNA, 20 bp, Artificial Sequence
  Artificially Synthesized Primer Sequence
agcctcgagtcaaccaagaa

SEQ ID NO: 9006 - DNA, 20 bp, Artificial Sequence
  Artificially Synthesized Primer Sequence
ggttaatccctgagtgccaa

SEQ ID NO: 9007 - DNA, 20 bp, Artificial Sequence
  Artificially Synthesized Primer Sequence
caaactgagccaagcaacaa

SEQ ID NO: 9008 - DNA, 20 bp, Artificial Sequence
  Artificially Synthesized Primer Sequence
gctcacacagtcgttttgga

SEQ ID NO: 9009 - DNA, 20 bp, Artificial Sequence
  Artificially Synthesized Primer Sequence
aaagtgataggcaacacggg

SEQ ID NO: 9010 - DNA, 20 bp, Artificial Sequence
  Artificially Synthesized Primer Sequence
ttgttaagtccttggtcggg

SEQ ID NO: 9011 - DNA, 20 bp, Artificial Sequence
  Artificially Synthesized Primer Sequence
cgacaaatgactggtgaacg

SEQ ID NO: 9012 - DNA, 20 bp, Artificial Sequence
  Artificially Synthesized Primer Sequence
gggacaacgcgacactaaat

SEQ ID NO: 9013 - DNA, 20 bp, Artificial Sequence
  Artificially Synthesized Primer Sequence
gcaaggactactggctcgtc

SEQ ID NO: 9014 - DNA, 20 bp, Artificial Sequence
  Artificially Synthesized Primer Sequence
ccgtgatgcaaatgtttacg

SEQ ID NO: 9015 - DNA, 20 bp, Artificial Sequence
  Artificially Synthesized Primer Sequence
ttctgtaaacgaccgaaccc

SEQ ID NO: 9016 - DNA, 20 bp, Artificial Sequence
  Artificially Synthesized Primer Sequence
ctgcatctacgagtacggca

SEQ ID NO: 9017 - DNA, 20 bp, Artificial Sequence
  Artificially Synthesized Primer Sequence
tctgcacatagttgcttcgg

SEQ ID NO: 9018 - DNA, 20 bp, Artificial Sequence
  Artificially Synthesized Primer Sequence
ggtcatgttttccgtctcgt

SEQ ID NO: 9019 - DNA, 20 bp, Artificial Sequence
  Artificially Synthesized Primer Sequence
ctgtcctcagaaacggaagc

SEQ ID NO: 9020 - DNA, 20 bp, Artificial Sequence
  Artificially Synthesized Primer Sequence
cacgctaggtgtggtgattg

SEQ ID NO: 9021 - DNA, 20 bp, Artificial Sequence
  Artificially Synthesized Primer Sequence
tctgcatggcaaagacactc

SEQ ID NO: 9022 - DNA, 20 bp, Artificial Sequence
  Artificially Synthesized Primer Sequence
acagtctttcccaccaatgc

SEQ ID NO: 9023 - DNA, 20 bp, Artificial Sequence
  Artificially Synthesized Primer Sequence
aaagccaaagaagaatcgca

SEQ ID NO: 9024 - DNA, 20 bp, Artificial Sequence
  Artificially Synthesized Primer Sequence
tgctacgtgttgatggtggt

SEQ ID NO: 9025 - DNA, 20 bp, Artificial Sequence
  Artificially Synthesized Primer Sequence
cgtgttgatggtggtgctac

SEQ ID NO: 9026 - DNA, 20 bp, Artificial Sequence
  Artificially Synthesized Primer Sequence
aaagccaaagaagaatcgca

SEQ ID NO: 9027 - DNA, 20 bp, Artificial Sequence
  Artificially Synthesized Primer Sequence
acaagacaaacaagggctgg

SEQ ID NO: 9028 - DNA, 20 bp, Artificial Sequence
  Artificially Synthesized Primer Sequence
tacgtgttgatggtggtgct

SEQ ID NO: 9029 - DNA, 20 bp, Artificial Sequence
  Artificially Synthesized Primer Sequence
cccagcttttggaatatgga

SEQ ID NO: 9030 - DNA, 20 bp, Artificial Sequence
  Artificially Synthesized Primer Sequence
gccttccaagacagcaagac

SEQ ID NO: 9031 - DNA, 21 bp, Artificial Sequence
  Artificially Synthesized Primer Sequence
tctagcggacagctaaacagc

SEQ ID NO: 9032 - DNA, 20 bp, Artificial Sequence
  Artificially Synthesized Primer Sequence
ccatcctcatcaccctcact

SEQ ID NO: 9033 - DNA, 20 bp, Artificial Sequence
  Artificially Synthesized Primer Sequence
atatttggtgcgattcgagg

SEQ ID NO: 9034 - DNA, 20 bp, Artificial Sequence
  Artificially Synthesized Primer Sequence
ggctttcggacaatgtcaat

SEQ ID NO: 9035 - DNA, 20 bp, Artificial Sequence
  Artificially Synthesized Primer Sequence
ggctttcggacaatgtcaat

SEQ ID NO: 9036 - DNA, 20 bp, Artificial Sequence
  Artificially Synthesized Primer Sequence
gagcttccgaagaaccaaga

SEQ ID NO: 9037 - DNA, 20 bp, Artificial Sequence
  Artificially Synthesized Primer Sequence
gccggagaactaccagatga

SEQ ID NO: 9038 - DNA, 20 bp, Artificial Sequence
  Artificially Synthesized Primer Sequence
gtacttggcctcgatgtcgt

SEQ ID NO: 9039 - DNA, 20 bp, Artificial Sequence
  Artificially Synthesized Primer Sequence
tcatccagaaaagagcacca

SEQ ID NO: 9040 - DNA, 20 bp, Artificial Sequence
  Artificially Synthesized Primer Sequence
agtacgtctccctccacgtc

SEQ ID NO: 9041 - DNA, 20 bp, Artificial Sequence
  Artificially Synthesized Primer Sequence
tgtgccccagtaatgtttca

SEQ ID NO: 9042 - DNA, 20 bp, Artificial Sequence
  Artificially Synthesized Primer Sequence
caaaagcgaggcgtaagaac

SEQ ID NO: 9043 - DNA, 20 bp, Artificial Sequence
  Artificially Synthesized Primer Sequence
tgaaacattactggggcaca

SEQ ID NO: 9044 - DNA, 20 bp, Artificial Sequence
  Artificially Synthesized Primer Sequence
gctcctggacgtgttctacg

SEQ ID NO: 9045 - DNA, 20 bp, Artificial Sequence
  Artificially Synthesized Primer Sequence
gctgatgctggtgatgaaga

SEQ ID NO: 9046 - DNA, 20 bp, Artificial Sequence
  Artificially Synthesized Primer Sequence
atcccatcccatggtgacta

SEQ ID NO: 9047 - DNA, 20 bp, Artificial Sequence
  Artificially Synthesized Primer Sequence
atcccatcccatggtgacta

SEQ ID NO: 9048 - DNA, 20 bp, Artificial Sequence
  Artificially Synthesized Primer Sequence
aagatgatgatggggacgag

SEQ ID NO: 9049 - DNA, 20 bp, Artificial Sequence
  Artificially Synthesized Primer Sequence
tttgactggtgcagcttacg

SEQ ID NO: 9050 - DNA, 20 bp, Artificial Sequence
  Artificially Synthesized Primer Sequence
gaccggttgccttcaagata

SEQ ID NO: 9051 - DNA, 20 bp, Artificial Sequence
  Artificially Synthesized Primer Sequence
gcaccttcttccatctgctc

SEQ ID NO: 9052 - DNA, 20 bp, Artificial Sequence
  Artificially Synthesized Primer Sequence
acgagccaccattttcagac

SEQ ID NO: 9053 - DNA, 20 bp, Artificial Sequence
  Artificially Synthesized Primer Sequence
tgtccactcctgatggtgaa

SEQ ID NO: 9054 - DNA, 20 bp, Artificial Sequence
  Artificially Synthesized Primer Sequence
gacagcccttccgttttgta

SEQ ID NO: 9055 - DNA, 20 bp, Artificial Sequence
  Artificially Synthesized Primer Sequence
tcgctccataggaacaaacc

SEQ ID NO: 9056 - DNA, 20 bp, Artificial Sequence
  Artificially Synthesized Primer Sequence
cttcacgctgagcgacttct

SEQ ID NO: 9057 - DNA, 20 bp, Artificial Sequence
  Artificially Synthesized Primer Sequence
aacttcacctcgcagctcat

SEQ ID NO: 9058 - DNA, 20 bp, Artificial Sequence
  Artificially Synthesized Primer Sequence
tcccgtagcatacttgggac

SEQ ID NO: 9059 - DNA, 20 bp, Artificial Sequence
  Artificially Synthesized Primer Sequence
tgctctccgttgcatacttg

SEQ ID NO: 9060 - DNA, 20 bp, Artificial Sequence
  Artificially Synthesized Primer Sequence
tcatgcactacaagcaaggc

SEQ ID NO: 9061 - DNA, 20 bp, Artificial Sequence
  Artificially Synthesized Primer Sequence
ccatcaccaagcacatcaag

SEQ ID NO: 9062 - DNA, 20 bp, Artificial Sequence
  Artificially Synthesized Primer Sequence
aattccaaaggcatgagcac

SEQ ID NO: 9063 - DNA, 20 bp, Artificial Sequence
  Artificially Synthesized Primer Sequence
aattccaaaggcatgagcac

SEQ ID NO: 9064 - DNA, 20 bp, Artificial Sequence
  Artificially Synthesized Primer Sequence
cgattcgaggtcgtaggaaa

SEQ ID NO: 9065 - DNA, 20 bp, Artificial Sequence
  Artificially Synthesized Primer Sequence
ggttcccacttcttggtgaa

SEQ ID NO: 9066 - DNA, 20 bp, Artificial Sequence
  Artificially Synthesized Primer Sequence
agaaacggggaggaagaaaa

SEQ ID NO: 9067 - DNA, 20 bp, Artificial Sequence
  Artificially Synthesized Primer Sequence
gaccctgtatgatgggatgg

SEQ ID NO: 9068 - DNA, 20 bp, Artificial Sequence
  Artificially Synthesized Primer Sequence
gaagtcagagaaggccgatg

SEQ ID NO: 9069 - DNA, 20 bp, Artificial Sequence
  Artificially Synthesized Primer Sequence
gacgagtccgagaaacttcg

SEQ ID NO: 9070 - DNA, 20 bp, Artificial Sequence
  Artificially Synthesized Primer Sequence
aacaggcatagaatgcggtc

SEQ ID NO: 9071 - DNA, 20 bp, Artificial Sequence
  Artificially Synthesized Primer Sequence
gatgggagcacaccagctat

SEQ ID NO: 9072 - DNA, 20 bp, Artificial Sequence
  Artificially Synthesized Primer Sequence
tgctattcgcagtgaggatg

SEQ ID NO: 9073 - DNA, 20 bp, Artificial Sequence
  Artificially Synthesized Primer Sequence
tcgaatcagctaggagcgtt

SEQ ID NO: 9074 - DNA, 20 bp, Artificial Sequence
  Artificially Synthesized Primer Sequence
ttgtagttcctttgggaccg

SEQ ID NO: 9075 - DNA, 20 bp, Artificial Sequence
  Artificially Synthesized Primer Sequence
gccttcgctgctaatctcac

SEQ ID NO: 9076 - DNA, 20 bp, Artificial Sequence
  Artificially Synthesized Primer Sequence
cgtcttaaggagctcggttg

SEQ ID NO: 9077 - DNA, 20 bp, Artificial Sequence
  Artificially Synthesized Primer Sequence
cggcacgaggctttagatac

SEQ ID NO: 9078 - DNA, 20 bp, Artificial Sequence
  Artificially Synthesized Primer Sequence
tcgaccacttgaaaccaaca

SEQ ID NO: 9079 - DNA, 20 bp, Artificial Sequence
  Artificially Synthesized Primer Sequence
tcgaccacttgaaaccaaca

SEQ ID NO: 9080 - DNA, 18 bp, Artificial Sequence
  Artificially Synthesized Primer Sequence
aatgctcccaaggctcgt

SEQ ID NO: 9081 - DNA, 20 bp, Artificial Sequence
  Artificially Synthesized Primer Sequence
accagaagatgacggtggtc

SEQ ID NO: 9082 - DNA, 20 bp, Artificial Sequence
  Artificially Synthesized Primer Sequence
aaatccttacgcggccttat

SEQ ID NO: 9083 - DNA, 20 bp, Artificial Sequence
  Artificially Synthesized Primer Sequence
aaatccttacgcggccttat

SEQ ID NO: 9084 - DNA, 20 bp, Artificial Sequence
  Artificially Synthesized Primer Sequence
gaccagaagatgacggtggt

SEQ ID NO: 9085 - DNA, 20 bp, Artificial Sequence
  Artificially Synthesized Primer Sequence
acttggcaaaacgccttcta

SEQ ID NO: 9086 - DNA, 20 bp, Artificial Sequence
  Artificially Synthesized Primer Sequence
ttagctcatgcttccggtct

SEQ ID NO: 9087 - DNA, 20 bp, Artificial Sequence
  Artificially Synthesized Primer Sequence
gggacgacatggtttttgtt

SEQ ID NO: 9088 - DNA, 20 bp, Artificial Sequence
  Artificially Synthesized Primer Sequence
aagaacgtactgcggaagga

SEQ ID NO: 9089 - DNA, 20 bp, Artificial Sequence
  Artificially Synthesized Primer Sequence
cgaggtgggtttatgcagtt

SEQ ID NO: 9090 - DNA, 20 bp, Artificial Sequence
  Artificially Synthesized Primer Sequence
tacaacaggcgagctcaatg

SEQ ID NO: 9091 - DNA, 20 bp, Artificial Sequence
  Artificially Synthesized Primer Sequence
tacaacaggcgagctcaatg

SEQ ID NO: 9092 - DNA, 20 bp, Artificial Sequence
  Artificially Synthesized Primer Sequence
agcctgtggctaccatagca

SEQ ID NO: 9093 - DNA, 21 bp, Artificial Sequence
  Artificially Synthesized Primer Sequence
gccggatatgagctacattga

SEQ ID NO: 9094 - DNA, 20 bp, Artificial Sequence
  Artificially Synthesized Primer Sequence
ttgattggagcatagcatcg

SEQ ID NO: 9095 - DNA, 21 bp, Artificial Sequence
  Artificially Synthesized Primer Sequence
caacattcagcaatgaactgg

SEQ ID NO: 9096 - DNA, 20 bp, Artificial Sequence
  Artificially Synthesized Primer Sequence
gggagcaggagttcgtgtat

SEQ ID NO: 9097 - DNA, 20 bp, Artificial Sequence
  Artificially Synthesized Primer Sequence
gacaagaaagacggggacaa

SEQ ID NO: 9098 - DNA, 20 bp, Artificial Sequence
  Artificially Synthesized Primer Sequence
gcccactcctacaaacctga

SEQ ID NO: 9099 - DNA, 20 bp, Artificial Sequence
  Artificially Synthesized Primer Sequence
ggtcgacatcttcccaaaaa

SEQ ID NO: 9100 - DNA, 20 bp, Artificial Sequence
  Artificially Synthesized Primer Sequence
gacaagaaagacggggacaa

SEQ ID NO: 9101 - DNA, 20 bp, Artificial Sequence
  Artificially Synthesized Primer Sequence
gtttgccaagggaaccacta

SEQ ID NO: 9102 - DNA, 20 bp, Artificial Sequence
  Artificially Synthesized Primer Sequence
cctctgcggacgaaatgtat

SEQ ID NO: 9103 - DNA, 20 bp, Artificial Sequence
  Artificially Synthesized Primer Sequence
tgacacgtgccaatctcaat

SEQ ID NO: 9104 - DNA, 20 bp, Artificial Sequence
  Artificially Synthesized Primer Sequence
gcaaagatgatccaagggaa

SEQ ID NO: 9105 - DNA, 20 bp, Artificial Sequence
  Artificially Synthesized Primer Sequence
ccaaattgccacctttgtct

SEQ ID NO: 9106 - DNA, 20 bp, Artificial Sequence
  Artificially Synthesized Primer Sequence
aagaagctccgtcagccata

SEQ ID NO: 9107 - DNA, 20 bp, Artificial Sequence
  Artificially Synthesized Primer Sequence
catccgcagctgacagtaaa

SEQ ID NO: 9108 - DNA, 20 bp, Artificial Sequence
  Artificially Synthesized Primer Sequence
tagcaggctatgaaatcccg

SEQ ID NO: 9109 - DNA, 20 bp, Artificial Sequence
  Artificially Synthesized Primer Sequence
catttgaatgggagacgctt

SEQ ID NO: 9110 - DNA, 20 bp, Artificial Sequence
  Artificially Synthesized Primer Sequence
ctgacttggagggtgagagc

SEQ ID NO: 9111 - DNA, 20 bp, Artificial Sequence
  Artificially Synthesized Primer Sequence
cacaccaaaaagcaagctga

SEQ ID NO: 9112 - DNA, 20 bp, Artificial Sequence
  Artificially Synthesized Primer Sequence
caattgaatgggagacgctt

SEQ ID NO: 9113 - DNA, 20 bp, Artificial Sequence
  Artificially Synthesized Primer Sequence
aaactgaccccagatacccc

SEQ ID NO: 9114 - DNA, 20 bp, Artificial Sequence
  Artificially Synthesized Primer Sequence
cactggagctcgaagtttcc

SEQ ID NO: 9115 - DNA, 20 bp, Artificial Sequence
  Artificially Synthesized Primer Sequence
ttttcgagtagcgtccgagt

SEQ ID NO: 9116 - DNA, 20 bp, Artificial Sequence
  Artificially Synthesized Primer Sequence
gacgcacatccactagctca

SEQ ID NO: 9117 - DNA, 20 bp, Artificial Sequence
  Artificially Synthesized Primer Sequence
cgactgaaaaacgaagaggc

SEQ ID NO: 9118 - DNA, 20 bp, Artificial Sequence
  Artificially Synthesized Primer Sequence
gtttgggccactgacaagat

SEQ ID NO: 9119 - DNA, 20 bp, Artificial Sequence
  Artificially Synthesized Primer Sequence
ctcgcattaacaaggcatga

SEQ ID NO: 9120 - DNA, 20 bp, Artificial Sequence
  Artificially Synthesized Primer Sequence
agagggtggcaacgttgtag

SEQ ID NO: 9121 - DNA, 20 bp, Artificial Sequence
  Artificially Synthesized Primer Sequence
cggtgaaatggtgcctaact

SEQ ID NO: 9122 - DNA, 20 bp, Artificial Sequence
  Artificially Synthesized Primer Sequence
tccaagcacaacacaccaat

SEQ ID NO: 9123 - DNA, 20 bp, Artificial Sequence
  Artificially Synthesized Primer Sequence
attccaagcacaacacacca

SEQ ID NO: 9124 - DNA, 20 bp, Artificial Sequence
  Artificially Synthesized Primer Sequence
cggtgaaatggtgcctaact

SEQ ID NO: 9125 - DNA, 20 bp, Artificial Sequence
  Artificially Synthesized Primer Sequence
accaacctgatcggtgagac

SEQ ID NO: 9126 - DNA, 20 bp, Artificial Sequence
  Artificially Synthesized Primer Sequence
cggccaacattgtaggatct

SEQ ID NO: 9127 - DNA, 20 bp, Artificial Sequence
  Artificially Synthesized Primer Sequence
cgttttcatgcaaaatgcac

SEQ ID NO: 9128 - DNA, 20 bp, Artificial Sequence
  Artificially Synthesized Primer Sequence
tgggatcaaggaacttctcg

SEQ ID NO: 9129 - DNA, 20 bp, Artificial Sequence
  Artificially Synthesized Primer Sequence
ggagtcctcctgccttctct

SEQ ID NO: 9130 - DNA, 20 bp, Artificial Sequence
  Artificially Synthesized Primer Sequence
ttcctgcatcccaatttctc

SEQ ID NO: 9131 - DNA, 20 bp, Artificial Sequence
  Artificially Synthesized Primer Sequence
aactagaatgcgctgtgcct

SEQ ID NO: 9132 - DNA, 20 bp, Artificial Sequence
  Artificially Synthesized Primer Sequence
tttccttgcaagaccagctt

SEQ ID NO: 9133 - DNA, 20 bp, Artificial Sequence
  Artificially Synthesized Primer Sequence
agaatacctggcgttggatg

SEQ ID NO: 9134 - DNA, 20 bp, Artificial Sequence
  Artificially Synthesized Primer Sequence
ggcttctcgctgtagtctgg

SEQ ID NO: 9135 - DNA, 20 bp, Artificial Sequence
  Artificially Synthesized Primer Sequence
aagcagagctaacagcgagc

SEQ ID NO: 9136 - DNA, 20 bp, Artificial Sequence
  Artificially Synthesized Primer Sequence
cgaccagacatacagcgaga

SEQ ID NO: 9137 - DNA, 20 bp, Artificial Sequence
  Artificially Synthesized Primer Sequence
ttcagaaatttgaatcgggc

SEQ ID NO: 9138 - DNA, 20 bp, Artificial Sequence
  Artificially Synthesized Primer Sequence
gtcgcaagcttaccaaaagc

SEQ ID NO: 9139 - DNA, 20 bp, Artificial Sequence
  Artificially Synthesized Primer Sequence
gagtaggattcgggcatgag

SEQ ID NO: 9140 - DNA, 20 bp, Artificial Sequence
  Artificially Synthesized Primer Sequence
ttggcccgtataatgtctgc

SEQ ID NO: 9141 - DNA, 20 bp, Artificial Sequence
  Artificially Synthesized Primer Sequence
gctctgttcctgccattctc

SEQ ID NO: 9142 - DNA, 20 bp, Artificial Sequence
  Artificially Synthesized Primer Sequence
gctcttctcttcctcgggtt

SEQ ID NO: 9143 - DNA, 20 bp, Artificial Sequence
  Artificially Synthesized Primer Sequence
catttttccacacttgggct

SEQ ID NO: 9144 - DNA, 20 bp, Artificial Sequence
  Artificially Synthesized Primer Sequence
cggaggatccagaggaattt

SEQ ID NO: 9145 - DNA, 20 bp, Artificial Sequence
  Artificially Synthesized Primer Sequence
cagcgtatcctgctgtcaaa

SEQ ID NO: 9146 - DNA, 20 bp, Artificial Sequence
  Artificially Synthesized Primer Sequence
cgtagcttaagcgttccacc

SEQ ID NO: 9147 - DNA, 20 bp, Artificial Sequence
  Artificially Synthesized Primer Sequence
aagacggtgattcgggactt

SEQ ID NO: 9148 - DNA, 19 bp, Artificial Sequence
  Artificially Synthesized Primer Sequence
ggtgaagctgaacgtggtg

SEQ ID NO: 9149 - DNA, 20 bp, Artificial Sequence
  Artificially Synthesized Primer Sequence
cttactggtggacatgggct

SEQ ID NO: 9150 - DNA, 20 bp, Artificial Sequence
  Artificially Synthesized Primer Sequence
aaggactggatgtcctgtgg

SEQ ID NO: 9151 - DNA, 20 bp, Artificial Sequence
  Artificially Synthesized Primer Sequence
ggtcagagataccgagctgc

SEQ ID NO: 9152 - DNA, 20 bp, Artificial Sequence
  Artificially Synthesized Primer Sequence
tcaggagaatgctaccaggg

SEQ ID NO: 9153 - DNA, 20 bp, Artificial Sequence
  Artificially Synthesized Primer Sequence
gtaggggagaaagtagcggg

SEQ ID NO: 9154 - DNA, 20 bp, Artificial Sequence
  Artificially Synthesized Primer Sequence
ttccgttcatcttccaaacc

SEQ ID NO: 9155 - DNA, 20 bp, Artificial Sequence
  Artificially Synthesized Primer Sequence
caaatgggagcgagctatgt

SEQ ID NO: 9156 - DNA, 20 bp, Artificial Sequence
  Artificially Synthesized Primer Sequence
gttcggcttcaggaaccttt

SEQ ID NO: 9157 - DNA, 20 bp, Artificial Sequence
  Artificially Synthesized Primer Sequence
ctacatggccaacaccctct

SEQ ID NO: 9158 - DNA, 20 bp, Artificial Sequence
  Artificially Synthesized Primer Sequence
cagaatcaggttccccaaga

SEQ ID NO: 9159 - DNA, 20 bp, Artificial Sequence
  Artificially Synthesized Primer Sequence
atggacccaaggatgtttca

SEQ ID NO: 9160 - DNA, 20 bp, Artificial Sequence
  Artificially Synthesized Primer Sequence
tttgggcgttgtacagaaga

SEQ ID NO: 9161 - DNA, 20 bp, Artificial Sequence
  Artificially Synthesized Primer Sequence
cactgttatggcaccgacac

SEQ ID NO: 9162 - DNA, 20 bp, Artificial Sequence
  Artificially Synthesized Primer Sequence
gcacccaccattcttgagtt

SEQ ID NO: 9163 - DNA, 20 bp, Artificial Sequence
  Artificially Synthesized Primer Sequence
cgctaacaataggcgctagg

SEQ ID NO: 9164 - DNA, 20 bp, Artificial Sequence
  Artificially Synthesized Primer Sequence
tacgttggtggtcacttgga

SEQ ID NO: 9165 - DNA, 20 bp, Artificial Sequence
  Artificially Synthesized Primer Sequence
cttgcaaaggaccaaggaag

SEQ ID NO: 9166 - DNA, 20 bp, Artificial Sequence
  Artificially Synthesized Primer Sequence
ttcagttcctccacccactc

SEQ ID NO: 9167 - DNA, 20 bp, Artificial Sequence
  Artificially Synthesized Primer Sequence
ttgatctcacgatctcacgg

SEQ ID NO: 9168 - DNA, 20 bp, Artificial Sequence
  Artificially Synthesized Primer Sequence
gagatcgacgaacttggagc

SEQ ID NO: 9169 - DNA, 20 bp, Artificial Sequence
  Artificially Synthesized Primer Sequence
gggtggagatggagagaaca

SEQ ID NO: 9170 - DNA, 20 bp, Artificial Sequence
  Artificially Synthesized Primer Sequence
agccaagcaacaccaactct

SEQ ID NO: 9171 - DNA, 20 bp, Artificial Sequence
  Artificially Synthesized Primer Sequence
gacaaaggcgagcaggttac

SEQ ID NO: 9172 - DNA, 20 bp, Artificial Sequence
  Artificially Synthesized Primer Sequence
gccaacttatcctccgttca

SEQ ID NO: 9173 - DNA, 20 bp, Artificial Sequence
  Artificially Synthesized Primer Sequence
cggcggtgagacagataagt

SEQ ID NO: 9174 - DNA, 20 bp, Artificial Sequence
  Artificially Synthesized Primer Sequence
gaggcgaaggtgaagaacac

SEQ ID NO: 9175 - DNA, 20 bp, Artificial Sequence
  Artificially Synthesized Primer Sequence
gcttgaagtaacctcggcac

SEQ ID NO: 9176 - DNA, 20 bp, Artificial Sequence
  Artificially Synthesized Primer Sequence
tgggaagggatttcagtcag

SEQ ID NO: 9177 - DNA, 20 bp, Artificial Sequence
  Artificially Synthesized Primer Sequence
gaagccacatcggaggataa

SEQ ID NO: 9178 - DNA, 20 bp, Artificial Sequence
  Artificially Synthesized Primer Sequence
acctttagtgcaatgccacc

SEQ ID NO: 9179 - DNA, 20 bp, Artificial Sequence
  Artificially Synthesized Primer Sequence
ggctgatcgttgtcatcctt

SEQ ID NO: 9180 - DNA, 20 bp, Artificial Sequence
  Artificially Synthesized Primer Sequence
gatttgcttcccgtgaatgt

SEQ ID NO: 9181 - DNA, 20 bp, Artificial Sequence
  Artificially Synthesized Primer Sequence
agcccgaacaagaagcacta

SEQ ID NO: 9182 - DNA, 20 bp, Artificial Sequence
  Artificially Synthesized Primer Sequence
cgtcccagttgatacgtgtg

SEQ ID NO: 9183 - DNA, 20 bp, Artificial Sequence
  Artificially Synthesized Primer Sequence
cgaatatgccaatgcaacag

SEQ ID NO: 9184 - DNA, 20 bp, Artificial Sequence
  Artificially Synthesized Primer Sequence
aggacaccaacaagattcgg

SEQ ID NO: 9185 - DNA, 20 bp, Artificial Sequence
  Artificially Synthesized Primer Sequence
ggaccgaacgaacttgaaaa

SEQ ID NO: 9186 - DNA, 20 bp, Artificial Sequence
  Artificially Synthesized Primer Sequence
ctagccccaggatcattcaa

SEQ ID NO: 9187 - DNA, 20 bp, Artificial Sequence
  Artificially Synthesized Primer Sequence
ctagccccaggatcattcaa

SEQ ID NO: 9188 - DNA, 20 bp, Artificial Sequence
  Artificially Synthesized Primer Sequence
ggaccgaacgaacttgaaaa

SEQ ID NO: 9189 - DNA, 20 bp, Artificial Sequence
  Artificially Synthesized Primer Sequence
ctgcagaacatgcacaggat

SEQ ID NO: 9190 - DNA, 20 bp, Artificial Sequence
  Artificially Synthesized Primer Sequence
aattcccctggtttattcgg

SEQ ID NO: 9191 - DNA, 20 bp, Artificial Sequence
  Artificially Synthesized Primer Sequence
tacaccatgccaccatcatc

SEQ ID NO: 9192 - DNA, 20 bp, Artificial Sequence
  Artificially Synthesized Primer Sequence
ctgcagaacatgcacaggat

SEQ ID NO: 9193 - DNA, 20 bp, Artificial Sequence
  Artificially Synthesized Primer Sequence
cccttctatggaggaggagg

SEQ ID NO: 9194 - DNA, 20 bp, Artificial Sequence
  Artificially Synthesized Primer Sequence
tttcccagtggaagaaatcg

SEQ ID NO: 9195 - DNA, 20 bp, Artificial Sequence
  Artificially Synthesized Primer Sequence
tcagaggacacactcgatgc

SEQ ID NO: 9196 - DNA, 20 bp, Artificial Sequence
  Artificially Synthesized Primer Sequence
ctgagctttccaacctctgg

SEQ ID NO: 9197 - DNA, 20 bp, Artificial Sequence
  Artificially Synthesized Primer Sequence
gcagctctcatgatgttcca

SEQ ID NO: 9198 - DNA, 20 bp, Artificial Sequence
  Artificially Synthesized Primer Sequence
tgcgctcgtttgtagtatgc

SEQ ID NO: 9199 - DNA, 20 bp, Artificial Sequence
  Artificially Synthesized Primer Sequence
agtttcctcgccatacaacg

SEQ ID NO: 9200 - DNA, 20 bp, Artificial Sequence
  Artificially Synthesized Primer Sequence
gaagctttgggcaaatacga

SEQ ID NO: 9201 - DNA, 20 bp, Artificial Sequence
  Artificially Synthesized Primer Sequence
gactcgttcgactggaccat

SEQ ID NO: 9202 - DNA, 20 bp, Artificial Sequence
  Artificially Synthesized Primer Sequence
ttccacaagacccaggtttc

SEQ ID NO: 9203 - DNA, 20 bp, Artificial Sequence
  Artificially Synthesized Primer Sequence
gacacctgccacacaccata

SEQ ID NO: 9204 - DNA, 20 bp, Artificial Sequence
  Artificially Synthesized Primer Sequence
tcagagtcgacggaggagat

SEQ ID NO: 9205 - DNA, 20 bp, Artificial Sequence
  Artificially Synthesized Primer Sequence
ctttcccgctgttttgttgt

SEQ ID NO: 9206 - DNA, 20 bp, Artificial Sequence
  Artificially Synthesized Primer Sequence
gcccatcaggaaacgataga

SEQ ID NO: 9207 - DNA, 20 bp, Artificial Sequence
  Artificially Synthesized Primer Sequence
tcaaactgcatgacagcctc

SEQ ID NO: 9208 - DNA, 20 bp, Artificial Sequence
  Artificially Synthesized Primer Sequence
ctacgagaagctgaccctcg

SEQ ID NO: 9209 - DNA, 20 bp, Artificial Sequence
  Artificially Synthesized Primer Sequence
ttggattcatttcatgcgaa

SEQ ID NO: 9210 - DNA, 20 bp, Artificial Sequence
  Artificially Synthesized Primer Sequence
agtgcagagtcacgcatttg

SEQ ID NO: 9211 - DNA, 20 bp, Artificial Sequence
  Artificially Synthesized Primer Sequence
agcacaccgaaaccacctac

SEQ ID NO: 9212 - DNA, 20 bp, Artificial Sequence
  Artificially Synthesized Primer Sequence
gtggctggtctgttccagat

SEQ ID NO: 9213 - DNA, 20 bp, Artificial Sequence
  Artificially Synthesized Primer Sequence
aaggcacacatccacctttc

SEQ ID NO: 9214 - DNA, 20 bp, Artificial Sequence
  Artificially Synthesized Primer Sequence
ttccttccatggcttttgac

SEQ ID NO: 9215 - DNA, 20 bp, Artificial Sequence
  Artificially Synthesized Primer Sequence
ttccttccatggcttttgac

SEQ ID NO: 9216 - DNA, 20 bp, Artificial Sequence
  Artificially Synthesized Primer Sequence
aaggcacacatccacctttc

SEQ ID NO: 9217 - DNA, 20 bp, Artificial Sequence
  Artificially Synthesized Primer Sequence
gcatttttggctggtttgtt

SEQ ID NO: 9218 - DNA, 20 bp, Artificial Sequence
  Artificially Synthesized Primer Sequence
atgctagaaactggcctcca

SEQ ID NO: 9219 - DNA, 20 bp, Artificial Sequence
  Artificially Synthesized Primer Sequence
gccatggtttggaagagaaa

SEQ ID NO: 9220 - DNA, 20 bp, Artificial Sequence
  Artificially Synthesized Primer Sequence
aattggctgctgctgttctt

SEQ ID NO: 9221 - DNA, 20 bp, Artificial Sequence
  Artificially Synthesized Primer Sequence
cgagggaaacattggaagaa

SEQ ID NO: 9222 - DNA, 20 bp, Artificial Sequence
  Artificially Synthesized Primer Sequence
tgtaccacaacgggtctgaa

SEQ ID NO: 9223 - DNA, 20 bp, Artificial Sequence
  Artificially Synthesized Primer Sequence
ttggaaaaaggaaaagggct

SEQ ID NO: 9224 - DNA, 20 bp, Artificial Sequence
  Artificially Synthesized Primer Sequence
tgcactttttgctctggatg

SEQ ID NO: 9225 - DNA, 20 bp, Artificial Sequence
  Artificially Synthesized Primer Sequence
cgtcatcttcctcaagcaca

SEQ ID NO: 9226 - DNA, 20 bp, Artificial Sequence
  Artificially Synthesized Primer Sequence
gaaattactcctccggctcc

SEQ ID NO: 9227 - DNA, 20 bp, Artificial Sequence
  Artificially Synthesized Primer Sequence
atcctcggccattctacctc

SEQ ID NO: 9228 - DNA, 20 bp, Artificial Sequence
  Artificially Synthesized Primer Sequence
cgtcatcttcctcaagcaca

SEQ ID NO: 9229 - DNA, 20 bp, Artificial Sequence
  Artificially Synthesized Primer Sequence
ttcaggatggtagtacgggc

SEQ ID NO: 9230 - DNA, 20 bp, Artificial Sequence
  Artificially Synthesized Primer Sequence
tcgtagtcgtcgctatcgtg

SEQ ID NO: 9231 - DNA, 20 bp, Artificial Sequence
  Artificially Synthesized Primer Sequence
ctgttggctggctcaaatct

SEQ ID NO: 9232 - DNA, 18 bp, Artificial Sequence
  Artificially Synthesized Primer Sequence
acccttggattgccacct

SEQ ID NO: 9233 - DNA, 20 bp, Artificial Sequence
  Artificially Synthesized Primer Sequence
gctagaggatgctttgctgg

SEQ ID NO: 9234 - DNA, 20 bp, Artificial Sequence
  Artificially Synthesized Primer Sequence
acatgagggaaaacaggcac

SEQ ID NO: 9235 - DNA, 20 bp, Artificial Sequence
  Artificially Synthesized Primer Sequence
ctgtgtgttgcacattgctg

SEQ ID NO: 9236 - DNA, 20 bp, Artificial Sequence
  Artificially Synthesized Primer Sequence
aggctgcctctcaaactacg

SEQ ID NO: 9237 - DNA, 20 bp, Artificial Sequence
  Artificially Synthesized Primer Sequence
tagcgctggtaggatatggc

SEQ ID NO: 9238 - DNA, 20 bp, Artificial Sequence
  Artificially Synthesized Primer Sequence
ttggttggttggttgattga

SEQ ID NO: 9239 - DNA, 20 bp, Artificial Sequence
  Artificially Synthesized Primer Sequence
caaaaacccaagggaagacc

SEQ ID NO: 9240 - DNA, 20 bp, Artificial Sequence
  Artificially Synthesized Primer Sequence
ctgagatcgatgttcctgcc

SEQ ID NO: 9241 - DNA, 20 bp, Artificial Sequence
  Artificially Synthesized Primer Sequence
gcagatgcaagcaaacaaaa

SEQ ID NO: 9242 - DNA, 20 bp, Artificial Sequence
  Artificially Synthesized Primer Sequence
agtcagctgctcctccaaga

SEQ ID NO: 9243 - DNA, 20 bp, Artificial Sequence
  Artificially Synthesized Primer Sequence
acagattggtcaaggcgttc

SEQ ID NO: 9244 - DNA, 20 bp, Artificial Sequence
  Artificially Synthesized Primer Sequence
gcctggcaagatgaggataa

SEQ ID NO: 9245 - DNA, 20 bp, Artificial Sequence
  Artificially Synthesized Primer Sequence
gcccttctcgtgctattctg

SEQ ID NO: 9246 - DNA, 20 bp, Artificial Sequence
  Artificially Synthesized Primer Sequence
gcaaccggatgagattctgt

SEQ ID NO: 9247 - DNA, 20 bp, Artificial Sequence
  Artificially Synthesized Primer Sequence
acctgcaccgtagaatcacc

SEQ ID NO: 9248 - DNA, 20 bp, Artificial Sequence
  Artificially Synthesized Primer Sequence
tccaaactgttcgtagtgcg

SEQ ID NO: 9249 - DNA, 20 bp, Artificial Sequence
  Artificially Synthesized Primer Sequence
ctcgcacaaatcaggtagca

SEQ ID NO: 9250 - DNA, 20 bp, Artificial Sequence
  Artificially Synthesized Primer Sequence
gagccctacggaaatccttc

SEQ ID NO: 9251 - DNA, 20 bp, Artificial Sequence
  Artificially Synthesized Primer Sequence
gatgcaacgaacgagcacta

SEQ ID NO: 9252 - DNA, 20 bp, Artificial Sequence
  Artificially Synthesized Primer Sequence
aagacgaggacacggagaga

SEQ ID NO: 9253 - DNA, 20 bp, Artificial Sequence
  Artificially Synthesized Primer Sequence
aagagatgcgttccatggtc

SEQ ID NO: 9254 - DNA, 20 bp, Artificial Sequence
  Artificially Synthesized Primer Sequence
tctgatgttcagctccgttg

SEQ ID NO: 9255 - DNA, 20 bp, Artificial Sequence
  Artificially Synthesized Primer Sequence
ccactggaaccagccaatac

SEQ ID NO: 9256 - DNA, 20 bp, Artificial Sequence
  Artificially Synthesized Primer Sequence
caacggagctgaacatcaga

SEQ ID NO: 9257 - DNA, 20 bp, Artificial Sequence
  Artificially Synthesized Primer Sequence
ttttgccctcctgaatcaac

SEQ ID NO: 9258 - DNA, 20 bp, Artificial Sequence
  Artificially Synthesized Primer Sequence
acaaaccgcttccatctctg

SEQ ID NO: 9259 - DNA, 20 bp, Artificial Sequence
  Artificially Synthesized Primer Sequence
gcaacatttgggaaggctaa

SEQ ID NO: 9260 - DNA, 20 bp, Artificial Sequence
  Artificially Synthesized Primer Sequence
accattgtgaaacccccttt

SEQ ID NO: 9261 - DNA, 20 bp, Artificial Sequence
  Artificially Synthesized Primer Sequence
cagttctctgcaatgcgtgt

SEQ ID NO: 9262 - DNA, 20 bp, Artificial Sequence
  Artificially Synthesized Primer Sequence
tccacgggttacgtcttagg

SEQ ID NO: 9263 - DNA, 19 bp, Artificial Sequence
  Artificially Synthesized Primer Sequence
caaacaaattcggcaggtg

SEQ ID NO: 9264 - DNA, 20 bp, Artificial Sequence
  Artificially Synthesized Primer Sequence
tcagttgagaaagaagcgca

SEQ ID NO: 9265 - DNA, 20 bp, Artificial Sequence
  Artificially Synthesized Primer Sequence
tcatggttcaaccctcacaa

SEQ ID NO: 9266 - DNA, 20 bp, Artificial Sequence
  Artificially Synthesized Primer Sequence
gtatcgcatcgacccaaact

SEQ ID NO: 9267 - DNA, 20 bp, Artificial Sequence
  Artificially Synthesized Primer Sequence
aatgctaacaaccgcattcc

SEQ ID NO: 9268 - DNA, 20 bp, Artificial Sequence
  Artificially Synthesized Primer Sequence
gtttgggtcgatgcgatact

SEQ ID NO: 9269 - DNA, 20 bp, Artificial Sequence
  Artificially Synthesized Primer Sequence
agtggacaaggaaagcgaga

SEQ ID NO: 9270 - DNA, 20 bp, Artificial Sequence
  Artificially Synthesized Primer Sequence
tccaacaacaaccgttttca

SEQ ID NO: 9271 - DNA, 20 bp, Artificial Sequence
  Artificially Synthesized Primer Sequence
tatccgccgtcttctgtttt

SEQ ID NO: 9272 - DNA, 20 bp, Artificial Sequence
  Artificially Synthesized Primer Sequence
cgagggagtacgggtgttta

SEQ ID NO: 9273 - DNA, 20 bp, Artificial Sequence
  Artificially Synthesized Primer Sequence
caagagaaatcccaatccga

SEQ ID NO: 9274 - DNA, 20 bp, Artificial Sequence
  Artificially Synthesized Primer Sequence
cacagctcagtggccttgta

SEQ ID NO: 9275 - DNA, 20 bp, Artificial Sequence
  Artificially Synthesized Primer Sequence
ttaacaaaccgaatgcacga

SEQ ID NO: 9276 - DNA, 20 bp, Artificial Sequence
  Artificially Synthesized Primer Sequence
ggattgcatagaggatcgga

SEQ ID NO: 9277 - DNA, 20 bp, Artificial Sequence
  Artificially Synthesized Primer Sequence
gatttccattgtttggtggg

SEQ ID NO: 9278 - DNA, 20 bp, Artificial Sequence
  Artificially Synthesized Primer Sequence
cacgcagtgaagaagagcag

SEQ ID NO: 9279 - DNA, 20 bp, Artificial Sequence
  Artificially Synthesized Primer Sequence
acaccatcggttccatcttc

SEQ ID NO: 9280 - DNA, 20 bp, Artificial Sequence
  Artificially Synthesized Primer Sequence
accatcaaggttgtgcttcc

SEQ ID NO: 9281 - DNA, 20 bp, Artificial Sequence
  Artificially Synthesized Primer Sequence
cggtgagaagaaacaggagc

SEQ ID NO: 9282 - DNA, 20 bp, Artificial Sequence
  Artificially Synthesized Primer Sequence
aggtccgtggtcttgatctg

SEQ ID NO: 9283 - DNA, 20 bp, Artificial Sequence
  Artificially Synthesized Primer Sequence
tacacagcgatactttgcgg

SEQ ID NO: 9284 - DNA, 20 bp, Artificial Sequence
  Artificially Synthesized Primer Sequence
cttagttcgcttgtgggcat

SEQ ID NO: 9285 - DNA, 20 bp, Artificial Sequence
  Artificially Synthesized Primer Sequence
cagctgcaggttatcgtcaa

SEQ ID NO: 9286 - DNA, 20 bp, Artificial Sequence
  Artificially Synthesized Primer Sequence
aacggtcggtcctccttagt

SEQ ID NO: 9287 - DNA, 20 bp, Artificial Sequence
  Artificially Synthesized Primer Sequence
agatgcgcttctatccctga

SEQ ID NO: 9288 - DNA, 21 bp, Artificial Sequence
  Artificially Synthesized Primer Sequence
cggatgagtaccggtatgaaa

SEQ ID NO: 9289 - DNA, 20 bp, Artificial Sequence
  Artificially Synthesized Primer Sequence
tctcaaattgtcagcgatgc

SEQ ID NO: 9290 - DNA, 20 bp, Artificial Sequence
  Artificially Synthesized Primer Sequence
aaagcgtcgaaggcactaaa

SEQ ID NO: 9291 - DNA, 21 bp, Artificial Sequence
  Artificially Synthesized Primer Sequence
cacgcacacacacatcttttt

SEQ ID NO: 9292 - DNA, 20 bp, Artificial Sequence
  Artificially Synthesized Primer Sequence
cagcgcttccatttgtttct

SEQ ID NO: 9293 - DNA, 20 bp, Artificial Sequence
  Artificially Synthesized Primer Sequence
aatacgagttgttcccgacg

SEQ ID NO: 9294 - DNA, 20 bp, Artificial Sequence
  Artificially Synthesized Primer Sequence
tcgcagcaacttgtatggtc

SEQ ID NO: 9295 - DNA, 20 bp, Artificial Sequence
  Artificially Synthesized Primer Sequence
aggatagtcatcgccgcata

SEQ ID NO: 9296 - DNA, 20 bp, Artificial Sequence
  Artificially Synthesized Primer Sequence
gaaggtggcttcatgacgat

SEQ ID NO: 9297 - DNA, 20 bp, Artificial Sequence
  Artificially Synthesized Primer Sequence
acttggcttgttgtcccttg

SEQ ID NO: 9298 - DNA, 20 bp, Artificial Sequence
  Artificially Synthesized Primer Sequence
acaccaggtatgagatcggc

SEQ ID NO: 9299 - DNA, 20 bp, Artificial Sequence
  Artificially Synthesized Primer Sequence
gggttggttgctcatcatct

SEQ ID NO: 9300 - DNA, 20 bp, Artificial Sequence
  Artificially Synthesized Primer Sequence
gactcgtatcctcagcgtgg

SEQ ID NO: 9301 - DNA, 20 bp, Artificial Sequence
  Artificially Synthesized Primer Sequence
ggcacgagggtacaccttta

SEQ ID NO: 9302 - DNA, 20 bp, Artificial Sequence
  Artificially Synthesized Primer Sequence
ttaggagtgctgatgatgcg

SEQ ID NO: 9303 - DNA, 20 bp, Artificial Sequence
  Artificially Synthesized Primer Sequence
tgcggttcgtaatactccct

SEQ ID NO: 9304 - DNA, 20 bp, Artificial Sequence
  Artificially Synthesized Primer Sequence
tgttcatatgctgctccctg

SEQ ID NO: 9305 - DNA, 20 bp, Artificial Sequence
  Artificially Synthesized Primer Sequence
tgttaagggtgtttgtgcca

SEQ ID NO: 9306 - DNA, 20 bp, Artificial Sequence
  Artificially Synthesized Primer Sequence
gggagggaggtacagggata

SEQ ID NO: 9307 - DNA, 20 bp, Artificial Sequence
  Artificially Synthesized Primer Sequence
tggcacaaacacccttaaca

SEQ ID NO: 9308 - DNA, 20 bp, Artificial Sequence
  Artificially Synthesized Primer Sequence
tgcacaaactatggcaatcc

SEQ ID NO: 9309 - DNA, 20 bp, Artificial Sequence
  Artificially Synthesized Primer Sequence
tgtacaacaaagcaggctgg

SEQ ID NO: 9310 - DNA, 20 bp, Artificial Sequence
  Artificially Synthesized Primer Sequence
cgaggaagaagaactggacg

SEQ ID NO: 9311 - DNA, 20 bp, Artificial Sequence
  Artificially Synthesized Primer Sequence
tgatttagagtctcgccgct

SEQ ID NO: 9312 - DNA, 20 bp, Artificial Sequence
  Artificially Synthesized Primer Sequence
atccagttcctcatcatcgc

SEQ ID NO: 9313 - DNA, 20 bp, Artificial Sequence
  Artificially Synthesized Primer Sequence
aagcactccactggaaatgg

SEQ ID NO: 9314 - DNA, 20 bp, Artificial Sequence
  Artificially Synthesized Primer Sequence
ggaaggtgcctcatggtaga

SEQ ID NO: 9315 - DNA, 20 bp, Artificial Sequence
  Artificially Synthesized Primer Sequence
gaaaccccacaaactgagga

SEQ ID NO: 9316 - DNA, 20 bp, Artificial Sequence
  Artificially Synthesized Primer Sequence
gaaccatgcccacaagctat

SEQ ID NO: 9317 - DNA, 20 bp, Artificial Sequence
  Artificially Synthesized Primer Sequence
aggcctcagagtgtgctgat

SEQ ID NO: 9318 - DNA, 20 bp, Artificial Sequence
  Artificially Synthesized Primer Sequence
agaacattgttttgggccag

SEQ ID NO: 9319 - DNA, 20 bp, Artificial Sequence
  Artificially Synthesized Primer Sequence
gctggcgattggttgttatt

SEQ ID NO: 9320 - DNA, 20 bp, Artificial Sequence
  Artificially Synthesized Primer Sequence
agtaccacctgctgtccctg

SEQ ID NO: 9321 - DNA, 20 bp, Artificial Sequence
  Artificially Synthesized Primer Sequence
tgctgatcgaacactccaag

SEQ ID NO: 9322 - DNA, 20 bp, Artificial Sequence
  Artificially Synthesized Primer Sequence
gacttggcatggctcatctt

SEQ ID NO: 9323 - DNA, 20 bp, Artificial Sequence
  Artificially Synthesized Primer Sequence
cacattgtgcgctgtgagta

SEQ ID NO: 9324 - DNA, 21 bp, Artificial Sequence
  Artificially Synthesized Primer Sequence
gctcaacacagcctcataagc

SEQ ID NO: 9325 - DNA, 20 bp, Artificial Sequence
  Artificially Synthesized Primer Sequence
ccaccaacaaactcatcacg

SEQ ID NO: 9326 - DNA, 20 bp, Artificial Sequence
  Artificially Synthesized Primer Sequence
aatccaggtacgcattcagg

SEQ ID NO: 9327 - DNA, 21 bp, Artificial Sequence
  Artificially Synthesized Primer Sequence
tgtctggaccaacattgacag

SEQ ID NO: 9328 - DNA, 20 bp, Artificial Sequence
  Artificially Synthesized Primer Sequence
gacatcggtgacgacttcct

SEQ ID NO: 9329 - DNA, 20 bp, Artificial Sequence
  Artificially Synthesized Primer Sequence
ctgatcttccttacgccgag

SEQ ID NO: 9330 - DNA, 20 bp, Artificial Sequence
  Artificially Synthesized Primer Sequence
ccttcaagctcctggcatag

SEQ ID NO: 9331 - DNA, 20 bp, Artificial Sequence
  Artificially Synthesized Primer Sequence
ccttcaagctcctggcatag

SEQ ID NO: 9332 - DNA, 20 bp, Artificial Sequence
  Artificially Synthesized Primer Sequence
tgtcgacggagttacaggtg

SEQ ID NO: 9333 - DNA, 20 bp, Artificial Sequence
  Artificially Synthesized Primer Sequence
ctgatgctttccctcgagtc

SEQ ID NO: 9334 - DNA, 20 bp, Artificial Sequence
  Artificially Synthesized Primer Sequence
tcttgaccagtaccttgggc

SEQ ID NO: 9335 - DNA, 20 bp, Artificial Sequence
  Artificially Synthesized Primer Sequence
ccagtaccttgggctccata

SEQ ID NO: 9336 - DNA, 20 bp, Artificial Sequence
  Artificially Synthesized Primer Sequence
gtagcagcgaagaagaaggg

SEQ ID NO: 9337 - DNA, 20 bp, Artificial Sequence
  Artificially Synthesized Primer Sequence
tgcatcgacagctactttgg

SEQ ID NO: 9338 - DNA, 20 bp, Artificial Sequence
  Artificially Synthesized Primer Sequence
tttgtccgcttgttgttctg

SEQ ID NO: 9339 - DNA, 20 bp, Artificial Sequence
  Artificially Synthesized Primer Sequence
ccggccatccattttatttt

SEQ ID NO: 9340 - DNA, 20 bp, Artificial Sequence
  Artificially Synthesized Primer Sequence
catggaccaggtcttcgagt

SEQ ID NO: 9341 - DNA, 20 bp, Artificial Sequence
  Artificially Synthesized Primer Sequence
aattcctcgagcactgttgg

SEQ ID NO: 9342 - DNA, 20 bp, Artificial Sequence
  Artificially Synthesized Primer Sequence
cgttgtggtactggtcgttg

SEQ ID NO: 9343 - DNA, 20 bp, Artificial Sequence
  Artificially Synthesized Primer Sequence
tgaaagtacacgcaggcatc

SEQ ID NO: 9344 - DNA, 20 bp, Artificial Sequence
  Artificially Synthesized Primer Sequence
gtgtgcaccaagtcctttcc

SEQ ID NO: 9345 - DNA, 20 bp, Artificial Sequence
  Artificially Synthesized Primer Sequence
gagcacacggactgtacgaa

SEQ ID NO: 9346 - DNA, 20 bp, Artificial Sequence
  Artificially Synthesized Primer Sequence
ggactccactctgttctcgc

SEQ ID NO: 9347 - DNA, 20 bp, Artificial Sequence
  Artificially Synthesized Primer Sequence
aatgcagtttcattcccctg

SEQ ID NO: 9348 - DNA, 20 bp, Artificial Sequence
  Artificially Synthesized Primer Sequence
catgacatggaacatgcaca

SEQ ID NO: 9349 - DNA, 20 bp, Artificial Sequence
  Artificially Synthesized Primer Sequence
atgcggtgaagattttctgg

SEQ ID NO: 9350 - DNA, 20 bp, Artificial Sequence
  Artificially Synthesized Primer Sequence
caacccacaagcatgtcatc

SEQ ID NO: 9351 - DNA, 20 bp, Artificial Sequence
  Artificially Synthesized Primer Sequence
caccatcaccccctgtattc

SEQ ID NO: 9352 - DNA, 19 bp, Artificial Sequence
  Artificially Synthesized Primer Sequence
cttcaccgacaacgacacc

SEQ ID NO: 9353 - DNA, 20 bp, Artificial Sequence
  Artificially Synthesized Primer Sequence
gagtttcacaagctcctccg

SEQ ID NO: 9354 - DNA, 20 bp, Artificial Sequence
  Artificially Synthesized Primer Sequence
ggccgcctcaagatatacaa

SEQ ID NO: 9355 - DNA, 20 bp, Artificial Sequence
  Artificially Synthesized Primer Sequence
gattttgcccaatgcaagtt

SEQ ID NO: 9356 - DNA, 20 bp, Artificial Sequence
  Artificially Synthesized Primer Sequence
gactggcagagggaatgaag

SEQ ID NO: 9357 - DNA, 20 bp, Artificial Sequence
  Artificially Synthesized Primer Sequence
catggaccaggtcttcgagt

SEQ ID NO: 9358 - DNA, 20 bp, Artificial Sequence
  Artificially Synthesized Primer Sequence
acctggtgcagatagccttg

SEQ ID NO: 9359 - DNA, 19 bp, Artificial Sequence
  Artificially Synthesized Primer Sequence
cttacacgctgctggtgct

SEQ ID NO: 9360 - DNA, 19 bp, Artificial Sequence
  Artificially Synthesized Primer Sequence
gatctgcacctgcatggac

SEQ ID NO: 9361 - DNA, 20 bp, Artificial Sequence
  Artificially Synthesized Primer Sequence
ctcttctcccgcttctcctt

SEQ ID NO: 9362 - DNA, 20 bp, Artificial Sequence
  Artificially Synthesized Primer Sequence
ttgagtgtgcattttctcgg

SEQ ID NO: 9363 - DNA, 20 bp, Artificial Sequence
  Artificially Synthesized Primer Sequence
gcttgggcacaattcaaaat

SEQ ID NO: 9364 - DNA, 20 bp, Artificial Sequence
  Artificially Synthesized Primer Sequence
aatttgccgagaaaatgcac

SEQ ID NO: 9365 - DNA, 20 bp, Artificial Sequence
  Artificially Synthesized Primer Sequence
cttggatgctgatgcgtaga

SEQ ID NO: 9366 - DNA, 20 bp, Artificial Sequence
  Artificially Synthesized Primer Sequence
aaaacaccggggtcatacaa

SEQ ID NO: 9367 - DNA, 20 bp, Artificial Sequence
  Artificially Synthesized Primer Sequence
tgaggggaaaacaaaacacc

SEQ ID NO: 9368 - DNA, 20 bp, Artificial Sequence
  Artificially Synthesized Primer Sequence
cttggatgctgatgcgtaga

SEQ ID NO: 9369 - DNA, 20 bp, Artificial Sequence
  Artificially Synthesized Primer Sequence
gccttacgcatccattcagt

SEQ ID NO: 9370 - DNA, 20 bp, Artificial Sequence
  Artificially Synthesized Primer Sequence
agtcctttgaaagcaggcaa

SEQ ID NO: 9371 - DNA, 20 bp, Artificial Sequence
  Artificially Synthesized Primer Sequence
accgtcaagtgaaccacaca

SEQ ID NO: 9372 - DNA, 20 bp, Artificial Sequence
  Artificially Synthesized Primer Sequence
caaggtcccttccaagacaa

SEQ ID NO: 9373 - DNA, 20 bp, Artificial Sequence
  Artificially Synthesized Primer Sequence
gacagagaacgagcaaaggg

SEQ ID NO: 9374 - DNA, 20 bp, Artificial Sequence
  Artificially Synthesized Primer Sequence
ttggtgctcaaactgcagac

SEQ ID NO: 9375 - DNA, 20 bp, Artificial Sequence
  Artificially Synthesized Primer Sequence
attcctcccagcgaaaatct

SEQ ID NO: 9376 - DNA, 20 bp, Artificial Sequence
  Artificially Synthesized Primer Sequence
ggagcagcatttccattgat

SEQ ID NO: 9377 - DNA, 20 bp, Artificial Sequence
  Artificially Synthesized Primer Sequence
atgcttcagacgcagaaggt

SEQ ID NO: 9378 - DNA, 20 bp, Artificial Sequence
  Artificially Synthesized Primer Sequence
cctcttcgatccagtcttcg

SEQ ID NO: 9379 - DNA, 21 bp, Artificial Sequence
  Artificially Synthesized Primer Sequence
tggagtacggacgtcagaaaa

SEQ ID NO: 9380 - DNA, 20 bp, Artificial Sequence
  Artificially Synthesized Primer Sequence
acctacgtcgacctgtacgc

SEQ ID NO: 9381 - DNA, 20 bp, Artificial Sequence
  Artificially Synthesized Primer Sequence
ttactgcactgagggtgctg

SEQ ID NO: 9382 - DNA, 20 bp, Artificial Sequence
  Artificially Synthesized Primer Sequence
cactctagggcgattgggta

SEQ ID NO: 9383 - DNA, 20 bp, Artificial Sequence
  Artificially Synthesized Primer Sequence
gctttgttcagggaatcagc

SEQ ID NO: 9384 - DNA, 20 bp, Artificial Sequence
  Artificially Synthesized Primer Sequence
tcttcagttccggaaattcg

SEQ ID NO: 9385 - DNA, 20 bp, Artificial Sequence
  Artificially Synthesized Primer Sequence
gaaacaagaagccccacaaa

SEQ ID NO: 9386 - DNA, 20 bp, Artificial Sequence
  Artificially Synthesized Primer Sequence
gaggtgtcggggtgagaata

SEQ ID NO: 9387 - DNA, 20 bp, Artificial Sequence
  Artificially Synthesized Primer Sequence
gtatgcaggaaagcaacggt

SEQ ID NO: 9388 - DNA, 20 bp, Artificial Sequence
  Artificially Synthesized Primer Sequence
ggagcggacgactcttacag

SEQ ID NO: 9389 - DNA, 20 bp, Artificial Sequence
  Artificially Synthesized Primer Sequence
tctgttgcttgcaccttttg

SEQ ID NO: 9390 - DNA, 20 bp, Artificial Sequence
  Artificially Synthesized Primer Sequence
ctcctgggaagattgatgga

SEQ ID NO: 9391 - DNA, 20 bp, Artificial Sequence
  Artificially Synthesized Primer Sequence
ctcctgggaagattgatgga

SEQ ID NO: 9392 - DNA, 20 bp, Artificial Sequence
  Artificially Synthesized Primer Sequence
tctgttgcttgcaccttttg

SEQ ID NO: 9393 - DNA, 20 bp, Artificial Sequence
  Artificially Synthesized Primer Sequence
gacagccaaccacaaacctt

SEQ ID NO: 9394 - DNA, 20 bp, Artificial Sequence
  Artificially Synthesized Primer Sequence
ggtggtttattgtgttgggg

SEQ ID NO: 9395 - DNA, 20 bp, Artificial Sequence
  Artificially Synthesized Primer Sequence
cgctcttgcagatttcacaa

SEQ ID NO: 9396 - DNA, 20 bp, Artificial Sequence
  Artificially Synthesized Primer Sequence
aaggaatttggtgcgatgac

SEQ ID NO: 9397 - DNA, 20 bp, Artificial Sequence
  Artificially Synthesized Primer Sequence
ctctgttccaagcacaccaa

SEQ ID NO: 9398 - DNA, 20 bp, Artificial Sequence
  Artificially Synthesized Primer Sequence
ggagaaagtgtcgaacgagc

SEQ ID NO: 9399 - DNA, 20 bp, Artificial Sequence
  Artificially Synthesized Primer Sequence
taccgtttgaatcattgcca

SEQ ID NO: 9400 - DNA, 20 bp, Artificial Sequence
  Artificially Synthesized Primer Sequence
gatcaaggaggtggtggaga

SEQ ID NO: 9401 - DNA, 20 bp, Artificial Sequence
  Artificially Synthesized Primer Sequence
gcatcctacctacgatccga

SEQ ID NO: 9402 - DNA, 20 bp, Artificial Sequence
  Artificially Synthesized Primer Sequence
ccttctccttagtgcgttcg

SEQ ID NO: 9403 - DNA, 20 bp, Artificial Sequence
  Artificially Synthesized Primer Sequence
aacgcgatacagagatgcct

SEQ ID NO: 9404 - DNA, 20 bp, Artificial Sequence
  Artificially Synthesized Primer Sequence
cgtgaagaaggaggaggtca

SEQ ID NO: 9405 - DNA, 20 bp, Artificial Sequence
  Artificially Synthesized Primer Sequence
cagctgttgatcaggtggaa

SEQ ID NO: 9406 - DNA, 20 bp, Artificial Sequence
  Artificially Synthesized Primer Sequence
gaaacgctttgtggggatta

SEQ ID NO: 9407 - DNA, 20 bp, Artificial Sequence
  Artificially Synthesized Primer Sequence
cgtgaatcgagatacgggat

SEQ ID NO: 9408 - DNA, 20 bp, Artificial Sequence
  Artificially Synthesized Primer Sequence
gagaaactcggcaagacacc

SEQ ID NO: 9409 - DNA, 20 bp, Artificial Sequence
  Artificially Synthesized Primer Sequence
catctgatgttgcagcgagt

SEQ ID NO: 9410 - DNA, 20 bp, Artificial Sequence
  Artificially Synthesized Primer Sequence
aagtacacggtgctgatccc

SEQ ID NO: 9411 - DNA, 20 bp, Artificial Sequence
  Artificially Synthesized Primer Sequence
tagcagccagcctaaatcgt

SEQ ID NO: 9412 - DNA, 20 bp, Artificial Sequence
  Artificially Synthesized Primer Sequence
gggatcagcaccgtgtactt

SEQ ID NO: 9413 - DNA, 20 bp, Artificial Sequence
  Artificially Synthesized Primer Sequence
acaactgcaccaagacgttg

SEQ ID NO: 9414 - DNA, 20 bp, Artificial Sequence
  Artificially Synthesized Primer Sequence
cttctgcaaaaggtgaagcc

SEQ ID NO: 9415 - DNA, 20 bp, Artificial Sequence
  Artificially Synthesized Primer Sequence
tgccaccttctctaagcgtt

SEQ ID NO: 9416 - DNA, 20 bp, Artificial Sequence
  Artificially Synthesized Primer Sequence
cattggcttgtggtgcatac

SEQ ID NO: 9417 - DNA, 20 bp, Artificial Sequence
  Artificially Synthesized Primer Sequence
ttactaccaacagcccgtcc

SEQ ID NO: 9418 - DNA, 20 bp, Artificial Sequence
  Artificially Synthesized Primer Sequence
aggggtacccatagtttccg

SEQ ID NO: 9419 - DNA, 22 bp, Artificial Sequence
  Artificially Synthesized Primer Sequence
catttcaacctcagtaccatcg

SEQ ID NO: 9420 - DNA, 20 bp, Artificial Sequence
  Artificially Synthesized Primer Sequence
caagtcgatggcaaacattg

SEQ ID NO: 9421 - DNA, 20 bp, Artificial Sequence
  Artificially Synthesized Primer Sequence
ttcttttggcggtgttatcc

SEQ ID NO: 9422 - DNA, 20 bp, Artificial Sequence
  Artificially Synthesized Primer Sequence
ctcctcacagtgggttcgat

SEQ ID NO: 9423 - DNA, 20 bp, Artificial Sequence
  Artificially Synthesized Primer Sequence
gaacgggcataaacatgagg

SEQ ID NO: 9424 - DNA, 20 bp, Artificial Sequence
  Artificially Synthesized Primer Sequence
cgcttcacttgttgggattt

SEQ ID NO: 9425 - DNA, 20 bp, Artificial Sequence
  Artificially Synthesized Primer Sequence
agctttcctgttccaagcaa

SEQ ID NO: 9426 - DNA, 20 bp, Artificial Sequence
  Artificially Synthesized Primer Sequence
cccgaaaagagtggaacgta

SEQ ID NO: 9427 - DNA, 20 bp, Artificial Sequence
  Artificially Synthesized Primer Sequence
aggtgttgtgcttctggtcc

SEQ ID NO: 9428 - DNA, 20 bp, Artificial Sequence
  Artificially Synthesized Primer Sequence
gactgaagaaagtgagcgcc

SEQ ID NO: 9429 - DNA, 20 bp, Artificial Sequence
  Artificially Synthesized Primer Sequence
ggctggcactcaactttctc

SEQ ID NO: 9430 - DNA, 20 bp, Artificial Sequence
  Artificially Synthesized Primer Sequence
gcgtgaagaccgaacttagc

SEQ ID NO: 9431 - DNA, 20 bp, Artificial Sequence
  Artificially Synthesized Primer Sequence
ttgggagcatccttcatttc

SEQ ID NO: 9432 - DNA, 20 bp, Artificial Sequence
  Artificially Synthesized Primer Sequence
ctaccgctccagagtccaag

SEQ ID NO: 9433 - DNA, 20 bp, Artificial Sequence
  Artificially Synthesized Primer Sequence
gcatgcacacatactggacc

SEQ ID NO: 9434 - DNA, 20 bp, Artificial Sequence
  Artificially Synthesized Primer Sequence
gaaagctcgtccttccctct

SEQ ID NO: 9435 - DNA, 20 bp, Artificial Sequence
  Artificially Synthesized Primer Sequence
ctgttgcttccgccagtagt

SEQ ID NO: 9436 - DNA, 20 bp, Artificial Sequence
  Artificially Synthesized Primer Sequence
ggcaagattaggctgctgtt

SEQ ID NO: 9437 - DNA, 20 bp, Artificial Sequence
  Artificially Synthesized Primer Sequence
tcgagcagaaggaagagagc

SEQ ID NO: 9438 - DNA, 20 bp, Artificial Sequence
  Artificially Synthesized Primer Sequence
tgagcagctttgtatgccac

SEQ ID NO: 9439 - DNA, 20 bp, Artificial Sequence
  Artificially Synthesized Primer Sequence
accaacaaccacactgacga

SEQ ID NO: 9440 - DNA, 20 bp, Artificial Sequence
  Artificially Synthesized Primer Sequence
gtggcatacaaagctgctca

SEQ ID NO: 9441 - DNA, 20 bp, Artificial Sequence
  Artificially Synthesized Primer Sequence
ctgcagctactcagctcgtg

SEQ ID NO: 9442 - DNA, 20 bp, Artificial Sequence
  Artificially Synthesized Primer Sequence
tgacctcaacgtactcagcg

SEQ ID NO: 9443 - DNA, 20 bp, Artificial Sequence
  Artificially Synthesized Primer Sequence
gggagtgaaggaacaaccaa

SEQ ID NO: 9444 - DNA, 19 bp, Artificial Sequence
  Artificially Synthesized Primer Sequence
agcccctgcatctcctatg

SEQ ID NO: 9445 - DNA, 20 bp, Artificial Sequence
  Artificially Synthesized Primer Sequence
gccttgcctcacagattctc

SEQ ID NO: 9446 - DNA, 20 bp, Artificial Sequence
  Artificially Synthesized Primer Sequence
tcgccatacgttaagcacag

SEQ ID NO: 9447 - DNA, 20 bp, Artificial Sequence
  Artificially Synthesized Primer Sequence
aagcgcaacgaatcaaagtt

SEQ ID NO: 9448 - DNA, 20 bp, Artificial Sequence
  Artificially Synthesized Primer Sequence
tccgatgttgctgtctgtgt

SEQ ID NO: 9449 - DNA, 20 bp, Artificial Sequence
  Artificially Synthesized Primer Sequence
catcatctccggcttagctc

SEQ ID NO: 9450 - DNA, 20 bp, Artificial Sequence
  Artificially Synthesized Primer Sequence
agtggtcgatcagcgaatct

SEQ ID NO: 9451 - DNA, 20 bp, Artificial Sequence
  Artificially Synthesized Primer Sequence
agtggtcgatcagcgaatct

SEQ ID NO: 9452 - DNA, 20 bp, Artificial Sequence
  Artificially Synthesized Primer Sequence
catcatctccggcttagctc

SEQ ID NO: 9453 - DNA, 20 bp, Artificial Sequence
  Artificially Synthesized Primer Sequence
gacaagcaagctacgtgcag

SEQ ID NO: 9454 - DNA, 20 bp, Artificial Sequence
  Artificially Synthesized Primer Sequence
aacgtacagcaaactcccgt

SEQ ID NO: 9455 - DNA, 20 bp, Artificial Sequence
  Artificially Synthesized Primer Sequence
aacgtacagcaaactcccgt

SEQ ID NO: 9456 - DNA, 20 bp, Artificial Sequence
  Artificially Synthesized Primer Sequence
gacaagcaagctacgtgcag

SEQ ID NO: 9457 - DNA, 20 bp, Artificial Sequence
  Artificially Synthesized Primer Sequence
tgttggcctactggaaaacc

SEQ ID NO: 9458 - DNA, 20 bp, Artificial Sequence
  Artificially Synthesized Primer Sequence
catggcttgttgcttttgtg

SEQ ID NO: 9459 - DNA, 20 bp, Artificial Sequence
  Artificially Synthesized Primer Sequence
cgcaaaattgaggaacacaa

SEQ ID NO: 9460 - DNA, 20 bp, Artificial Sequence
  Artificially Synthesized Primer Sequence
ggagattgccaaagcagaac

SEQ ID NO: 9461 - DNA, 20 bp, Artificial Sequence
  Artificially Synthesized Primer Sequence
atgggatgcaacgagaaatc

SEQ ID NO: 9462 - DNA, 20 bp, Artificial Sequence
  Artificially Synthesized Primer Sequence
gccttgtcacggatcttcat

SEQ ID NO: 9463 - DNA, 20 bp, Artificial Sequence
  Artificially Synthesized Primer Sequence
ataactgggaagcaaggcaa

SEQ ID NO: 9464 - DNA, 20 bp, Artificial Sequence
  Artificially Synthesized Primer Sequence
gcaatgttggtgtaggaccc

SEQ ID NO: 9465 - DNA, 20 bp, Artificial Sequence
  Artificially Synthesized Primer Sequence
ctgcagctactcagctcgtg

SEQ ID NO: 9466 - DNA, 20 bp, Artificial Sequence
  Artificially Synthesized Primer Sequence
gctataggcagaaacgacgg

SEQ ID NO: 9467 - DNA, 20 bp, Artificial Sequence
  Artificially Synthesized Primer Sequence
gctataggcagaaacgacgg

SEQ ID NO: 9468 - DNA, 20 bp, Artificial Sequence
  Artificially Synthesized Primer Sequence
ctgcagctactcagctcgtg

SEQ ID NO: 9469 - DNA, 20 bp, Artificial Sequence
  Artificially Synthesized Primer Sequence
tgaagcagtggttgaacgag

SEQ ID NO: 9470 - DNA, 20 bp, Artificial Sequence
  Artificially Synthesized Primer Sequence
aagcatggactcaaggatgg

SEQ ID NO: 9471 - DNA, 20 bp, Artificial Sequence
  Artificially Synthesized Primer Sequence
gctgtctccaaactccatcc

SEQ ID NO: 9472 - DNA, 20 bp, Artificial Sequence
  Artificially Synthesized Primer Sequence
catggagaccagtgcaaaga

SEQ ID NO: 9473 - DNA, 20 bp, Artificial Sequence
  Artificially Synthesized Primer Sequence
agatgagcaccatgttcgtg

SEQ ID NO: 9474 - DNA, 20 bp, Artificial Sequence
  Artificially Synthesized Primer Sequence
gtacgaagccgagcaatctc

SEQ ID NO: 9475 - DNA, 20 bp, Artificial Sequence
  Artificially Synthesized Primer Sequence
tctgccagatttttccaagc

SEQ ID NO: 9476 - DNA, 20 bp, Artificial Sequence
  Artificially Synthesized Primer Sequence
ctacaagaagaccgccgaag

SEQ ID NO: 9477 - DNA, 20 bp, Artificial Sequence
  Artificially Synthesized Primer Sequence
tttcctttgaagctggcagt

SEQ ID NO: 9478 - DNA, 20 bp, Artificial Sequence
  Artificially Synthesized Primer Sequence
tgaggcgtcttaacttgggt

SEQ ID NO: 9479 - DNA, 20 bp, Artificial Sequence
  Artificially Synthesized Primer Sequence
caatttgcaagcacaagcac

SEQ ID NO: 9480 - DNA, 20 bp, Artificial Sequence
  Artificially Synthesized Primer Sequence
tgcctcgaaagtctaaggga

SEQ ID NO: 9481 - DNA, 20 bp, Artificial Sequence
  Artificially Synthesized Primer Sequence
aaaacccccaataaacagcc

SEQ ID NO: 9482 - DNA, 20 bp, Artificial Sequence
  Artificially Synthesized Primer Sequence
tattaaaggccgagtgtggg

SEQ ID NO: 9483 - DNA, 21 bp, Artificial Sequence
  Artificially Synthesized Primer Sequence
tggaataaactctctgcaccc

SEQ ID NO: 9484 - DNA, 20 bp, Artificial Sequence
  Artificially Synthesized Primer Sequence
acaactaccggaaatgccac

SEQ ID NO: 9485 - DNA, 20 bp, Artificial Sequence
  Artificially Synthesized Primer Sequence
gtttttctttccgagggagg

SEQ ID NO: 9486 - DNA, 20 bp, Artificial Sequence
  Artificially Synthesized Primer Sequence
ccgccctatgcatatcaact

SEQ ID NO: 9487 - DNA, 20 bp, Artificial Sequence
  Artificially Synthesized Primer Sequence
atgtcttttctcccaacccc

SEQ ID NO: 9488 - DNA, 20 bp, Artificial Sequence
  Artificially Synthesized Primer Sequence
taaaagagtcgctccggcta

SEQ ID NO: 9489 - DNA, 20 bp, Artificial Sequence
  Artificially Synthesized Primer Sequence
tcactatagggcgaattggg

SEQ ID NO: 9490 - DNA, 20 bp, Artificial Sequence
  Artificially Synthesized Primer Sequence
gtgacgttggacctgacctt

SEQ ID NO: 9491 - DNA, 20 bp, Artificial Sequence
  Artificially Synthesized Primer Sequence
tgacatgaatccgacgaaaa

SEQ ID NO: 9492 - DNA, 19 bp, Artificial Sequence
  Artificially Synthesized Primer Sequence
gcgtttcaggtggagaagg

SEQ ID NO: 9493 - DNA, 20 bp, Artificial Sequence
  Artificially Synthesized Primer Sequence
tgaacggttacgtctgcaag

SEQ ID NO: 9494 - DNA, 20 bp, Artificial Sequence
  Artificially Synthesized Primer Sequence
tacatctgaatccggtgcaa

SEQ ID NO: 9495 - DNA, 20 bp, Artificial Sequence
  Artificially Synthesized Primer Sequence
tacatctgaatccggtgcaa

SEQ ID NO: 9496 - DNA, 20 bp, Artificial Sequence
  Artificially Synthesized Primer Sequence
tgaacggttacgtctgcaag

SEQ ID NO: 9497 - DNA, 20 bp, Artificial Sequence
  Artificially Synthesized Primer Sequence
caaccaccaacttcatgcac

SEQ ID NO: 9498 - DNA, 20 bp, Artificial Sequence
  Artificially Synthesized Primer Sequence
aagtccataggggaattggg

SEQ ID NO: 9499 - DNA, 20 bp, Artificial Sequence
  Artificially Synthesized Primer Sequence
tactactggtttcgtggggc

SEQ ID NO: 9500 - DNA, 20 bp, Artificial Sequence
  Artificially Synthesized Primer Sequence
atgacgatgaagatgagggc

SEQ ID NO: 9501 - DNA, 20 bp, Artificial Sequence
  Artificially Synthesized Primer Sequence
attacgacccaaacagcagg

SEQ ID NO: 9502 - DNA, 20 bp, Artificial Sequence
  Artificially Synthesized Primer Sequence
cacattttcactggcacacc

SEQ ID NO: 9503 - DNA, 20 bp, Artificial Sequence
  Artificially Synthesized Primer Sequence
ccgaaagttcccctgtgtaa

SEQ ID NO: 9504 - DNA, 20 bp, Artificial Sequence
  Artificially Synthesized Primer Sequence
gtggcaagtctgtggacctt

SEQ ID NO: 9505 - DNA, 20 bp, Artificial Sequence
  Artificially Synthesized Primer Sequence
cacctgtggtgacattctgg

SEQ ID NO: 9506 - DNA, 20 bp, Artificial Sequence
  Artificially Synthesized Primer Sequence
aatggactgctgtttgggtc

SEQ ID NO: 9507 - DNA, 20 bp, Artificial Sequence
  Artificially Synthesized Primer Sequence
caacattcactggcacaacc

SEQ ID NO: 9508 - DNA, 20 bp, Artificial Sequence
  Artificially Synthesized Primer Sequence
tttgtcaatgtgggagtgga

SEQ ID NO: 9509 - DNA, 20 bp, Artificial Sequence
  Artificially Synthesized Primer Sequence
cttcccctcacagtcaccat

SEQ ID NO: 9510 - DNA, 20 bp, Artificial Sequence
  Artificially Synthesized Primer Sequence
gcagttttgagttccgaagc

SEQ ID NO: 9511 - DNA, 20 bp, Artificial Sequence
  Artificially Synthesized Primer Sequence
ctgaagccctacccaggttt

SEQ ID NO: 9512 - DNA, 20 bp, Artificial Sequence
  Artificially Synthesized Primer Sequence
ctgcgaacttggaagaggag

SEQ ID NO: 9513 - DNA, 20 bp, Artificial Sequence
  Artificially Synthesized Primer Sequence
tgtacgatgtacgcgatggt

SEQ ID NO: 9514 - DNA, 20 bp, Artificial Sequence
  Artificially Synthesized Primer Sequence
gcatgctggagtgctcaata

SEQ ID NO: 9515 - DNA, 20 bp, Artificial Sequence
  Artificially Synthesized Primer Sequence
aagttcacatcgcccatttc

SEQ ID NO: 9516 - DNA, 20 bp, Artificial Sequence
  Artificially Synthesized Primer Sequence
aacggttgaaggacaaatgc

SEQ ID NO: 9517 - DNA, 20 bp, Artificial Sequence
  Artificially Synthesized Primer Sequence
ccgtccgtttttgtttttgt

SEQ ID NO: 9518 - DNA, 20 bp, Artificial Sequence
  Artificially Synthesized Primer Sequence
aagagagcagaggagagggg

SEQ ID NO: 9519 - DNA, 20 bp, Artificial Sequence
  Artificially Synthesized Primer Sequence
gacgtcagcaatgctctctg

SEQ ID NO: 9520 - DNA, 20 bp, Artificial Sequence
  Artificially Synthesized Primer Sequence
atgaagccaagcttgagagg

SEQ ID NO: 9521 - DNA, 20 bp, Artificial Sequence
  Artificially Synthesized Primer Sequence
tttgctctctttgccaggat

SEQ ID NO: 9522 - DNA, 20 bp, Artificial Sequence
  Artificially Synthesized Primer Sequence
tcaaggcgtcgatttcttct

SEQ ID NO: 9523 - DNA, 20 bp, Artificial Sequence
  Artificially Synthesized Primer Sequence
caaggcgtcgatttcttctc

SEQ ID NO: 9524 - DNA, 20 bp, Artificial Sequence
  Artificially Synthesized Primer Sequence
ttgctctctttgccaggatt

SEQ ID NO: 9525 - DNA, 20 bp, Artificial Sequence
  Artificially Synthesized Primer Sequence
gacaagaagcccgacaagag

SEQ ID NO: 9526 - DNA, 20 bp, Artificial Sequence
  Artificially Synthesized Primer Sequence
ggctcgacccttctatgtca

SEQ ID NO: 9527 - DNA, 20 bp, Artificial Sequence
  Artificially Synthesized Primer Sequence
ttcgggtttgagagagagga

SEQ ID NO: 9528 - DNA, 20 bp, Artificial Sequence
  Artificially Synthesized Primer Sequence
ttgttgtggtgcataaggga

SEQ ID NO: 9529 - DNA, 20 bp, Artificial Sequence
  Artificially Synthesized Primer Sequence
cgcaaacttctactgccaca

SEQ ID NO: 9530 - DNA, 20 bp, Artificial Sequence
  Artificially Synthesized Primer Sequence
caggaatggaggaaggatca

SEQ ID NO: 9531 - DNA, 20 bp, Artificial Sequence
  Artificially Synthesized Primer Sequence
caggaatggaggaaggatca

SEQ ID NO: 9532 - DNA, 20 bp, Artificial Sequence
  Artificially Synthesized Primer Sequence
acctgcagatgaagattggg

SEQ ID NO: 9533 - DNA, 20 bp, Artificial Sequence
  Artificially Synthesized Primer Sequence
ttgtcatgtgcttctcctgc

SEQ ID NO: 9534 - DNA, 20 bp, Artificial Sequence
  Artificially Synthesized Primer Sequence
ttgatatgatagcggggagg

SEQ ID NO: 9535 - DNA, 20 bp, Artificial Sequence
  Artificially Synthesized Primer Sequence
gataagacgggaaaggcaca

SEQ ID NO: 9536 - DNA, 20 bp, Artificial Sequence
  Artificially Synthesized Primer Sequence
acacatggagacagcatgga

SEQ ID NO: 9537 - DNA, 20 bp, Artificial Sequence
  Artificially Synthesized Primer Sequence
cgaatcaacacatggagacg

SEQ ID NO: 9538 - DNA, 20 bp, Artificial Sequence
  Artificially Synthesized Primer Sequence
tatggatagaaccaagccgc

SEQ ID NO: 9539 - DNA, 20 bp, Artificial Sequence
  Artificially Synthesized Primer Sequence
tagataagacggggaaggca

SEQ ID NO: 9540 - DNA, 20 bp, Artificial Sequence
  Artificially Synthesized Primer Sequence
cgaatcaacacatggagacg

SEQ ID NO: 9541 - DNA, 20 bp, Artificial Sequence
  Artificially Synthesized Primer Sequence
tgacaccacgaaacctacca

SEQ ID NO: 9542 - DNA, 20 bp, Artificial Sequence
  Artificially Synthesized Primer Sequence
gctcagaattcctcactgcc

SEQ ID NO: 9543 - DNA, 20 bp, Artificial Sequence
  Artificially Synthesized Primer Sequence
tcactgccatttggctaaca

SEQ ID NO: 9544 - DNA, 20 bp, Artificial Sequence
  Artificially Synthesized Primer Sequence
tgacaccacgaaacctacca

SEQ ID NO: 9545 - DNA, 20 bp, Artificial Sequence
  Artificially Synthesized Primer Sequence
gaaggcaattcttcactcgc

SEQ ID NO: 9546 - DNA, 20 bp, Artificial Sequence
  Artificially Synthesized Primer Sequence
ctgagacgcatgattaggca

SEQ ID NO: 9547 - DNA, 20 bp, Artificial Sequence
  Artificially Synthesized Primer Sequence
gaaggcaattcttcactcgc

SEQ ID NO: 9548 - DNA, 20 bp, Artificial Sequence
  Artificially Synthesized Primer Sequence
agggcaatgcatcttgacat

SEQ ID NO: 9549 - DNA, 20 bp, Artificial Sequence
  Artificially Synthesized Primer Sequence
aacaaggacgattgtcaggg

SEQ ID NO: 9550 - DNA, 20 bp, Artificial Sequence
  Artificially Synthesized Primer Sequence
tggaatccgtagttccttgg

SEQ ID NO: 9551 - DNA, 20 bp, Artificial Sequence
  Artificially Synthesized Primer Sequence
tcctgatgcacccactacag

SEQ ID NO: 9552 - DNA, 20 bp, Artificial Sequence
  Artificially Synthesized Primer Sequence
agctgcatcgaaggtttcag

SEQ ID NO: 9553 - DNA, 20 bp, Artificial Sequence
  Artificially Synthesized Primer Sequence
gctcaagaaaagtggcttgg

SEQ ID NO: 9554 - DNA, 20 bp, Artificial Sequence
  Artificially Synthesized Primer Sequence
gaagcatgctgcctagaacc

SEQ ID NO: 9555 - DNA, 20 bp, Artificial Sequence
  Artificially Synthesized Primer Sequence
atttccaccgatcttgttgc

SEQ ID NO: 9556 - DNA, 20 bp, Artificial Sequence
  Artificially Synthesized Primer Sequence
gcaaagtggttctaggcagc

SEQ ID NO: 9557 - DNA, 20 bp, Artificial Sequence
  Artificially Synthesized Primer Sequence
tcaaatgtcacagctggctc

SEQ ID NO: 9558 - DNA, 20 bp, Artificial Sequence
  Artificially Synthesized Primer Sequence
tataccagagaaatcgggcg

SEQ ID NO: 9559 - DNA, 20 bp, Artificial Sequence
  Artificially Synthesized Primer Sequence
agttgtttgccgcagaactt

SEQ ID NO: 9560 - DNA, 20 bp, Artificial Sequence
  Artificially Synthesized Primer Sequence
gtcttgcattttggccatct

SEQ ID NO: 9561 - DNA, 20 bp, Artificial Sequence
  Artificially Synthesized Primer Sequence
gcaagctggagtcaatcctc

SEQ ID NO: 9562 - DNA, 20 bp, Artificial Sequence
  Artificially Synthesized Primer Sequence
tgagggccttgtttgtaacc

SEQ ID NO: 9563 - DNA, 20 bp, Artificial Sequence
  Artificially Synthesized Primer Sequence
cgccttacagaacagcacaa

SEQ ID NO: 9564 - DNA, 20 bp, Artificial Sequence
  Artificially Synthesized Primer Sequence
ggaaagaagggcaaaaggtc

SEQ ID NO: 9565 - DNA, 20 bp, Artificial Sequence
  Artificially Synthesized Primer Sequence
gagacaatagaagcgaggcg

SEQ ID NO: 9566 - DNA, 20 bp, Artificial Sequence
  Artificially Synthesized Primer Sequence
tctcggtttatctgatgccc

SEQ ID NO: 9567 - DNA, 20 bp, Artificial Sequence
  Artificially Synthesized Primer Sequence
ccccttctttggttctctcc

SEQ ID NO: 9568 - DNA, 20 bp, Artificial Sequence
  Artificially Synthesized Primer Sequence
gggcatcagataaaccgaga

SEQ ID NO: 9569 - DNA, 20 bp, Artificial Sequence
  Artificially Synthesized Primer Sequence
agcatctgcaagcacatcac

SEQ ID NO: 9570 - DNA, 20 bp, Artificial Sequence
  Artificially Synthesized Primer Sequence
cagggcacacttggattttt

SEQ ID NO: 9571 - DNA, 19 bp, Artificial Sequence
  Artificially Synthesized Primer Sequence
agcactggtttgctcatgc

SEQ ID NO: 9572 - DNA, 20 bp, Artificial Sequence
  Artificially Synthesized Primer Sequence
ctgcatcaggatggtgaaca

SEQ ID NO: 9573 - DNA, 20 bp, Artificial Sequence
  Artificially Synthesized Primer Sequence
caagggtcaaggatgaggaa

SEQ ID NO: 9574 - DNA, 20 bp, Artificial Sequence
  Artificially Synthesized Primer Sequence
gcatatgcatcgttcaccag

SEQ ID NO: 9575 - DNA, 20 bp, Artificial Sequence
  Artificially Synthesized Primer Sequence
caaaacagaaacaccgctca

SEQ ID NO: 9576 - DNA, 20 bp, Artificial Sequence
  Artificially Synthesized Primer Sequence
caagggtcaaggatgaggaa

SEQ ID NO: 9577 - DNA, 20 bp, Artificial Sequence
  Artificially Synthesized Primer Sequence
aagaccagccccaacttctt

SEQ ID NO: 9578 - DNA, 20 bp, Artificial Sequence
  Artificially Synthesized Primer Sequence
gtctgacccttctcgctttg

SEQ ID NO: 9579 - DNA, 20 bp, Artificial Sequence
  Artificially Synthesized Primer Sequence
gcagatcttgttccagctcc

SEQ ID NO: 9580 - DNA, 20 bp, Artificial Sequence
  Artificially Synthesized Primer Sequence
aagaccagccccaacttctt

SEQ ID NO: 9581 - DNA, 20 bp, Artificial Sequence
  Artificially Synthesized Primer Sequence
tgcgatggttgatgaggata

SEQ ID NO: 9582 - DNA, 20 bp, Artificial Sequence
  Artificially Synthesized Primer Sequence
tcgctcaatctctagcagca

SEQ ID NO: 9583 - DNA, 20 bp, Artificial Sequence
  Artificially Synthesized Primer Sequence
tcgctcaatctctagcagca

SEQ ID NO: 9584 - DNA, 19 bp, Artificial Sequence
  Artificially Synthesized Primer Sequence
actgcgtgttcttcctccc

SEQ ID NO: 9585 - DNA, 20 bp, Artificial Sequence
  Artificially Synthesized Primer Sequence
tcctccgtctcgtcgttact

SEQ ID NO: 9586 - DNA, 20 bp, Artificial Sequence
  Artificially Synthesized Primer Sequence
gtcgatggtcttgtcctggt

SEQ ID NO: 9587 - DNA, 20 bp, Artificial Sequence
  Artificially Synthesized Primer Sequence
tggttttacaaaagggcgag

SEQ ID NO: 9588 - DNA, 20 bp, Artificial Sequence
  Artificially Synthesized Primer Sequence
gctacatctactccagcggc

SEQ ID NO: 9589 - DNA, 20 bp, Artificial Sequence
  Artificially Synthesized Primer Sequence
gcttcacctgctgtcatcaa

SEQ ID NO: 9590 - DNA, 20 bp, Artificial Sequence
  Artificially Synthesized Primer Sequence
ttttcatcggctatcaaggg

SEQ ID NO: 9591 - DNA, 20 bp, Artificial Sequence
  Artificially Synthesized Primer Sequence
acaggttcatggggtgttgt

SEQ ID NO: 9592 - DNA, 20 bp, Artificial Sequence
  Artificially Synthesized Primer Sequence
gcttcacctgctgtcatcaa

SEQ ID NO: 9593 - DNA, 20 bp, Artificial Sequence
  Artificially Synthesized Primer Sequence
gacgtcctcgatgatttcgt

SEQ ID NO: 9594 - DNA, 20 bp, Artificial Sequence
  Artificially Synthesized Primer Sequence
ggggcgaggtagtaggagaa

SEQ ID NO: 9595 - DNA, 20 bp, Artificial Sequence
  Artificially Synthesized Primer Sequence
cagaacaccttgctgctcaa

SEQ ID NO: 9596 - DNA, 20 bp, Artificial Sequence
  Artificially Synthesized Primer Sequence
catgatcgcacttgaggtga

SEQ ID NO: 9597 - DNA, 20 bp, Artificial Sequence
  Artificially Synthesized Primer Sequence
agccgtgaatgacatgttga

SEQ ID NO: 9598 - DNA, 20 bp, Artificial Sequence
  Artificially Synthesized Primer Sequence
gctcgatcatttcaggcttc

SEQ ID NO: 9599 - DNA, 20 bp, Artificial Sequence
  Artificially Synthesized Primer Sequence
gcatgaataacttgcagcga

SEQ ID NO: 9600 - DNA, 20 bp, Artificial Sequence
  Artificially Synthesized Primer Sequence
gatctgaaggagcgctatgc

SEQ ID NO: 9601 - DNA, 20 bp, Artificial Sequence
  Artificially Synthesized Primer Sequence
gtatcagcgtacccccagaa

SEQ ID NO: 9602 - DNA, 20 bp, Artificial Sequence
  Artificially Synthesized Primer Sequence
ggcaaatttagctcgctcac

SEQ ID NO: 9603 - DNA, 20 bp, Artificial Sequence
  Artificially Synthesized Primer Sequence
acaaaactcaaggccacacc

SEQ ID NO: 9604 - DNA, 20 bp, Artificial Sequence
  Artificially Synthesized Primer Sequence
cgactccttggcttctgaac

SEQ ID NO: 9605 - DNA, 20 bp, Artificial Sequence
  Artificially Synthesized Primer Sequence
tcagtgactcacacatcgca

SEQ ID NO: 9606 - DNA, 20 bp, Artificial Sequence
  Artificially Synthesized Primer Sequence
agaaaaatggggcaagaggt

SEQ ID NO: 9607 - DNA, 20 bp, Artificial Sequence
  Artificially Synthesized Primer Sequence
cacatgtatctcgccattcg

SEQ ID NO: 9608 - DNA, 20 bp, Artificial Sequence
  Artificially Synthesized Primer Sequence
ggtgtacctcgtctccaagc

SEQ ID NO: 9609 - DNA, 20 bp, Artificial Sequence
  Artificially Synthesized Primer Sequence
ggcctactgggagagattcc

SEQ ID NO: 9610 - DNA, 20 bp, Artificial Sequence
  Artificially Synthesized Primer Sequence
ccctccttatagccctctcg

SEQ ID NO: 9611 - DNA, 20 bp, Artificial Sequence
  Artificially Synthesized Primer Sequence
taatcagatggcagtgcagg

SEQ ID NO: 9612 - DNA, 20 bp, Artificial Sequence
  Artificially Synthesized Primer Sequence
tgctgctgcttttcgaagta

SEQ ID NO: 9613 - DNA, 20 bp, Artificial Sequence
  Artificially Synthesized Primer Sequence
ggaggaggatgatggtgaga

SEQ ID NO: 9614 - DNA, 20 bp, Artificial Sequence
  Artificially Synthesized Primer Sequence
tctgaacggggttatccttg

SEQ ID NO: 9615 - DNA, 20 bp, Artificial Sequence
  Artificially Synthesized Primer Sequence
cgaacaatttcgaagccatt

SEQ ID NO: 9616 - DNA, 20 bp, Artificial Sequence
  Artificially Synthesized Primer Sequence
ttggtgtattcggggaggta

SEQ ID NO: 9617 - DNA, 20 bp, Artificial Sequence
  Artificially Synthesized Primer Sequence
agcttcaaggcgagactgag

SEQ ID NO: 9618 - DNA, 20 bp, Artificial Sequence
  Artificially Synthesized Primer Sequence
caatggcttctgacacgcta

SEQ ID NO: 9619 - DNA, 20 bp, Artificial Sequence
  Artificially Synthesized Primer Sequence
tcacatgcttcccaaacaaa

SEQ ID NO: 9620 - DNA, 20 bp, Artificial Sequence
  Artificially Synthesized Primer Sequence
gacgacacacttctcacgga

SEQ ID NO: 9621 - DNA, 20 bp, Artificial Sequence
  Artificially Synthesized Primer Sequence
ccgtacaaggagctgaaagc

SEQ ID NO: 9622 - DNA, 20 bp, Artificial Sequence
  Artificially Synthesized Primer Sequence
gcacttggtgcgtagactga

SEQ ID NO: 9623 - DNA, 20 bp, Artificial Sequence
  Artificially Synthesized Primer Sequence
ggcatttgattcgcacctat

SEQ ID NO: 9624 - DNA, 20 bp, Artificial Sequence
  Artificially Synthesized Primer Sequence
aaggctccggagtttgctat

SEQ ID NO: 9625 - DNA, 20 bp, Artificial Sequence
  Artificially Synthesized Primer Sequence
tcgaatcagagattccccac

SEQ ID NO: 9626 - DNA, 20 bp, Artificial Sequence
  Artificially Synthesized Primer Sequence
gcagtatgccgagtgctgta

SEQ ID NO: 9627 - DNA, 20 bp, Artificial Sequence
  Artificially Synthesized Primer Sequence
tgtcaatttgcttctggctg

SEQ ID NO: 9628 - DNA, 20 bp, Artificial Sequence
  Artificially Synthesized Primer Sequence
ttcaaaagggcacaaccttc

SEQ ID NO: 9629 - DNA, 20 bp, Artificial Sequence
  Artificially Synthesized Primer Sequence
tcatgctgctcaagttctgc

SEQ ID NO: 9630 - DNA, 20 bp, Artificial Sequence
  Artificially Synthesized Primer Sequence
acaagagtccggtgtcgttc

SEQ ID NO: 9631 - DNA, 20 bp, Artificial Sequence
  Artificially Synthesized Primer Sequence
ttataacccagcaggcaaca

SEQ ID NO: 9632 - DNA, 20 bp, Artificial Sequence
  Artificially Synthesized Primer Sequence
gctggacatgactgaggagg

SEQ ID NO: 9633 - DNA, 20 bp, Artificial Sequence
  Artificially Synthesized Primer Sequence
cctttcctctgagcatggag

SEQ ID NO: 9634 - DNA, 20 bp, Artificial Sequence
  Artificially Synthesized Primer Sequence
atggtgtacccaccgttgtt

SEQ ID NO: 9635 - DNA, 20 bp, Artificial Sequence
  Artificially Synthesized Primer Sequence
cgtgcaacaacagtggactc

SEQ ID NO: 9636 - DNA, 20 bp, Artificial Sequence
  Artificially Synthesized Primer Sequence
cctgataaacaacggtgggt

SEQ ID NO: 9637 - DNA, 20 bp, Artificial Sequence
  Artificially Synthesized Primer Sequence
tcctcatctccactcaaccc

SEQ ID NO: 9638 - DNA, 20 bp, Artificial Sequence
  Artificially Synthesized Primer Sequence
cgagatagagcggtggaaag

SEQ ID NO: 9639 - DNA, 20 bp, Artificial Sequence
  Artificially Synthesized Primer Sequence
cacatcagagcaggccatta

SEQ ID NO: 9640 - DNA, 20 bp, Artificial Sequence
  Artificially Synthesized Primer Sequence
ccttttcgtccatccactgt

SEQ ID NO: 9641 - DNA, 20 bp, Artificial Sequence
  Artificially Synthesized Primer Sequence
cggagcttgctgatacttcc

SEQ ID NO: 9642 - DNA, 20 bp, Artificial Sequence
  Artificially Synthesized Primer Sequence
taccccagaccacactagcc

SEQ ID NO: 9643 - DNA, 20 bp, Artificial Sequence
  Artificially Synthesized Primer Sequence
aaatcacgacgagttggcat

SEQ ID NO: 9644 - DNA, 20 bp, Artificial Sequence
  Artificially Synthesized Primer Sequence
caagtcgttggaggagaagc

SEQ ID NO: 9645 - DNA, 20 bp, Artificial Sequence
  Artificially Synthesized Primer Sequence
cactacaccgcctacgacaa

SEQ ID NO: 9646 - DNA, 20 bp, Artificial Sequence
  Artificially Synthesized Primer Sequence
cacgtaccccaaccaatctc

SEQ ID NO: 9647 - DNA, 20 bp, Artificial Sequence
  Artificially Synthesized Primer Sequence
gtgcccctactctgcttcac

SEQ ID NO: 9648 - DNA, 20 bp, Artificial Sequence
  Artificially Synthesized Primer Sequence
cactacaccgcctacgacaa

SEQ ID NO: 9649 - DNA, 20 bp, Artificial Sequence
  Artificially Synthesized Primer Sequence
gatatcgcccccgttatttt

SEQ ID NO: 9650 - DNA, 20 bp, Artificial Sequence
  Artificially Synthesized Primer Sequence
caagaggagtgggaggatga

SEQ ID NO: 9651 - DNA, 20 bp, Artificial Sequence
  Artificially Synthesized Primer Sequence
gagttgctcaccacccactt

SEQ ID NO: 9652 - DNA, 20 bp, Artificial Sequence
  Artificially Synthesized Primer Sequence
agatgcactggtttgcactg

SEQ ID NO: 9653 - DNA, 20 bp, Artificial Sequence
  Artificially Synthesized Primer Sequence
gcttgcatggaccagtacct

SEQ ID NO: 9654 - DNA, 20 bp, Artificial Sequence
  Artificially Synthesized Primer Sequence
ccaaagggagaaaggtgtca

SEQ ID NO: 9655 - DNA, 20 bp, Artificial Sequence
  Artificially Synthesized Primer Sequence
ttaccaatggtgtagcccgt

SEQ ID NO: 9656 - DNA, 20 bp, Artificial Sequence
  Artificially Synthesized Primer Sequence
tttggacttccttgggacac

SEQ ID NO: 9657 - DNA, 20 bp, Artificial Sequence
  Artificially Synthesized Primer Sequence
gcttcagctacacggagagc

SEQ ID NO: 9658 - DNA, 20 bp, Artificial Sequence
  Artificially Synthesized Primer Sequence
catgctccaggtgtgatgtc

SEQ ID NO: 9659 - DNA, 20 bp, Artificial Sequence
  Artificially Synthesized Primer Sequence
aagaatggacaagctggtgg

SEQ ID NO: 9660 - DNA, 20 bp, Artificial Sequence
  Artificially Synthesized Primer Sequence
agagtgcagcaggagaggat

SEQ ID NO: 9661 - DNA, 20 bp, Artificial Sequence
  Artificially Synthesized Primer Sequence
agttcaattgcctggtggag

SEQ ID NO: 9662 - DNA, 20 bp, Artificial Sequence
  Artificially Synthesized Primer Sequence
gcacgcattcagctatttca

SEQ ID NO: 9663 - DNA, 20 bp, Artificial Sequence
  Artificially Synthesized Primer Sequence
tattgtcacaaaagcgccag

SEQ ID NO: 9664 - DNA, 20 bp, Artificial Sequence
  Artificially Synthesized Primer Sequence
ttgtcagccactacagctcg

SEQ ID NO: 9665 - DNA, 20 bp, Artificial Sequence
  Artificially Synthesized Primer Sequence
ttttgccgaaagcaagaagt

SEQ ID NO: 9666 - DNA, 20 bp, Artificial Sequence
  Artificially Synthesized Primer Sequence
ctatggaatcgccaagcatt

SEQ ID NO: 9667 - DNA, 20 bp, Artificial Sequence
  Artificially Synthesized Primer Sequence
gctgcttctttcaggctttg

SEQ ID NO: 9668 - DNA, 20 bp, Artificial Sequence
  Artificially Synthesized Primer Sequence
cggattatggcctgatcact

SEQ ID NO: 9669 - DNA, 20 bp, Artificial Sequence
  Artificially Synthesized Primer Sequence
tgtctctccccaatggtctc

SEQ ID NO: 9670 - DNA, 20 bp, Artificial Sequence
  Artificially Synthesized Primer Sequence
ccggtgaaggaggtgaaata

SEQ ID NO: 9671 - DNA, 20 bp, Artificial Sequence
  Artificially Synthesized Primer Sequence
tattcacagcatcccccttc

SEQ ID NO: 9672 - DNA, 20 bp, Artificial Sequence
  Artificially Synthesized Primer Sequence
gattctgccaaccctcaaaa

SEQ ID NO: 9673 - DNA, 20 bp, Artificial Sequence
  Artificially Synthesized Primer Sequence
ggtccttgtccgggaattat

SEQ ID NO: 9674 - DNA, 20 bp, Artificial Sequence
  Artificially Synthesized Primer Sequence
tttactggttgctggttccc

SEQ ID NO: 9675 - DNA, 20 bp, Artificial Sequence
  Artificially Synthesized Primer Sequence
tccagcaagggctattctgt

SEQ ID NO: 9676 - DNA, 19 bp, Artificial Sequence
  Artificially Synthesized Primer Sequence
gaggatgctgtcaagggtg

SEQ ID NO: 9677 - DNA, 20 bp, Artificial Sequence
  Artificially Synthesized Primer Sequence
ggagattttcccaaacccaa

SEQ ID NO: 9678 - DNA, 20 bp, Artificial Sequence
  Artificially Synthesized Primer Sequence
ttaaaaaccctctcccctcc

SEQ ID NO: 9679 - DNA, 20 bp, Artificial Sequence
  Artificially Synthesized Primer Sequence
gaaaatggtaagcagccgag

SEQ ID NO: 9680 - DNA, 20 bp, Artificial Sequence
  Artificially Synthesized Primer Sequence
caaatccagatgtgccaatg

SEQ ID NO: 9681 - DNA, 20 bp, Artificial Sequence
  Artificially Synthesized Primer Sequence
gcctactggagcttcaccac

SEQ ID NO: 9682 - DNA, 20 bp, Artificial Sequence
  Artificially Synthesized Primer Sequence
ccgatgttcttcagcggtat

SEQ ID NO: 9683 - DNA, 20 bp, Artificial Sequence
  Artificially Synthesized Primer Sequence
gaaaagccctcacaaatcca

SEQ ID NO: 9684 - DNA, 20 bp, Artificial Sequence
  Artificially Synthesized Primer Sequence
acgccgagcagatcaactac

SEQ ID NO: 9685 - DNA, 20 bp, Artificial Sequence
  Artificially Synthesized Primer Sequence
agctggcttgtgagttcgat

SEQ ID NO: 9686 - DNA, 20 bp, Artificial Sequence
  Artificially Synthesized Primer Sequence
tggacctcggtgaatctttc

SEQ ID NO: 9687 - DNA, 20 bp, Artificial Sequence
  Artificially Synthesized Primer Sequence
ttcagtgggattctgttccc

SEQ ID NO: 9688 - DNA, 20 bp, Artificial Sequence
  Artificially Synthesized Primer Sequence
cgattccgtagtacccctca

SEQ ID NO: 9689 - DNA, 20 bp, Artificial Sequence
  Artificially Synthesized Primer Sequence
ctcgaggcaaaaggaaactg

SEQ ID NO: 9690 - DNA, 20 bp, Artificial Sequence
  Artificially Synthesized Primer Sequence
gagaaggccagctctaccaa

SEQ ID NO: 9691 - DNA, 20 bp, Artificial Sequence
  Artificially Synthesized Primer Sequence
aagcctgtgggactccataa

SEQ ID NO: 9692 - DNA, 20 bp, Artificial Sequence
  Artificially Synthesized Primer Sequence
ttgcaaggactcattgggta

SEQ ID NO: 9693 - DNA, 20 bp, Artificial Sequence
  Artificially Synthesized Primer Sequence
tctggccttggaatagatgg

SEQ ID NO: 9694 - DNA, 20 bp, Artificial Sequence
  Artificially Synthesized Primer Sequence
atcctcgttacagccacacc

SEQ ID NO: 9695 - DNA, 20 bp, Artificial Sequence
  Artificially Synthesized Primer Sequence
gagtgcaaaccctcgagttc

SEQ ID NO: 9696 - DNA, 20 bp, Artificial Sequence
  Artificially Synthesized Primer Sequence
gaacctgaaaacaccgggta

SEQ ID NO: 9697 - DNA, 20 bp, Artificial Sequence
  Artificially Synthesized Primer Sequence
ctccatgaaccacgacacac

SEQ ID NO: 9698 - DNA, 20 bp, Artificial Sequence
  Artificially Synthesized Primer Sequence
ggtaacgttcttgagcgtcc

SEQ ID NO: 9699 - DNA, 20 bp, Artificial Sequence
  Artificially Synthesized Primer Sequence
ccttgttctagccgcttttg

SEQ ID NO: 9700 - DNA, 20 bp, Artificial Sequence
  Artificially Synthesized Primer Sequence
atacaccctgtgatcgctcc

SEQ ID NO: 9701 - DNA, 20 bp, Artificial Sequence
  Artificially Synthesized Primer Sequence
tcagtaaccgttccactccc

SEQ ID NO: 9702 - DNA, 20 bp, Artificial Sequence
  Artificially Synthesized Primer Sequence
ggcgtgtgtagggaagtcat

SEQ ID NO: 9703 - DNA, 20 bp, Artificial Sequence
  Artificially Synthesized Primer Sequence
ttttgggatacaccagccat

SEQ ID NO: 9704 - DNA, 20 bp, Artificial Sequence
  Artificially Synthesized Primer Sequence
gagaaccaaacgacgagagc

SEQ ID NO: 9705 - DNA, 20 bp, Artificial Sequence
  Artificially Synthesized Primer Sequence
tggtgcttcagatgcgtaag

SEQ ID NO: 9706 - DNA, 20 bp, Artificial Sequence
  Artificially Synthesized Primer Sequence
cgggaaacatcttctggaaa

SEQ ID NO: 9707 - DNA, 20 bp, Artificial Sequence
  Artificially Synthesized Primer Sequence
accaacaaagcagtatcccg

SEQ ID NO: 9708 - DNA, 20 bp, Artificial Sequence
  Artificially Synthesized Primer Sequence
agccaccctgaagcatctaa

SEQ ID NO: 9709 - DNA, 20 bp, Artificial Sequence
  Artificially Synthesized Primer Sequence
tgcactcttcggcctacttt

SEQ ID NO: 9710 - DNA, 20 bp, Artificial Sequence
  Artificially Synthesized Primer Sequence
gcttacacggtaccgcattt

SEQ ID NO: 9711 - DNA, 20 bp, Artificial Sequence
  Artificially Synthesized Primer Sequence
tacacggtaccgcattttca

SEQ ID NO: 9712 - DNA, 20 bp, Artificial Sequence
  Artificially Synthesized Primer Sequence
tgcactcttcggcctacttt

SEQ ID NO: 9713 - DNA, 20 bp, Artificial Sequence
  Artificially Synthesized Primer Sequence
ttgcatcggacagagagttg

SEQ ID NO: 9714 - DNA, 20 bp, Artificial Sequence
  Artificially Synthesized Primer Sequence
ttgagaggccaatggagagt

SEQ ID NO: 9715 - DNA, 20 bp, Artificial Sequence
  Artificially Synthesized Primer Sequence
agtcattcttgggccctttc

SEQ ID NO: 9716 - DNA, 21 bp, Artificial Sequence
  Artificially Synthesized Primer Sequence
tgcatccaactgactcagaga

SEQ ID NO: 9717 - DNA, 20 bp, Artificial Sequence
  Artificially Synthesized Primer Sequence
cgctgttggttacttcagca

SEQ ID NO: 9718 - DNA, 20 bp, Artificial Sequence
  Artificially Synthesized Primer Sequence
catatccccatttctcccct

SEQ ID NO: 9719 - DNA, 20 bp, Artificial Sequence
  Artificially Synthesized Primer Sequence
ttgtacaaaaaggttcccgc

SEQ ID NO: 9720 - DNA, 20 bp, Artificial Sequence
  Artificially Synthesized Primer Sequence
cacgtgcagctgaagagaag

SEQ ID NO: 9721 - DNA, 20 bp, Artificial Sequence
  Artificially Synthesized Primer Sequence
acatttacagttctggcggc

SEQ ID NO: 9722 - DNA, 20 bp, Artificial Sequence
  Artificially Synthesized Primer Sequence
tctctcctcatgatcggctt

SEQ ID NO: 9723 - DNA, 20 bp, Artificial Sequence
  Artificially Synthesized Primer Sequence
gtagcggtccctgcagtaaa

SEQ ID NO: 9724 - DNA, 20 bp, Artificial Sequence
  Artificially Synthesized Primer Sequence
aggctattgtcggcagttgt

SEQ ID NO: 9725 - DNA, 20 bp, Artificial Sequence
  Artificially Synthesized Primer Sequence
ctcagcatagcacacctgga

SEQ ID NO: 9726 - DNA, 20 bp, Artificial Sequence
  Artificially Synthesized Primer Sequence
agcgggaaaagaagaaggag

SEQ ID NO: 9727 - DNA, 20 bp, Artificial Sequence
  Artificially Synthesized Primer Sequence
ccatgaaggtcccacttgat

SEQ ID NO: 9728 - DNA, 20 bp, Artificial Sequence
  Artificially Synthesized Primer Sequence
tgcactcagcatagcagacc

SEQ ID NO: 9729 - DNA, 20 bp, Artificial Sequence
  Artificially Synthesized Primer Sequence
acccaacctcttttgacgtg

SEQ ID NO: 9730 - DNA, 20 bp, Artificial Sequence
  Artificially Synthesized Primer Sequence
ctcagaaagaaggtccacgg

SEQ ID NO: 9731 - DNA, 20 bp, Artificial Sequence
  Artificially Synthesized Primer Sequence
gccacatgtagcttgtgcag

SEQ ID NO: 9732 - DNA, 20 bp, Artificial Sequence
  Artificially Synthesized Primer Sequence
gctccggtaattcccagttt

SEQ ID NO: 9733 - DNA, 20 bp, Artificial Sequence
  Artificially Synthesized Primer Sequence
agcttgaatggagggtgaga

SEQ ID NO: 9734 - DNA, 20 bp, Artificial Sequence
  Artificially Synthesized Primer Sequence
gtcacccttcttccctgaca

SEQ ID NO: 9735 - DNA, 20 bp, Artificial Sequence
  Artificially Synthesized Primer Sequence
gcctctagctagcacaaccg

SEQ ID NO: 9736 - DNA, 20 bp, Artificial Sequence
  Artificially Synthesized Primer Sequence
gaagactgatgcacctgctg

SEQ ID NO: 9737 - DNA, 20 bp, Artificial Sequence
  Artificially Synthesized Primer Sequence
gccagtctcaacacaagcaa

SEQ ID NO: 9738 - DNA, 20 bp, Artificial Sequence
  Artificially Synthesized Primer Sequence
ccaccctttcctttcacaaa

SEQ ID NO: 9739 - DNA, 20 bp, Artificial Sequence
  Artificially Synthesized Primer Sequence
ccactcattagcgtgcagaa

SEQ ID NO: 9740 - DNA, 20 bp, Artificial Sequence
  Artificially Synthesized Primer Sequence
gaagccttcgtcaagtcagg

SEQ ID NO: 9741 - DNA, 20 bp, Artificial Sequence
  Artificially Synthesized Primer Sequence
accacatcctcatcgtctcc

SEQ ID NO: 9742 - DNA, 20 bp, Artificial Sequence
  Artificially Synthesized Primer Sequence
ggatagctttgcctgactcg

SEQ ID NO: 9743 - DNA, 20 bp, Artificial Sequence
  Artificially Synthesized Primer Sequence
cacccaaacctgagcaaaat

SEQ ID NO: 9744 - DNA, 20 bp, Artificial Sequence
  Artificially Synthesized Primer Sequence
ggaccaacaaagctgctcat

SEQ ID NO: 9745 - DNA, 20 bp, Artificial Sequence
  Artificially Synthesized Primer Sequence
catgcctacctcctctgctc

SEQ ID NO: 9746 - DNA, 20 bp, Artificial Sequence
  Artificially Synthesized Primer Sequence
aagatgcggtcgtactggac

SEQ ID NO: 9747 - DNA, 20 bp, Artificial Sequence
  Artificially Synthesized Primer Sequence
cgtataacacgaccccaacc

SEQ ID NO: 9748 - DNA, 20 bp, Artificial Sequence
  Artificially Synthesized Primer Sequence
taatgggaacagaagtgggc

SEQ ID NO: 9749 - DNA, 20 bp, Artificial Sequence
  Artificially Synthesized Primer Sequence
gttggagcagcactgaacaa

SEQ ID NO: 9750 - DNA, 20 bp, Artificial Sequence
  Artificially Synthesized Primer Sequence
cagtgaaccaacacattgcc

SEQ ID NO: 9751 - DNA, 20 bp, Artificial Sequence
  Artificially Synthesized Primer Sequence
acagaggttgggatccaatg

SEQ ID NO: 9752 - DNA, 20 bp, Artificial Sequence
  Artificially Synthesized Primer Sequence
tggcaatgtgttggttcact

SEQ ID NO: 9753 - DNA, 20 bp, Artificial Sequence
  Artificially Synthesized Primer Sequence
tccataaagatggctcaggg

SEQ ID NO: 9754 - DNA, 20 bp, Artificial Sequence
  Artificially Synthesized Primer Sequence
ggcaactcctttgattggaa

SEQ ID NO: 9755 - DNA, 21 bp, Artificial Sequence
  Artificially Synthesized Primer Sequence
gctagcacaaccggattattg

SEQ ID NO: 9756 - DNA, 20 bp, Artificial Sequence
  Artificially Synthesized Primer Sequence
atgaagatggctcaggggtt

SEQ ID NO: 9757 - DNA, 20 bp, Artificial Sequence
  Artificially Synthesized Primer Sequence
ttggaaccacaagaaccaca

SEQ ID NO: 9758 - DNA, 20 bp, Artificial Sequence
  Artificially Synthesized Primer Sequence
cattcttccaagtccgcatt

SEQ ID NO: 9759 - DNA, 20 bp, Artificial Sequence
  Artificially Synthesized Primer Sequence
ttcggcacaacaaaagtgtc

SEQ ID NO: 9760 - DNA, 20 bp, Artificial Sequence
  Artificially Synthesized Primer Sequence
aatgcggacttggaagaatg

SEQ ID NO: 9761 - DNA, 20 bp, Artificial Sequence
  Artificially Synthesized Primer Sequence
ctgcaaaaacatgagcctga

SEQ ID NO: 9762 - DNA, 20 bp, Artificial Sequence
  Artificially Synthesized Primer Sequence
tcaggaggaaaacgaccatc

SEQ ID NO: 9763 - DNA, 20 bp, Artificial Sequence
  Artificially Synthesized Primer Sequence
ggcgaaatttcatcttccag

SEQ ID NO: 9764 - DNA, 20 bp, Artificial Sequence
  Artificially Synthesized Primer Sequence
gtcagggatagcgccaagta

SEQ ID NO: 9765 - DNA, 20 bp, Artificial Sequence
  Artificially Synthesized Primer Sequence
attcctaaaaagccaccgct

SEQ ID NO: 9766 - DNA, 20 bp, Artificial Sequence
  Artificially Synthesized Primer Sequence
tccacgctcttgatcagttg

SEQ ID NO: 9767 - DNA, 20 bp, Artificial Sequence
  Artificially Synthesized Primer Sequence
cccgcagtcctttgaaatta

SEQ ID NO: 9768 - DNA, 20 bp, Artificial Sequence
  Artificially Synthesized Primer Sequence
agcgggcctattttgattct

SEQ ID NO: 9769 - DNA, 20 bp, Artificial Sequence
  Artificially Synthesized Primer Sequence
gctctgggggtttacatcaa

SEQ ID NO: 9770 - DNA, 20 bp, Artificial Sequence
  Artificially Synthesized Primer Sequence
ccttaccggctacctcatca

SEQ ID NO: 9771 - DNA, 20 bp, Artificial Sequence
  Artificially Synthesized Primer Sequence
tggtcgaatttggattctcc

SEQ ID NO: 9772 - DNA, 20 bp, Artificial Sequence
  Artificially Synthesized Primer Sequence
cagtggaatggctaccgagt

SEQ ID NO: 9773 - DNA, 20 bp, Artificial Sequence
  Artificially Synthesized Primer Sequence
tgcaattgtggtgcctgtat

SEQ ID NO: 9774 - DNA, 20 bp, Artificial Sequence
  Artificially Synthesized Primer Sequence
tccccggagtttaagatgtg

SEQ ID NO: 9775 - DNA, 20 bp, Artificial Sequence
  Artificially Synthesized Primer Sequence
taaccccgtaacaaccgaag

SEQ ID NO: 9776 - DNA, 20 bp, Artificial Sequence
  Artificially Synthesized Primer Sequence
gcaattgtggtgcctgtatg

SEQ ID NO: 9777 - DNA, 10 bp, Artificial Sequence
  Artificially Synthesized Primer Sequence
  MISC_FEATURE (1)..(10): n stands for any base
nnnnnnnnnn

SEQ ID NO: 9778 - DNA, 10 bp, Artificial Sequence
  Artificially Synthesized Primer Sequence
  MISC_FEATURE (1)..(10): n stands for any base
nnnnnnnnnn

SEQ ID NO: 9779 - DNA, 20 bp, Artificial Sequence
  Artificially Synthesized Primer Sequence
ggcagcaaattactgtgggt

SEQ ID NO: 9780 - DNA, 20 bp, Artificial Sequence
  Artificially Synthesized Primer Sequence
aggcgacgcttatcttggta

SEQ ID NO: 9781 - DNA, 20 bp, Artificial Sequence
  Artificially Synthesized Primer Sequence
gctcttgggtgtctcctcag

SEQ ID NO: 9782 - DNA, 20 bp, Artificial Sequence
  Artificially Synthesized Primer Sequence
ggctctgcaggttctcaatc

SEQ ID NO: 9783 - DNA, 20 bp, Artificial Sequence
  Artificially Synthesized Primer Sequence
gcagaagctcaactcaggct

SEQ ID NO: 9784 - DNA, 20 bp, Artificial Sequence
  Artificially Synthesized Primer Sequence
aggaggaagatgatgcgatg

SEQ ID NO: 9785 - DNA, 20 bp, Artificial Sequence
  Artificially Synthesized Primer Sequence
aattcctcgagcactgttgg

SEQ ID NO: 9786 - DNA, 20 bp, Artificial Sequence
  Artificially Synthesized Primer Sequence
gtggtagagctgtccggtgt

SEQ ID NO: 9787 - DNA, 20 bp, Artificial Sequence
  Artificially Synthesized Primer Sequence
cttccgtatggcaacgattt

SEQ ID NO: 9788 - DNA, 20 bp, Artificial Sequence
  Artificially Synthesized Primer Sequence
gtgatggtgatggtggagtg

SEQ ID NO: 9789 - DNA, 20 bp, Artificial Sequence
  Artificially Synthesized Primer Sequence
gatctggtcgtcggatctgt

SEQ ID NO: 9790 - DNA, 20 bp, Artificial Sequence
  Artificially Synthesized Primer Sequence
aaaaagcccaattagcccat

SEQ ID NO: 9791 - DNA, 20 bp, Artificial Sequence
  Artificially Synthesized Primer Sequence
aactcgaatcagatcagccc

SEQ ID NO: 9792 - DNA, 20 bp, Artificial Sequence
  Artificially Synthesized Primer Sequence
ctctccctcccactcctttc

SEQ ID NO: 9793 - DNA, 20 bp, Artificial Sequence
  Artificially Synthesized Primer Sequence
cttcgtcgtgggatcctaaa

SEQ ID NO: 9794 - DNA, 20 bp, Artificial Sequence
  Artificially Synthesized Primer Sequence
tgcatgtgaaaccaccaact

SEQ ID NO: 9795 - DNA, 20 bp, Artificial Sequence
  Artificially Synthesized Primer Sequence
tacaggtgcacagcaaaagg

SEQ ID NO: 9796 - DNA, 20 bp, Artificial Sequence
  Artificially Synthesized Primer Sequence
cttcgtcgtgggatcctaaa

SEQ ID NO: 9797 - DNA, 20 bp, Artificial Sequence
  Artificially Synthesized Primer Sequence
agtaggttgccctggtgatg

SEQ ID NO: 9798 - DNA, 20 bp, Artificial Sequence
  Artificially Synthesized Primer Sequence
actaccacctgcttgatggc

SEQ ID NO: 9799 - DNA, 20 bp, Artificial Sequence
  Artificially Synthesized Primer Sequence
ttcttgcatgattgaatcgg

SEQ ID NO: 9800 - DNA, 20 bp, Artificial Sequence
  Artificially Synthesized Primer Sequence
agtaggttgccctggtgatg

SEQ ID NO: 9801 - DNA, 20 bp, Artificial Sequence
  Artificially Synthesized Primer Sequence
ggatgcatctgccatttctt

SEQ ID NO: 9802 - DNA, 20 bp, Artificial Sequence
  Artificially Synthesized Primer Sequence
gcacaccaggaaaggttcat

SEQ ID NO: 9803 - DNA, 20 bp, Artificial Sequence
  Artificially Synthesized Primer Sequence
gaagcttcgccttgacactc

SEQ ID NO: 9804 - DNA, 20 bp, Artificial Sequence
  Artificially Synthesized Primer Sequence
gaggagtagctcgttgtcgg

SEQ ID NO: 9805 - DNA, 20 bp, Artificial Sequence
  Artificially Synthesized Primer Sequence
ccacccagataccactgacc

SEQ ID NO: 9806 - DNA, 20 bp, Artificial Sequence
  Artificially Synthesized Primer Sequence
ggggaagaagtacgggagag

SEQ ID NO: 9807 - DNA, 20 bp, Artificial Sequence
  Artificially Synthesized Primer Sequence
ggccgattaaaagatcgtca

SEQ ID NO: 9808 - DNA, 20 bp, Artificial Sequence
  Artificially Synthesized Primer Sequence
gaccgcaggaagctgtactc

SEQ ID NO: 9809 - DNA, 20 bp, Artificial Sequence
  Artificially Synthesized Primer Sequence
gttcgtgaaacacaccatcg

SEQ ID NO: 9810 - DNA, 20 bp, Artificial Sequence
  Artificially Synthesized Primer Sequence
tgagattcggtcaacatgga

SEQ ID NO: 9811 - DNA, 20 bp, Artificial Sequence
  Artificially Synthesized Primer Sequence
tgagattcggtcaacatgga

SEQ ID NO: 9812 - DNA, 20 bp, Artificial Sequence
  Artificially Synthesized Primer Sequence
gttcgtgaaacacaccatcg

SEQ ID NO: 9813 - DNA, 20 bp, Artificial Sequence
  Artificially Synthesized Primer Sequence
gaggaagtccaccatcctca

SEQ ID NO: 9814 - DNA, 20 bp, Artificial Sequence
  Artificially Synthesized Primer Sequence
acaccttgaggtttccatgc

SEQ ID NO: 9815 - DNA, 21 bp, Artificial Sequence
  Artificially Synthesized Primer Sequence
caattgctaccacaaaaggga

SEQ ID NO: 9816 - DNA, 20 bp, Artificial Sequence
  Artificially Synthesized Primer Sequence
tccaaagaagggagaaaggg

SEQ ID NO: 9817 - DNA, 20 bp, Artificial Sequence
  Artificially Synthesized Primer Sequence
ctccgaaaggcaacatgaat

SEQ ID NO: 9818 - DNA, 20 bp, Artificial Sequence
  Artificially Synthesized Primer Sequence
cctcctctgcaaggtacgag

SEQ ID NO: 9819 - DNA, 20 bp, Artificial Sequence
  Artificially Synthesized Primer Sequence
cagcgagacatggtggtaaa

SEQ ID NO: 9820 - DNA, 20 bp, Artificial Sequence
  Artificially Synthesized Primer Sequence
atcgagcttgtggagaagga

SEQ ID NO: 9821 - DNA, 20 bp, Artificial Sequence
  Artificially Synthesized Primer Sequence
ctcacctagctccaaggcac

SEQ ID NO: 9822 - DNA, 20 bp, Artificial Sequence
  Artificially Synthesized Primer Sequence
gcctcagctgtgctttctct

SEQ ID NO: 9823 - DNA, 20 bp, Artificial Sequence
  Artificially Synthesized Primer Sequence
tacacaacacacgccgaagt

SEQ ID NO: 9824 - DNA, 20 bp, Artificial Sequence
  Artificially Synthesized Primer Sequence
ctccgaaccttcatccatgt

SEQ ID NO: 9825 - DNA, 20 bp, Artificial Sequence
  Artificially Synthesized Primer Sequence
catctacttgtgggggtcgt

SEQ ID NO: 9826 - DNA, 20 bp, Artificial Sequence
  Artificially Synthesized Primer Sequence
tgtccaaggacaaactgggt

SEQ ID NO: 9827 - DNA, 20 bp, Artificial Sequence
  Artificially Synthesized Primer Sequence
ctgatggaaacaacgggtct

SEQ ID NO: 9828 - DNA, 20 bp, Artificial Sequence
  Artificially Synthesized Primer Sequence
acatgctgttggcaatgtgt

SEQ ID NO: 9829 - DNA, 20 bp, Artificial Sequence
  Artificially Synthesized Primer Sequence
cgaaaacatcgtcagcagaa

SEQ ID NO: 9830 - DNA, 20 bp, Artificial Sequence
  Artificially Synthesized Primer Sequence
accagcatttccaaagcaac

SEQ ID NO: 9831 - DNA, 20 bp, Artificial Sequence
  Artificially Synthesized Primer Sequence
caaaatccccatcaggagaa

SEQ ID NO: 9832 - DNA, 20 bp, Artificial Sequence
  Artificially Synthesized Primer Sequence
cgaaaacatcgtcagcagaa

SEQ ID NO: 9833 - DNA, 20 bp, Artificial Sequence
  Artificially Synthesized Primer Sequence
ccacgcagatccctcagtat

SEQ ID NO: 9834 - DNA, 20 bp, Artificial Sequence
  Artificially Synthesized Primer Sequence
tgcttcaattgttgcagagg

SEQ ID NO: 9835 - DNA, 20 bp, Artificial Sequence
  Artificially Synthesized Primer Sequence
tttgcaaaccccatatagcc

SEQ ID NO: 9836 - DNA, 21 bp, Artificial Sequence
  Artificially Synthesized Primer Sequence
ctatcagttccgaacacccaa

SEQ ID NO: 9837 - DNA, 20 bp, Artificial Sequence
  Artificially Synthesized Primer Sequence
ctttctctttcccgcctctt

SEQ ID NO: 9838 - DNA, 20 bp, Artificial Sequence
  Artificially Synthesized Primer Sequence
aatggtgacaaggatcggag

SEQ ID NO: 9839 - DNA, 20 bp, Artificial Sequence
  Artificially Synthesized Primer Sequence
tggagaagtcatgcatcagg

SEQ ID NO: 9840 - DNA, 20 bp, Artificial Sequence
  Artificially Synthesized Primer Sequence
tgccaagttgaatgatgagc

SEQ ID NO: 9841 - DNA, 20 bp, Artificial Sequence
  Artificially Synthesized Primer Sequence
aggataccctgcaaatcgtg

SEQ ID NO: 9842 - DNA, 20 bp, Artificial Sequence
  Artificially Synthesized Primer Sequence
ggctctggtctgtaagcagg

SEQ ID NO: 9843 - DNA, 20 bp, Artificial Sequence
  Artificially Synthesized Primer Sequence
tctgtgcccttggtagatcc

SEQ ID NO: 9844 - DNA, 20 bp, Artificial Sequence
  Artificially Synthesized Primer Sequence
gagttggtgctgtgtgcagt

SEQ ID NO: 9845 - DNA, 20 bp, Artificial Sequence
  Artificially Synthesized Primer Sequence
gctgtagctgatgccaacaa

SEQ ID NO: 9846 - DNA, 20 bp, Artificial Sequence
  Artificially Synthesized Primer Sequence
agtcatgcctgtatttgggc

SEQ ID NO: 9847 - DNA, 20 bp, Artificial Sequence
  Artificially Synthesized Primer Sequence
cacagatgcacaggtatggg

SEQ ID NO: 9848 - DNA, 20 bp, Artificial Sequence
  Artificially Synthesized Primer Sequence
gaaacttgacggtgatgctg

SEQ ID NO: 9849 - DNA, 20 bp, Artificial Sequence
  Artificially Synthesized Primer Sequence
ctgggaggttaggatggtga

SEQ ID NO: 9850 - DNA, 20 bp, Artificial Sequence
  Artificially Synthesized Primer Sequence
aagtagagcaggtccgggat

SEQ ID NO: 9851 - DNA, 20 bp, Artificial Sequence
  Artificially Synthesized Primer Sequence
gggtggtggtgactccatag

SEQ ID NO: 9852 - DNA, 20 bp, Artificial Sequence
  Artificially Synthesized Primer Sequence
tcctggagttcctggcatac

SEQ ID NO: 9853 - DNA, 20 bp, Artificial Sequence
  Artificially Synthesized Primer Sequence
atccgaatacggagcacaag

SEQ ID NO: 9854 - DNA, 20 bp, Artificial Sequence
  Artificially Synthesized Primer Sequence
cccattagcagtcgcaaaat

SEQ ID NO: 9855 - DNA, 20 bp, Artificial Sequence
  Artificially Synthesized Primer Sequence
tatgtggcaatacagcaggg

SEQ ID NO: 9856 - DNA, 20 bp, Artificial Sequence
  Artificially Synthesized Primer Sequence
ccgtgttcagggagatgaag

SEQ ID NO: 9857 - DNA, 20 bp, Artificial Sequence
  Artificially Synthesized Primer Sequence
gatctgttgcccgaagatgt

SEQ ID NO: 9858 - DNA, 20 bp, Artificial Sequence
  Artificially Synthesized Primer Sequence
gactggacaacaagggagga

SEQ ID NO: 9859 - DNA, 20 bp, Artificial Sequence
  Artificially Synthesized Primer Sequence
atcatgagccacctcaaagg

SEQ ID NO: 9860 - DNA, 20 bp, Artificial Sequence
  Artificially Synthesized Primer Sequence
tcctcccttgttgtccagtc

SEQ ID NO: 9861 - DNA, 20 bp, Artificial Sequence
  Artificially Synthesized Primer Sequence
tcctactttatgcgccttgg

SEQ ID NO: 9862 - DNA, 20 bp, Artificial Sequence
  Artificially Synthesized Primer Sequence
cctcttacctgtgctggctc

SEQ ID NO: 9863 - DNA, 20 bp, Artificial Sequence
  Artificially Synthesized Primer Sequence
caagtactcgcacatgcgtt

SEQ ID NO: 9864 - DNA, 20 bp, Artificial Sequence
  Artificially Synthesized Primer Sequence
ccttccattcttggtcctca

SEQ ID NO: 9865 - DNA, 20 bp, Artificial Sequence
  Artificially Synthesized Primer Sequence
ttttgcccagaatgttttcc

SEQ ID NO: 9866 - DNA, 20 bp, Artificial Sequence
  Artificially Synthesized Primer Sequence
gtaaaactccttccccctcg

SEQ ID NO: 9867 - DNA, 20 bp, Artificial Sequence
  Artificially Synthesized Primer Sequence
atgttcacctgacgaaagcc

SEQ ID NO: 9868 - DNA, 20 bp, Artificial Sequence
  Artificially Synthesized Primer Sequence
cagctcttactgccccaaag

SEQ ID NO: 9869 - DNA, 20 bp, Artificial Sequence
  Artificially Synthesized Primer Sequence
gctctttgccagaccatctc

SEQ ID NO: 9870 - DNA, 20 bp, Artificial Sequence
  Artificially Synthesized Primer Sequence
caagaatgcacgacacgact

SEQ ID NO: 9871 - DNA, 20 bp, Artificial Sequence
  Artificially Synthesized Primer Sequence
caagaatgcacgacacgact

SEQ ID NO: 9872 - DNA, 20 bp, Artificial Sequence
  Artificially Synthesized Primer Sequence
tctttgccaagaccatctcc

SEQ ID NO: 9873 - DNA, 20 bp, Artificial Sequence
  Artificially Synthesized Primer Sequence
cgccagtccctatcctatca

SEQ ID NO: 9874 - DNA, 20 bp, Artificial Sequence
  Artificially Synthesized Primer Sequence
cgatacgcgctaataaaggc

SEQ ID NO: 9875 - DNA, 20 bp, Artificial Sequence
  Artificially Synthesized Primer Sequence
cttacaaacgattcccagcc

SEQ ID NO: 9876 - DNA, 20 bp, Artificial Sequence
  Artificially Synthesized Primer Sequence
cctttcgctgtcgacaaaat

SEQ ID NO: 9877 - DNA, 20 bp, Artificial Sequence
  Artificially Synthesized Primer Sequence
tggtgatgatgtgaggagga

SEQ ID NO: 9878 - DNA, 20 bp, Artificial Sequence
  Artificially Synthesized Primer Sequence
tgaagtgtctcctttgtgcg

SEQ ID NO: 9879 - DNA, 20 bp, Artificial Sequence
  Artificially Synthesized Primer Sequence
aagatcgtttttcagcccct

SEQ ID NO: 9880 - DNA, 20 bp, Artificial Sequence
  Artificially Synthesized Primer Sequence
tatgccaagagtgtgttcgg

SEQ ID NO: 9881 - DNA, 19 bp, Artificial Sequence
  Artificially Synthesized Primer Sequence
aactcatcccctccccagt

SEQ ID NO: 9882 - DNA, 20 bp, Artificial Sequence
  Artificially Synthesized Primer Sequence
aaccgtccagtccagttttg

SEQ ID NO: 9883 - DNA, 20 bp, Artificial Sequence
  Artificially Synthesized Primer Sequence
ccatctagaagtcagggcca

SEQ ID NO: 9884 - DNA, 20 bp, Artificial Sequence
  Artificially Synthesized Primer Sequence
tgatctccgtgttgctcttg

SEQ ID NO: 9885 - DNA, 20 bp, Artificial Sequence
  Artificially Synthesized Primer Sequence
cctcttcctgcctgtttgag

SEQ ID NO: 9886 - DNA, 20 bp, Artificial Sequence
  Artificially Synthesized Primer Sequence
ccccaactgaggacactagc

SEQ ID NO: 9887 - DNA, 21 bp, Artificial Sequence
  Artificially Synthesized Primer Sequence
ggagactggatgcgtatgaga

SEQ ID NO: 9888 - DNA, 20 bp, Artificial Sequence
  Artificially Synthesized Primer Sequence
gatgcacagggaacgaagtt

SEQ ID NO: 9889 - DNA, 20 bp, Artificial Sequence
  Artificially Synthesized Primer Sequence
gcaagcatatgagcagcaaa

SEQ ID NO: 9890 - DNA, 20 bp, Artificial Sequence
  Artificially Synthesized Primer Sequence
tgctttccctttcattggtc

SEQ ID NO: 9891 - DNA, 21 bp, Artificial Sequence
  Artificially Synthesized Primer Sequence
aacagcttttagcatgggtga

SEQ ID NO: 9892 - DNA, 20 bp, Artificial Sequence
  Artificially Synthesized Primer Sequence
gcaagcatatgagcagcaaa

SEQ ID NO: 9893 - DNA, 20 bp, Artificial Sequence
  Artificially Synthesized Primer Sequence
gatcctgattaggcgtggaa

SEQ ID NO: 9894 - DNA, 20 bp, Artificial Sequence
  Artificially Synthesized Primer Sequence
gaataaatcgccgacctgaa

SEQ ID NO: 9895 - DNA, 20 bp, Artificial Sequence
  Artificially Synthesized Primer Sequence
tgtcttccgtggttcctttc

SEQ ID NO: 9896 - DNA, 20 bp, Artificial Sequence
  Artificially Synthesized Primer Sequence
gcattttgttcagcttcggt

SEQ ID NO: 9897 - DNA, 20 bp, Artificial Sequence
  Artificially Synthesized Primer Sequence
ttttcaggaggtcatttccg

SEQ ID NO: 9898 - DNA, 20 bp, Artificial Sequence
  Artificially Synthesized Primer Sequence
cttctgagcgccttttatgg

SEQ ID NO: 9899 - DNA, 21 bp, Artificial Sequence
  Artificially Synthesized Primer Sequence
gcagctaaaagctaagcaacg

SEQ ID NO: 9900 - DNA, 20 bp, Artificial Sequence
  Artificially Synthesized Primer Sequence
cttcttccagtccatgcgtc

SEQ ID NO: 9901 - DNA, 20 bp, Artificial Sequence
  Artificially Synthesized Primer Sequence
atcgaggtggtgaaatgctc

SEQ ID NO: 9902 - DNA, 20 bp, Artificial Sequence
  Artificially Synthesized Primer Sequence
agagcacagcgatgatgatg

SEQ ID NO: 9903 - DNA, 20 bp, Artificial Sequence
  Artificially Synthesized Primer Sequence
gctaaccttattgcatgccg

SEQ ID NO: 9904 - DNA, 21 bp, Artificial Sequence
  Artificially Synthesized Primer Sequence
ccaggatggaacgtcacatta

SEQ ID NO: 9905 - DNA, 20 bp, Artificial Sequence
  Artificially Synthesized Primer Sequence
cgacctattatgggaagcca

SEQ ID NO: 9906 - DNA, 20 bp, Artificial Sequence
  Artificially Synthesized Primer Sequence
actctttatcgcctgagcca

SEQ ID NO: 9907 - DNA, 20 bp, Artificial Sequence
  Artificially Synthesized Primer Sequence
acagactcgaaatggggatg

SEQ ID NO: 9908 - DNA, 20 bp, Artificial Sequence
  Artificially Synthesized Primer Sequence
tgagccaatcacctaccctc

SEQ ID NO: 9909 - DNA, 20 bp, Artificial Sequence
  Artificially Synthesized Primer Sequence
gggattgaagacgacacgtt

SEQ ID NO: 9910 - DNA, 20 bp, Artificial Sequence
  Artificially Synthesized Primer Sequence
cggacatgttcactcacacc

SEQ ID NO: 9911 - DNA, 20 bp, Artificial Sequence
  Artificially Synthesized Primer Sequence
gcattcttcatcttcgcaca

SEQ ID NO: 9912 - DNA, 20 bp, Artificial Sequence
  Artificially Synthesized Primer Sequence
ggaaagcacatcatctccgt

SEQ ID NO: 9913 - DNA, 20 bp, Artificial Sequence
  Artificially Synthesized Primer Sequence
aaggagctgaacctgcaaaa

SEQ ID NO: 9914 - DNA, 20 bp, Artificial Sequence
  Artificially Synthesized Primer Sequence
taagcctctcgcatgaaggt

SEQ ID NO: 9915 - DNA, 20 bp, Artificial Sequence
  Artificially Synthesized Primer Sequence
cgacattttccctgtcctgt

SEQ ID NO: 9916 - DNA, 20 bp, Artificial Sequence
  Artificially Synthesized Primer Sequence
taccttcatgcgagaggctt

SEQ ID NO: 9917 - DNA, 20 bp, Artificial Sequence
  Artificially Synthesized Primer Sequence
gatgcttttccagtgtgggt

SEQ ID NO: 9918 - DNA, 20 bp, Artificial Sequence
  Artificially Synthesized Primer Sequence
cctgaacatgaaagcaagca

SEQ ID NO: 9919 - DNA, 20 bp, Artificial Sequence
  Artificially Synthesized Primer Sequence
cgtcactgatgcaatggaac

SEQ ID NO: 9920 - DNA, 20 bp, Artificial Sequence
  Artificially Synthesized Primer Sequence
tacttgcttgcgttgtttgc

SEQ ID NO: 9921 - DNA, 20 bp, Artificial Sequence
  Artificially Synthesized Primer Sequence
gagggagggatcagttgtga

SEQ ID NO: 9922 - DNA, 20 bp, Artificial Sequence
  Artificially Synthesized Primer Sequence
tttgaagagcccaggagaaa

SEQ ID NO: 9923 - DNA, 20 bp, Artificial Sequence
  Artificially Synthesized Primer Sequence
caaatccaccgaatcatgtg

SEQ ID NO: 9924 - DNA, 20 bp, Artificial Sequence
  Artificially Synthesized Primer Sequence
gagggagggatcagttgtga

SEQ ID NO: 9925 - DNA, 20 bp, Artificial Sequence
  Artificially Synthesized Primer Sequence
tcgtcgaaatcacgctacag

SEQ ID NO: 9926 - DNA, 20 bp, Artificial Sequence
  Artificially Synthesized Primer Sequence
gacattttggtgctgtgtgg

SEQ ID NO: 9927 - DNA, 20 bp, Artificial Sequence
  Artificially Synthesized Primer Sequence
aaggaacagctccagcaaaa

SEQ ID NO: 9928 - DNA, 20 bp, Artificial Sequence
  Artificially Synthesized Primer Sequence
tgagcgcatgaaggacatag

SEQ ID NO: 9929 - DNA, 20 bp, Artificial Sequence
  Artificially Synthesized Primer Sequence
gtttattgcggcagaagagc

SEQ ID NO: 9930 - DNA, 20 bp, Artificial Sequence
  Artificially Synthesized Primer Sequence
cttggacaagatcgctgaca

SEQ ID NO: 9931 - DNA, 20 bp, Artificial Sequence
  Artificially Synthesized Primer Sequence
atttgcatgacttgctgctc

SEQ ID NO: 9932 - DNA, 20 bp, Artificial Sequence
  Artificially Synthesized Primer Sequence
tgaagatgcaagctcacagg

SEQ ID NO: 9933 - DNA, 20 bp, Artificial Sequence
  Artificially Synthesized Primer Sequence
catgcatatttggttgtcgc

SEQ ID NO: 9934 - DNA, 20 bp, Artificial Sequence
  Artificially Synthesized Primer Sequence
aaaacatgccgagaatgtcc

SEQ ID NO: 9935 - DNA, 20 bp, Artificial Sequence
  Artificially Synthesized Primer Sequence
tttgttggtgcatttcctga

SEQ ID NO: 9936 - DNA, 20 bp, Artificial Sequence
  Artificially Synthesized Primer Sequence
cgactttgtgagcaccgata

SEQ ID NO: 9937 - DNA, 20 bp, Artificial Sequence
  Artificially Synthesized Primer Sequence
gtagtgttcgtgtgctcgga

SEQ ID NO: 9938 - DNA, 20 bp, Artificial Sequence
  Artificially Synthesized Primer Sequence
agggagctacaaacgaacga

SEQ ID NO: 9939 - DNA, 20 bp, Artificial Sequence
  Artificially Synthesized Primer Sequence
tccgagcacacgaacactac

SEQ ID NO: 9940 - DNA, 20 bp, Artificial Sequence
  Artificially Synthesized Primer Sequence
cgactaatgagggaaggcag

SEQ ID NO: 9941 - DNA, 20 bp, Artificial Sequence
  Artificially Synthesized Primer Sequence
catggatcctgtctgtggtg

SEQ ID NO: 9942 - DNA, 20 bp, Artificial Sequence
  Artificially Synthesized Primer Sequence
gttgatgctttgtcagcgaa

SEQ ID NO: 9943 - DNA, 20 bp, Artificial Sequence
  Artificially Synthesized Primer Sequence
catggatcctgtctgtggtg

SEQ ID NO: 9944 - DNA, 20 bp, Artificial Sequence
  Artificially Synthesized Primer Sequence
ggtctggatccgatctttca

SEQ ID NO: 9945 - DNA, 20 bp, Artificial Sequence
  Artificially Synthesized Primer Sequence
ctccaagctcctcacctcac

SEQ ID NO: 9946 - DNA, 20 bp, Artificial Sequence
  Artificially Synthesized Primer Sequence
ggaactgctcgaagaggttg

SEQ ID NO: 9947 - DNA, 20 bp, Artificial Sequence
  Artificially Synthesized Primer Sequence
gaggctaaacctattgccga

SEQ ID NO: 9948 - DNA, 20 bp, Artificial Sequence
  Artificially Synthesized Primer Sequence
acagcaatggtcccacattt

SEQ ID NO: 9949 - DNA, 20 bp, Artificial Sequence
  Artificially Synthesized Primer Sequence
caagaagcttgtggaggagg

SEQ ID NO: 9950 - DNA, 20 bp, Artificial Sequence
  Artificially Synthesized Primer Sequence
tggccagttcttccattttc

SEQ ID NO: 9951 - DNA, 20 bp, Artificial Sequence
  Artificially Synthesized Primer Sequence
tcacgggacaattcacaaga

SEQ ID NO: 9952 - DNA, 19 bp, Artificial Sequence
  Artificially Synthesized Primer Sequence
caagaagcaccattgcagc

SEQ ID NO: 9953 - DNA, 20 bp, Artificial Sequence
  Artificially Synthesized Primer Sequence
cctatgcacccctcacactt

SEQ ID NO: 9954 - DNA, 20 bp, Artificial Sequence
  Artificially Synthesized Primer Sequence
gtcccacccaaaacatcatc

SEQ ID NO: 9955 - DNA, 20 bp, Artificial Sequence
  Artificially Synthesized Primer Sequence
ggctctcacaacctgggtaa

SEQ ID NO: 9956 - DNA, 20 bp, Artificial Sequence
  Artificially Synthesized Primer Sequence
gctgagatgcaccacatgat

SEQ ID NO: 9957 - DNA, 20 bp, Artificial Sequence
  Artificially Synthesized Primer Sequence
ttcaagatgacaccccatga

SEQ ID NO: 9958 - DNA, 20 bp, Artificial Sequence
  Artificially Synthesized Primer Sequence
ccctgccaactaaatccgta

SEQ ID NO: 9959 - DNA, 20 bp, Artificial Sequence
  Artificially Synthesized Primer Sequence
ggtgttgtgctgaaaagcaa

SEQ ID NO: 9960 - DNA, 20 bp, Artificial Sequence
  Artificially Synthesized Primer Sequence
tgcaattttcctgcaatctg

SEQ ID NO: 9961 - DNA, 20 bp, Artificial Sequence
  Artificially Synthesized Primer Sequence
tccagcaaatgcaagaacag

SEQ ID NO: 9962 - DNA, 20 bp, Artificial Sequence
  Artificially Synthesized Primer Sequence
tgatgaaaggggatcctcag

SEQ ID NO: 9963 - DNA, 20 bp, Artificial Sequence
  Artificially Synthesized Primer Sequence
accaaatagggcttccgtct

SEQ ID NO: 9964 - DNA, 20 bp, Artificial Sequence
  Artificially Synthesized Primer Sequence
ggtgatcactggcttggaat

SEQ ID NO: 9965 - DNA, 20 bp, Artificial Sequence
  Artificially Synthesized Primer Sequence
gtggccaaggaactacagga

SEQ ID NO: 9966 - DNA, 20 bp, Artificial Sequence
  Artificially Synthesized Primer Sequence
caatccaaatccacaatccc

SEQ ID NO: 9967 - DNA, 20 bp, Artificial Sequence
  Artificially Synthesized Primer Sequence
ggatcttcatttgctcgacg

SEQ ID NO: 9968 - DNA, 19 bp, Artificial Sequence
  Artificially Synthesized Primer Sequence
acagccgtcacctcctctt

SEQ ID NO: 9969 - DNA, 20 bp, Artificial Sequence
  Artificially Synthesized Primer Sequence
aggtagagaggctcgaaggg

SEQ ID NO: 9970 - DNA, 20 bp, Artificial Sequence
  Artificially Synthesized Primer Sequence
taacccaatggtccacgaat

SEQ ID NO: 9971 - DNA, 20 bp, Artificial Sequence
  Artificially Synthesized Primer Sequence
cagatttcaaacaggtcgcc

SEQ ID NO: 9972 - DNA, 20 bp, Artificial Sequence
  Artificially Synthesized Primer Sequence
gtcaacgtaacttggcagca

SEQ ID NO: 9973 - DNA, 20 bp, Artificial Sequence
  Artificially Synthesized Primer Sequence
aggtggatcttgaggaagca

SEQ ID NO: 9974 - DNA, 20 bp, Artificial Sequence
  Artificially Synthesized Primer Sequence
ttgactggtcattgaggctg

SEQ ID NO: 9975 - DNA, 20 bp, Artificial Sequence
  Artificially Synthesized Primer Sequence
cgccaggtgtgcaactataa

SEQ ID NO: 9976 - DNA, 20 bp, Artificial Sequence
  Artificially Synthesized Primer Sequence
ccctcagctgggttgtactc

SEQ ID NO: 9977 - DNA, 20 bp, Artificial Sequence
  Artificially Synthesized Primer Sequence
aaagttggggcgtacatgag

SEQ ID NO: 9978 - DNA, 20 bp, Artificial Sequence
  Artificially Synthesized Primer Sequence
atcagtgggattgagatggc

SEQ ID NO: 9979 - DNA, 20 bp, Artificial Sequence
  Artificially Synthesized Primer Sequence
tgcaatcgatctcgacaaaa

SEQ ID NO: 9980 - DNA, 20 bp, Artificial Sequence
  Artificially Synthesized Primer Sequence
ctggtgcactggtcttagca

SEQ ID NO: 9981 - DNA, 20 bp, Artificial Sequence
  Artificially Synthesized Primer Sequence
tatctgccgtggatgttgaa

SEQ ID NO: 9982 - DNA, 20 bp, Artificial Sequence
  Artificially Synthesized Primer Sequence
gtaaaccggcccccttaata

SEQ ID NO: 9983 - DNA, 20 bp, Artificial Sequence
  Artificially Synthesized Primer Sequence
ttgtacagcagtttgctccg

SEQ ID NO: 9984 - DNA, 20 bp, Artificial Sequence
  Artificially Synthesized Primer Sequence
ggctctgcattatcttccca

SEQ ID NO: 9985 - DNA, 20 bp, Artificial Sequence
  Artificially Synthesized Primer Sequence
agtttcttacgaggctggca

SEQ ID NO: 9986 - DNA, 20 bp, Artificial Sequence
  Artificially Synthesized Primer Sequence
cagtcagctaaaacaggccc

SEQ ID NO: 9987 - DNA, 20 bp, Artificial Sequence
  Artificially Synthesized Primer Sequence
agcatctgctgcactgttgt

SEQ ID NO: 9988 - DNA, 20 bp, Artificial Sequence
  Artificially Synthesized Primer Sequence
agtttcttacgaggctggca

SEQ ID NO: 9989 - DNA, 20 bp, Artificial Sequence
  Artificially Synthesized Primer Sequence
tgccgttgattggtctcata

SEQ ID NO: 9990 - DNA, 20 bp, Artificial Sequence
  Artificially Synthesized Primer Sequence
ttctgacgttgctggcatag

SEQ ID NO: 9991 - DNA, 20 bp, Artificial Sequence
  Artificially Synthesized Primer Sequence
cagcatacgcctcaaacaga

SEQ ID NO: 9992 - DNA, 20 bp, Artificial Sequence
  Artificially Synthesized Primer Sequence
gcacgtcatgtgtttttgct

SEQ ID NO: 9993 - DNA, 20 bp, Artificial Sequence
  Artificially Synthesized Primer Sequence
atctccggtgcaatcttacg

SEQ ID NO: 9994 - DNA, 20 bp, Artificial Sequence
  Artificially Synthesized Primer Sequence
tagccatatctccagcaggg

SEQ ID NO: 9995 - DNA, 20 bp, Artificial Sequence
  Artificially Synthesized Primer Sequence
ccacctctcttcctcctcct

SEQ ID NO: 9996 - DNA, 20 bp, Artificial Sequence
  Artificially Synthesized Primer Sequence
atcccacgcacttagagcac

SEQ ID NO: 9997 - DNA, 20 bp, Artificial Sequence
  Artificially Synthesized Primer Sequence
cgagaagttcaagaccgagg

SEQ ID NO: 9998 - DNA, 20 bp, Artificial Sequence
  Artificially Synthesized Primer Sequence
ggagacacaggaccaggaaa

SEQ ID NO: 9999 - DNA, 20 bp, Artificial Sequence
  Artificially Synthesized Primer Sequence
gttaaccggtggggaagatt

SEQ ID NO: 10000 - DNA, 20 bp, Artificial Sequence
  Artificially Synthesized Primer Sequence
tcaaggttgaggtcatcgtg

SEQ ID NO: 10001 - DNA, 20 bp, Artificial Sequence
  Artificially Synthesized Primer Sequence
ggcctgcaaagctcagtaac

SEQ ID NO: 10002 - DNA, 20 bp, Artificial Sequence
  Artificially Synthesized Primer Sequence
aagggaaaggcaggattcat

SEQ ID NO: 10003 - DNA, 20 bp, Artificial Sequence
  Artificially Synthesized Primer Sequence
tcatgggagacagaggaagg

SEQ ID NO: 10004 - DNA, 20 bp, Artificial Sequence
  Artificially Synthesized Primer Sequence
gggcttaagcttctgagcct

SEQ ID NO: 10005 - DNA, 20 bp, Artificial Sequence
  Artificially Synthesized Primer Sequence
tttcgtctcaggatccaacc

SEQ ID NO: 10006 - DNA, 20 bp, Artificial Sequence
  Artificially Synthesized Primer Sequence
cagagcatacaacagcgtgg

SEQ ID NO: 10007 - DNA, 18 bp, Artificial Sequence
  Artificially Synthesized Primer Sequence
gttggttcaggcgtgctt

SEQ ID NO: 10008 - DNA, 20 bp, Artificial Sequence
  Artificially Synthesized Primer Sequence
gacagggaaaccgtgatgag

SEQ ID NO: 10009 - DNA, 10 bp, Artificial Sequence
  Artificially Synthesized Primer Sequence
  MISC_FEATURE (1)..(10): n stands for any base
nnnnnnnnnn

SEQ ID NO: 10010 - DNA, 10 bp, Artificial Sequence
  Artificially Synthesized Primer Sequence
  MISC_FEATURE (1)..(10): n stands for any base
nnnnnnnnnn

SEQ ID NO: 10011 - DNA, 20 bp, Artificial Sequence
  Artificially Synthesized Primer Sequence
gattttgctgcccaccttta

SEQ ID NO: 10012 - DNA, 20 bp, Artificial Sequence
  Artificially Synthesized Primer Sequence
tagacgcagcaatgttacgc

SEQ ID NO: 10013 - DNA, 20 bp, Artificial Sequence
  Artificially Synthesized Primer Sequence
ggcaaatctaacacagggga

SEQ ID NO: 10014 - DNA, 20 bp, Artificial Sequence
  Artificially Synthesized Primer Sequence
agctgtgcaagatcctcgat

SEQ ID NO: 10015 - DNA, 20 bp, Artificial Sequence
  Artificially Synthesized Primer Sequence
gctaccagcaccacaaacct

SEQ ID NO: 10016 - DNA, 20 bp, Artificial Sequence
  Artificially Synthesized Primer Sequence
cacaagagatcatcgaggca

SEQ ID NO: 10017 - DNA, 20 bp, Artificial Sequence
  Artificially Synthesized Primer Sequence
tgataaattcacgcggaaca

SEQ ID NO: 10018 - DNA, 20 bp, Artificial Sequence
  Artificially Synthesized Primer Sequence
gccagttctccagtaaagcg

SEQ ID NO: 10019 - DNA, 20 bp, Artificial Sequence
  Artificially Synthesized Primer Sequence
acaggaccgtgataaccagc

SEQ ID NO: 10020 - DNA, 20 bp, Artificial Sequence
  Artificially Synthesized Primer Sequence
cagaggggttacgaccttca

SEQ ID NO: 10021 - DNA, 20 bp, Artificial Sequence
  Artificially Synthesized Primer Sequence
aactcctcccatcctggtct

SEQ ID NO: 10022 - DNA, 20 bp, Artificial Sequence
  Artificially Synthesized Primer Sequence
ggctttcttccgaagctttt

SEQ ID NO: 10023 - DNA, 20 bp, Artificial Sequence
  Artificially Synthesized Primer Sequence
gctgctgcaatttacgatga

SEQ ID NO: 10024 - DNA, 20 bp, Artificial Sequence
  Artificially Synthesized Primer Sequence
gactcggtgaagaagaggga

SEQ ID NO: 10025 - DNA, 20 bp, Artificial Sequence
  Artificially Synthesized Primer Sequence
cactgttggcctactgggtt

SEQ ID NO: 10026 - DNA, 20 bp, Artificial Sequence
  Artificially Synthesized Primer Sequence
acccatgggaaccatctttt

SEQ ID NO: 10027 - DNA, 21 bp, Artificial Sequence
  Artificially Synthesized Primer Sequence
tttagccctgcaacattcttc

SEQ ID NO: 10028 - DNA, 20 bp, Artificial Sequence
  Artificially Synthesized Primer Sequence
ggcttgaaattccagaaggg

SEQ ID NO: 10029 - DNA, 20 bp, Artificial Sequence
  Artificially Synthesized Primer Sequence
cattccagagtcggaagctc

SEQ ID NO: 10030 - DNA, 20 bp, Artificial Sequence
  Artificially Synthesized Primer Sequence
ttctgggtcaaaaagggttg

SEQ ID NO: 10031 - DNA, 20 bp, Artificial Sequence
  Artificially Synthesized Primer Sequence
cctaaaaagcccacgacaaa

SEQ ID NO: 10032 - DNA, 20 bp, Artificial Sequence
  Artificially Synthesized Primer Sequence
gaaggacgaaacaaagctgc

SEQ ID NO: 10033 - DNA, 20 bp, Artificial Sequence
  Artificially Synthesized Primer Sequence
ccctcaactcgctcttcaac

SEQ ID NO: 10034 - DNA, 20 bp, Artificial Sequence
  Artificially Synthesized Primer Sequence
ggcaagtctgagcatcttcc

SEQ ID NO: 10035 - DNA, 20 bp, Artificial Sequence
  Artificially Synthesized Primer Sequence
acagcaggcacaaatcattg

SEQ ID NO: 10036 - DNA, 20 bp, Artificial Sequence
  Artificially Synthesized Primer Sequence
acgattccggatcatcagtc

SEQ ID NO: 10037 - DNA, 20 bp, Artificial Sequence
  Artificially Synthesized Primer Sequence
ttgtgttcacggtggtctgt

SEQ ID NO: 10038 - DNA, 20 bp, Artificial Sequence
  Artificially Synthesized Primer Sequence
ccggcacactaggtcaagat

SEQ ID NO: 10039 - DNA, 20 bp, Artificial Sequence
  Artificially Synthesized Primer Sequence
atgctcccagcgatctattg

SEQ ID NO: 10040 - DNA, 20 bp, Artificial Sequence
  Artificially Synthesized Primer Sequence
tggctttttggatcacgagt

SEQ ID NO: 10041 - DNA, 20 bp, Artificial Sequence
  Artificially Synthesized Primer Sequence
taaaggaagagctgggacga

SEQ ID NO: 10042 - DNA, 20 bp, Artificial Sequence
  Artificially Synthesized Primer Sequence
ttcacccagttattctgccc

SEQ ID NO: 10043 - DNA, 20 bp, Artificial Sequence
  Artificially Synthesized Primer Sequence
gaatggcgtggatctcaagt

SEQ ID NO: 10044 - DNA, 20 bp, Artificial Sequence
  Artificially Synthesized Primer Sequence
gccattgaggaacaaaagga

SEQ ID NO: 10045 - DNA, 20 bp, Artificial Sequence
  Artificially Synthesized Primer Sequence
agaagggatacgggaggatg

SEQ ID NO: 10046 - DNA, 20 bp, Artificial Sequence
  Artificially Synthesized Primer Sequence
agacaacattccgctgctct

SEQ ID NO: 10047 - DNA, 20 bp, Artificial Sequence
  Artificially Synthesized Primer Sequence
ttgcttgtccgagtcttcct

SEQ ID NO: 10048 - DNA, 20 bp, Artificial Sequence
  Artificially Synthesized Primer Sequence
atttgtagaagcaaggcgga

SEQ ID NO: 10049 - DNA, 20 bp, Artificial Sequence
  Artificially Synthesized Primer Sequence
gcctcacagaggcctacaag

SEQ ID NO: 10050 - DNA, 20 bp, Artificial Sequence
  Artificially Synthesized Primer Sequence
accggtgtgtagtaatcgcc

SEQ ID NO: 10051 - DNA, 20 bp, Artificial Sequence
  Artificially Synthesized Primer Sequence
tgtaccccacttgcaatgaa

SEQ ID NO: 10052 - DNA, 20 bp, Artificial Sequence
  Artificially Synthesized Primer Sequence
ctccagcctgagaagtttgg

SEQ ID NO: 10053 - DNA, 20 bp, Artificial Sequence
  Artificially Synthesized Primer Sequence
ctcgctcagaggacaaatcc

SEQ ID NO: 10054 - DNA, 20 bp, Artificial Sequence
  Artificially Synthesized Primer Sequence
gcgcggaagaattgtatgat

SEQ ID NO: 10055 - DNA, 20 bp, Artificial Sequence
  Artificially Synthesized Primer Sequence
cctcgctagtttggggtaga

SEQ ID NO: 10056 - DNA, 20 bp, Artificial Sequence
  Artificially Synthesized Primer Sequence
acacaaatgtcgggagaagg

SEQ ID NO: 10057 - DNA, 20 bp, Artificial Sequence
  Artificially Synthesized Primer Sequence
aggcatgggcaaagacatac

SEQ ID NO: 10058 - DNA, 20 bp, Artificial Sequence
  Artificially Synthesized Primer Sequence
aaccctgaagtcaatggcac

SEQ ID NO: 10059 - DNA, 20 bp, Artificial Sequence
  Artificially Synthesized Primer Sequence
tcgacaatttattcgcacca

SEQ ID NO: 10060 - DNA, 20 bp, Artificial Sequence
  Artificially Synthesized Primer Sequence
aggcatgggcaaagacatac

SEQ ID NO: 10061 - DNA, 20 bp, Artificial Sequence
  Artificially Synthesized Primer Sequence
cttcgttttatggccaagga

SEQ ID NO: 10062 - DNA, 20 bp, Artificial Sequence
  Artificially Synthesized Primer Sequence
actggccgtttcgaacatac

SEQ ID NO: 10063 - DNA, 20 bp, Artificial Sequence
  Artificially Synthesized Primer Sequence
ccaactgtcggttacaagca

SEQ ID NO: 10064 - DNA, 20 bp, Artificial Sequence
  Artificially Synthesized Primer Sequence
gttgttgctgttctgcctca

SEQ ID NO: 10065 - DNA, 20 bp, Artificial Sequence
  Artificially Synthesized Primer Sequence
gcaattggaggaatcaagga

SEQ ID NO: 10066 - DNA, 20 bp, Artificial Sequence
  Artificially Synthesized Primer Sequence
ttgaattgttcggtaagggc

SEQ ID NO: 10067 - DNA, 20 bp, Artificial Sequence
  Artificially Synthesized Primer Sequence
gttgtgagtgcggatgtagc

SEQ ID NO: 10068 - DNA, 20 bp, Artificial Sequence
  Artificially Synthesized Primer Sequence
tggatgagctcgaatcacac

SEQ ID NO: 10069 - DNA, 20 bp, Artificial Sequence
  Artificially Synthesized Primer Sequence
gaggattggttgctgttggt

SEQ ID NO: 10070 - DNA, 20 bp, Artificial Sequence
  Artificially Synthesized Primer Sequence
caaccagatggtcgtgtgac

SEQ ID NO: 10071 - DNA, 21 bp, Artificial Sequence
  Artificially Synthesized Primer Sequence
tctcacaacgatacgcaagaa

SEQ ID NO: 10072 - DNA, 20 bp, Artificial Sequence
  Artificially Synthesized Primer Sequence
aaggatggtgttttgatgcc

SEQ ID NO: 10073 - DNA, 20 bp, Artificial Sequence
  Artificially Synthesized Primer Sequence
caaccgacacacaggaaatg

SEQ ID NO: 10074 - DNA, 20 bp, Artificial Sequence
  Artificially Synthesized Primer Sequence
tccttgcaaatgccatacaa

SEQ ID NO: 10075 - DNA, 20 bp, Artificial Sequence
  Artificially Synthesized Primer Sequence
tctgcgaaagataaatgccc

SEQ ID NO: 10076 - DNA, 20 bp, Artificial Sequence
  Artificially Synthesized Primer Sequence
agggagccaagaagaaggac

SEQ ID NO: 10077 - DNA, 20 bp, Artificial Sequence
  Artificially Synthesized Primer Sequence
cagtaggaagaggcagtcgg

SEQ ID NO: 10078 - DNA, 20 bp, Artificial Sequence
  Artificially Synthesized Primer Sequence
aattcccttgctccgagaat

SEQ ID NO: 10079 - DNA, 20 bp, Artificial Sequence
  Artificially Synthesized Primer Sequence
ccaaatggttaggtgcttgg

SEQ ID NO: 10080 - DNA, 20 bp, Artificial Sequence
  Artificially Synthesized Primer Sequence
acaatgtggatgttgcctga

SEQ ID NO: 10081 - DNA, 20 bp, Artificial Sequence
  Artificially Synthesized Primer Sequence
gcttggaaccagtgtggatt

SEQ ID NO: 10082 - DNA, 20 bp, Artificial Sequence
  Artificially Synthesized Primer Sequence
cgtcggcgtaatctgatttt

SEQ ID NO: 10083 - DNA, 20 bp, Artificial Sequence
  Artificially Synthesized Primer Sequence
gggtcaatgcaccaaaagtt

SEQ ID NO: 10084 - DNA, 20 bp, Artificial Sequence
  Artificially Synthesized Primer Sequence
atgctcgttgggtttttcac

SEQ ID NO: 10085 - DNA, 20 bp, Artificial Sequence
  Artificially Synthesized Primer Sequence
gcttggacaagaggacttgc

SEQ ID NO: 10086 - DNA, 20 bp, Artificial Sequence
  Artificially Synthesized Primer Sequence
aaagctcggtctgttcagga

SEQ ID NO: 10087 - DNA, 20 bp, Artificial Sequence
  Artificially Synthesized Primer Sequence
aaagctcggtctgttcagga

SEQ ID NO: 10088 - DNA, 20 bp, Artificial Sequence
  Artificially Synthesized Primer Sequence
ggtaaaacaatcgaagccga

SEQ ID NO: 10089 - DNA, 20 bp, Artificial Sequence
  Artificially Synthesized Primer Sequence
gtgaagggaaagcaaatgga

SEQ ID NO: 10090 - DNA, 20 bp, Artificial Sequence
  Artificially Synthesized Primer Sequence
gtgacattgcacaccgtttc

SEQ ID NO: 10091 - DNA, 20 bp, Artificial Sequence
  Artificially Synthesized Primer Sequence
gtgacattgcacaccgtttc

SEQ ID NO: 10092 - DNA, 20 bp, Artificial Sequence
  Artificially Synthesized Primer Sequence
atgaagctgcagatccgtgt

SEQ ID NO: 10093 - DNA, 20 bp, Artificial Sequence
  Artificially Synthesized Primer Sequence
gatgtgcaggagcagttgaa

SEQ ID NO: 10094 - DNA, 20 bp, Artificial Sequence
  Artificially Synthesized Primer Sequence
agcggcaaagaaaaagaaca

SEQ ID NO: 10095 - DNA, 20 bp, Artificial Sequence
  Artificially Synthesized Primer Sequence
ggtttactccgcacttggaa

SEQ ID NO: 10096 - DNA, 20 bp, Artificial Sequence
  Artificially Synthesized Primer Sequence
gcatcgtgcaagaatacgag

SEQ ID NO: 10097 - DNA, 20 bp, Artificial Sequence
  Artificially Synthesized Primer Sequence
tgtggccagttggtgagata

SEQ ID NO: 10098 - DNA, 20 bp, Artificial Sequence
  Artificially Synthesized Primer Sequence
caagagctgccacattcaaa

SEQ ID NO: 10099 - DNA, 20 bp, Artificial Sequence
  Artificially Synthesized Primer Sequence
agcaaagacgaaccacccta

SEQ ID NO: 10100 - DNA, 20 bp, Artificial Sequence
  Artificially Synthesized Primer Sequence
gcgagtcgacatacaagcac

SEQ ID NO: 10101 - DNA, 20 bp, Artificial Sequence
  Artificially Synthesized Primer Sequence
cagatactgggcaggctgat

SEQ ID NO: 10102 - DNA, 20 bp, Artificial Sequence
  Artificially Synthesized Primer Sequence
atcccacctgcctattcctt

SEQ ID NO: 10103 - DNA, 20 bp, Artificial Sequence
  Artificially Synthesized Primer Sequence
tagcatggccctaattttcg

SEQ ID NO: 10104 - DNA, 20 bp, Artificial Sequence
  Artificially Synthesized Primer Sequence
gaacccgatgaggacaaaga

SEQ ID NO: 10105 - DNA, 20 bp, Artificial Sequence
  Artificially Synthesized Primer Sequence
gaggtcatggttgacgcttt

SEQ ID NO: 10106 - DNA, 20 bp, Artificial Sequence
  Artificially Synthesized Primer Sequence
agacatccaaatcccacagc

SEQ ID NO: 10107 - DNA, 20 bp, Artificial Sequence
  Artificially Synthesized Primer Sequence
caactccatcttctgcgtga

SEQ ID NO: 10108 - DNA, 20 bp, Artificial Sequence
  Artificially Synthesized Primer Sequence
ctggaaccagaggtgaggag

SEQ ID NO: 10109 - DNA, 20 bp, Artificial Sequence
  Artificially Synthesized Primer Sequence
gaggtaagaacctcccggtc

SEQ ID NO: 10110 - DNA, 20 bp, Artificial Sequence
  Artificially Synthesized Primer Sequence
gcacacaagcttcccatttt

SEQ ID NO: 10111 - DNA, 20 bp, Artificial Sequence
  Artificially Synthesized Primer Sequence
cccatgtcagcactgaagaa

SEQ ID NO: 10112 - DNA, 20 bp, Artificial Sequence
  Artificially Synthesized Primer Sequence
cagtgaccgcatgaatgaag

SEQ ID NO: 10113 - DNA, 20 bp, Artificial Sequence
  Artificially Synthesized Primer Sequence
acccgcacaatcttgctatc

SEQ ID NO: 10114 - DNA, 20 bp, Artificial Sequence
  Artificially Synthesized Primer Sequence
caggttgaggatgtcgaggt

SEQ ID NO: 10115 - DNA, 20 bp, Artificial Sequence
  Artificially Synthesized Primer Sequence
agattcagcaccaacaaggg

SEQ ID NO: 10116 - DNA, 20 bp, Artificial Sequence
  Artificially Synthesized Primer Sequence
cctggttctcctagtctgcg

SEQ ID NO: 10117 - DNA, 20 bp, Artificial Sequence
  Artificially Synthesized Primer Sequence
cctaaaatcctagccctgcc

SEQ ID NO: 10118 - DNA, 20 bp, Artificial Sequence
  Artificially Synthesized Primer Sequence
gactccaaactccttcagcg

SEQ ID NO: 10119 - DNA, 20 bp, Artificial Sequence
  Artificially Synthesized Primer Sequence
ttgctcgcaacatacgactc

SEQ ID NO: 10120 - DNA, 20 bp, Artificial Sequence
  Artificially Synthesized Primer Sequence
gcaaaagaagcccaatacca

SEQ ID NO: 10121 - DNA, 20 bp, Artificial Sequence
  Artificially Synthesized Primer Sequence
actacgacatccacccgttc

SEQ ID NO: 10122 - DNA, 20 bp, Artificial Sequence
  Artificially Synthesized Primer Sequence
agcatgaaggccttgaacac

SEQ ID NO: 10123 - DNA, 20 bp, Artificial Sequence
  Artificially Synthesized Primer Sequence
agcatgaaggccttgaacac

SEQ ID NO: 10124 - DNA, 20 bp, Artificial Sequence
  Artificially Synthesized Primer Sequence
actacgacatccacccgttc

SEQ ID NO: 10125 - DNA, 20 bp, Artificial Sequence
  Artificially Synthesized Primer Sequence
acctcaacctgctgctcact

SEQ ID NO: 10126 - DNA, 20 bp, Artificial Sequence
  Artificially Synthesized Primer Sequence
ttgttaggtcgctggagctt

SEQ ID NO: 10127 - DNA, 20 bp, Artificial Sequence
  Artificially Synthesized Primer Sequence
taaagcaagggcagaggaga

SEQ ID NO: 10128 - DNA, 20 bp, Artificial Sequence
  Artificially Synthesized Primer Sequence
ttcagagccttggaaaatgg

SEQ ID NO: 10129 - DNA, 20 bp, Artificial Sequence
  Artificially Synthesized Primer Sequence
catgtaccccaagtgtgcag

SEQ ID NO: 10130 - DNA, 20 bp, Artificial Sequence
  Artificially Synthesized Primer Sequence
caatcgacgcaatgaacatc

SEQ ID NO: 10131 - DNA, 20 bp, Artificial Sequence
  Artificially Synthesized Primer Sequence
ctgagcaggtccaaacacaa

SEQ ID NO: 10132 - DNA, 20 bp, Artificial Sequence
  Artificially Synthesized Primer Sequence
gatttgatctaccgcccaga

SEQ ID NO: 10133 - DNA, 20 bp, Artificial Sequence
  Artificially Synthesized Primer Sequence
ctcaaggatacaccctggga

SEQ ID NO: 10134 - DNA, 20 bp, Artificial Sequence
  Artificially Synthesized Primer Sequence
ccaggcattggatatcgtct

SEQ ID NO: 10135 - DNA, 20 bp, Artificial Sequence
  Artificially Synthesized Primer Sequence
cgtaacaacaggcgtcacat

SEQ ID NO: 10136 - DNA, 20 bp, Artificial Sequence
  Artificially Synthesized Primer Sequence
cacagcatgaaaggggaaat

SEQ ID NO: 10137 - DNA, 20 bp, Artificial Sequence
  Artificially Synthesized Primer Sequence
cttctgctttctcgtccacc

SEQ ID NO: 10138 - DNA, 20 bp, Artificial Sequence
  Artificially Synthesized Primer Sequence
cccagatacccaggatgaga

SEQ ID NO: 10139 - DNA, 20 bp, Artificial Sequence
  Artificially Synthesized Primer Sequence
cccacctaaaatcctagccc

SEQ ID NO: 10140 - DNA, 20 bp, Artificial Sequence
  Artificially Synthesized Primer Sequence
ggtcttcctggtggtggtaa

SEQ ID NO: 10141 - DNA, 20 bp, Artificial Sequence
  Artificially Synthesized Primer Sequence
agggaaaatgggaagcttgt

SEQ ID NO: 10142 - DNA, 20 bp, Artificial Sequence
  Artificially Synthesized Primer Sequence
ttcaaactccccctcaactg

SEQ ID NO: 10143 - DNA, 20 bp, Artificial Sequence
  Artificially Synthesized Primer Sequence
ttcaaactccccctcaactg

SEQ ID NO: 10144 - DNA, 20 bp, Artificial Sequence
  Artificially Synthesized Primer Sequence
agggaaaatgggaagcttgt

SEQ ID NO: 10145 - DNA, 20 bp, Artificial Sequence
  Artificially Synthesized Primer Sequence
attgaatattatgcgggcca

SEQ ID NO: 10146 - DNA, 20 bp, Artificial Sequence
  Artificially Synthesized Primer Sequence
aggggatgaaaagcacctct

SEQ ID NO: 10147 - DNA, 20 bp, Artificial Sequence
  Artificially Synthesized Primer Sequence
aggaagcccgaaggtagttc

SEQ ID NO: 10148 - DNA, 20 bp, Artificial Sequence
  Artificially Synthesized Primer Sequence
agaggtgcttttcatcccct

SEQ ID NO: 10149 - DNA, 20 bp, Artificial Sequence
  Artificially Synthesized Primer Sequence
cagcttgagtctgttgctgc

SEQ ID NO: 10150 - DNA, 20 bp, Artificial Sequence
  Artificially Synthesized Primer Sequence
gcttgcacacttccacagaa

SEQ ID NO: 10151 - DNA, 20 bp, Artificial Sequence
  Artificially Synthesized Primer Sequence
aatatgcaaggcttgatcgg

SEQ ID NO: 10152 - DNA, 20 bp, Artificial Sequence
  Artificially Synthesized Primer Sequence
tccaagtcggtgtgtgacat

SEQ ID NO: 10153 - DNA, 20 bp, Artificial Sequence
  Artificially Synthesized Primer Sequence
atggctttgcaatcctcaac

SEQ ID NO: 10154 - DNA, 20 bp, Artificial Sequence
  Artificially Synthesized Primer Sequence
ccgcacctaactctcgtctc

SEQ ID NO: 10155 - DNA, 20 bp, Artificial Sequence
  Artificially Synthesized Primer Sequence
atacccaatgcccatgaaaa

SEQ ID NO: 10156 - DNA, 20 bp, Artificial Sequence
  Artificially Synthesized Primer Sequence
cttctggttcgtgctccttc

SEQ ID NO: 10157 - DNA, 20 bp, Artificial Sequence
  Artificially Synthesized Primer Sequence
ggttccatgtgttgcagttg

SEQ ID NO: 10158 - DNA, 20 bp, Artificial Sequence
  Artificially Synthesized Primer Sequence
tgatcttttgtctccgggtc

SEQ ID NO: 10159 - DNA, 20 bp, Artificial Sequence
  Artificially Synthesized Primer Sequence
agcgctcaagcatatccagt

SEQ ID NO: 10160 - DNA, 20 bp, Artificial Sequence
  Artificially Synthesized Primer Sequence
tgaagtagtggctgatcccc

SEQ ID NO: 10161 - DNA, 20 bp, Artificial Sequence
  Artificially Synthesized Primer Sequence
caagaagaaggaccgtcgag

SEQ ID NO: 10162 - DNA, 20 bp, Artificial Sequence
  Artificially Synthesized Primer Sequence
ggctgggttgtgttgattct

SEQ ID NO: 10163 - DNA, 20 bp, Artificial Sequence
  Artificially Synthesized Primer Sequence
gctccaacacctcaccctta

SEQ ID NO: 10164 - DNA, 20 bp, Artificial Sequence
  Artificially Synthesized Primer Sequence
ggcgtcaagaactgatccat

SEQ ID NO: 10165 - DNA, 20 bp, Artificial Sequence
  Artificially Synthesized Primer Sequence
tgatcttcgcaacgtacgag

SEQ ID NO: 10166 - DNA, 20 bp, Artificial Sequence
  Artificially Synthesized Primer Sequence
ccaagactggcattggaaat

SEQ ID NO: 10167 - DNA, 20 bp, Artificial Sequence
  Artificially Synthesized Primer Sequence
tgctacgtttgctatgacgc

SEQ ID NO: 10168 - DNA, 20 bp, Artificial Sequence
  Artificially Synthesized Primer Sequence
gttggcctttccatttctga

SEQ ID NO: 10169 - DNA, 20 bp, Artificial Sequence
  Artificially Synthesized Primer Sequence
gtgttcatgcacatcttggg

SEQ ID NO: 10170 - DNA, 20 bp, Artificial Sequence
  Artificially Synthesized Primer Sequence
ttggggccccctatactatc

SEQ ID NO: 10171 - DNA, 20 bp, Artificial Sequence
  Artificially Synthesized Primer Sequence
ggggaaagcagatgttctca

SEQ ID NO: 10172 - DNA, 20 bp, Artificial Sequence
  Artificially Synthesized Primer Sequence
ctggagcaaacaatgggagt

SEQ ID NO: 10173 - DNA, 20 bp, Artificial Sequence
  Artificially Synthesized Primer Sequence
ggcctaactttggtggcata

SEQ ID NO: 10174 - DNA, 20 bp, Artificial Sequence
  Artificially Synthesized Primer Sequence
tgctgaaaccagtaaacccc

SEQ ID NO: 10175 - DNA, 20 bp, Artificial Sequence
  Artificially Synthesized Primer Sequence
agccaatcctccaccagata

SEQ ID NO: 10176 - DNA, 20 bp, Artificial Sequence
  Artificially Synthesized Primer Sequence
caggtaccgggatttcaaga

SEQ ID NO: 10177 - DNA, 20 bp, Artificial Sequence
  Artificially Synthesized Primer Sequence
tctctttcgcttttcctcca

SEQ ID NO: 10178 - DNA, 20 bp, Artificial Sequence
  Artificially Synthesized Primer Sequence
tccgataaaagagtgggacg

SEQ ID NO: 10179 - DNA, 20 bp, Artificial Sequence
  Artificially Synthesized Primer Sequence
aagattgcaatgtcttgccc

SEQ ID NO: 10180 - DNA, 20 bp, Artificial Sequence
  Artificially Synthesized Primer Sequence
ggacaaaaaccaagcaaagc

SEQ ID NO: 10181 - DNA, 20 bp, Artificial Sequence
  Artificially Synthesized Primer Sequence
gcattttaaccgtgcatgtg

SEQ ID NO: 10182 - DNA, 20 bp, Artificial Sequence
  Artificially Synthesized Primer Sequence
cacctaactcgaccccagaa

SEQ ID NO: 10183 - DNA, 20 bp, Artificial Sequence
  Artificially Synthesized Primer Sequence
cgtcttgtgtcgtgtctcgt

SEQ ID NO: 10184 - DNA, 20 bp, Artificial Sequence
  Artificially Synthesized Primer Sequence
agcggcagtagcttggtaaa

SEQ ID NO: 10185 - DNA, 20 bp, Artificial Sequence
  Artificially Synthesized Primer Sequence
ggagttcgaccacatgttca

SEQ ID NO: 10186 - DNA, 20 bp, Artificial Sequence
  Artificially Synthesized Primer Sequence
gggaccgtgtaggaggtgta

SEQ ID NO: 10187 - DNA, 20 bp, Artificial Sequence
  Artificially Synthesized Primer Sequence
gagctgactcgaaaactggg

SEQ ID NO: 10188 - DNA, 20 bp, Artificial Sequence
  Artificially Synthesized Primer Sequence
acagtttgacccgtggagac

SEQ ID NO: 10189 - DNA, 20 bp, Artificial Sequence
  Artificially Synthesized Primer Sequence
gttggcctactggagagcag

SEQ ID NO: 10190 - DNA, 20 bp, Artificial Sequence
  Artificially Synthesized Primer Sequence
ggagaagtcggtggacttga

SEQ ID NO: 10191 - DNA, 20 bp, Artificial Sequence
  Artificially Synthesized Primer Sequence
gtcgaaatgtacctaggccg

SEQ ID NO: 10192 - DNA, 19 bp, Artificial Sequence
  Artificially Synthesized Primer Sequence
aagaggtggttaaggccga

SEQ ID NO: 10193 - DNA, 20 bp, Artificial Sequence
  Artificially Synthesized Primer Sequence
tactggattcaggcattccc

SEQ ID NO: 10194 - DNA, 20 bp, Artificial Sequence
  Artificially Synthesized Primer Sequence
tatcatccgtagctccctgc

SEQ ID NO: 10195 - DNA, 20 bp, Artificial Sequence
  Artificially Synthesized Primer Sequence
acgaattgtgagggagcatc

SEQ ID NO: 10196 - DNA, 20 bp, Artificial Sequence
  Artificially Synthesized Primer Sequence
gtcagatcattgcgagggac

SEQ ID NO: 10197 - DNA, 20 bp, Artificial Sequence
  Artificially Synthesized Primer Sequence
gtttggcatcaccaggaact

SEQ ID NO: 10198 - DNA, 20 bp, Artificial Sequence
  Artificially Synthesized Primer Sequence
gtgggctcgcaattttacat

SEQ ID NO: 10199 - DNA, 19 bp, Artificial Sequence
  Artificially Synthesized Primer Sequence
caaaaccggaatggctctt

SEQ ID NO: 10200 - DNA, 20 bp, Artificial Sequence
  Artificially Synthesized Primer Sequence
ggatatggtttgggtcatcg

SEQ ID NO: 10201 - DNA, 20 bp, Artificial Sequence
  Artificially Synthesized Primer Sequence
ttggaaccagttagggttcg

SEQ ID NO: 10202 - DNA, 20 bp, Artificial Sequence
  Artificially Synthesized Primer Sequence
tgaccaaatgtgtgcaggat

SEQ ID NO: 10203 - DNA, 20 bp, Artificial Sequence
  Artificially Synthesized Primer Sequence
tgataaagcaaaacccctgc

SEQ ID NO: 10204 - DNA, 20 bp, Artificial Sequence
  Artificially Synthesized Primer Sequence
agcaaagctagtgcaggctc

SEQ ID NO: 10205 - DNA, 20 bp, Artificial Sequence
  Artificially Synthesized Primer Sequence
aggcaagtcctctgagacca

SEQ ID NO: 10206 - DNA, 20 bp, Artificial Sequence
  Artificially Synthesized Primer Sequence
gttcgcaaagcctaatctgc

SEQ ID NO: 10207 - DNA, 20 bp, Artificial Sequence
  Artificially Synthesized Primer Sequence
attcttgctcacgaaccgat

SEQ ID NO: 10208 - DNA, 20 bp, Artificial Sequence
  Artificially Synthesized Primer Sequence
cagcagcagcatttgttgac

SEQ ID NO: 10209 - DNA, 20 bp, Artificial Sequence
  Artificially Synthesized Primer Sequence
ctccgttcaaagctaccgac

SEQ ID NO: 10210 - DNA, 20 bp, Artificial Sequence
  Artificially Synthesized Primer Sequence
ctgcgaaagaagaggaccac

SEQ ID NO: 10211 - DNA, 20 bp, Artificial Sequence
  Artificially Synthesized Primer Sequence
tgtcgttgaggaattggaca

SEQ ID NO: 10212 - DNA, 20 bp, Artificial Sequence
  Artificially Synthesized Primer Sequence
ggaagggttcttggagagga

SEQ ID NO: 10213 - DNA, 20 bp, Artificial Sequence
  Artificially Synthesized Primer Sequence
agacgaggacctgttcgaga

SEQ ID NO: 10214 - DNA, 20 bp, Artificial Sequence
  Artificially Synthesized Primer Sequence
cagcacggtcaggaaaaact

SEQ ID NO: 10215 - DNA, 20 bp, Artificial Sequence
  Artificially Synthesized Primer Sequence
ccaagaaaaatccccatcct

SEQ ID NO: 10216 - DNA, 20 bp, Artificial Sequence
  Artificially Synthesized Primer Sequence
gtactacgacggcaagtccc

SEQ ID NO: 10217 - DNA, 20 bp, Artificial Sequence
  Artificially Synthesized Primer Sequence
acgtcctggtggaatgaaag

SEQ ID NO: 10218 - DNA, 20 bp, Artificial Sequence
  Artificially Synthesized Primer Sequence
tttgagcaacatgtgggtgt

SEQ ID NO: 10219 - DNA, 20 bp, Artificial Sequence
  Artificially Synthesized Primer Sequence
aatgttccggtcacattcct

SEQ ID NO: 10220 - DNA, 20 bp, Artificial Sequence
  Artificially Synthesized Primer Sequence
catgggggcttttgttattg

SEQ ID NO: 10221 - DNA, 20 bp, Artificial Sequence
  Artificially Synthesized Primer Sequence
tgtacaacaaagcaggctgg

SEQ ID NO: 10222 - DNA, 20 bp, Artificial Sequence
  Artificially Synthesized Primer Sequence
cgtctaggagctcgcgtatc

SEQ ID NO: 10223 - DNA, 20 bp, Artificial Sequence
  Artificially Synthesized Primer Sequence
ccacaagtgaagttgcgttg

SEQ ID NO: 10224 - DNA, 20 bp, Artificial Sequence
  Artificially Synthesized Primer Sequence
agccagctgaggttgttgat

SEQ ID NO: 10225 - DNA, 20 bp, Artificial Sequence
  Artificially Synthesized Primer Sequence
agatacaggagggaggcgat

SEQ ID NO: 10226 - DNA, 20 bp, Artificial Sequence
  Artificially Synthesized Primer Sequence
atgtagtgtaggcgttcggc

SEQ ID NO: 10227 - DNA, 20 bp, Artificial Sequence
  Artificially Synthesized Primer Sequence
tcatacagaacgggcatcag

SEQ ID NO: 10228 - DNA, 20 bp, Artificial Sequence
  Artificially Synthesized Primer Sequence
gatgaagaaggacgacaggg

SEQ ID NO: 10229 - DNA, 20 bp, Artificial Sequence
  Artificially Synthesized Primer Sequence
ccctgtatccctctcccact

SEQ ID NO: 10230 - DNA, 20 bp, Artificial Sequence
  Artificially Synthesized Primer Sequence
acaccaaagcttgctggttc

SEQ ID NO: 10231 - DNA, 20 bp, Artificial Sequence
  Artificially Synthesized Primer Sequence
tcgagcgaacaattccaata

SEQ ID NO: 10232 - DNA, 20 bp, Artificial Sequence
  Artificially Synthesized Primer Sequence
aaggtgctcagctccaagac

SEQ ID NO: 10233 - DNA, 20 bp, Artificial Sequence
  Artificially Synthesized Primer Sequence
tagctgccttcttcaccgat

SEQ ID NO: 10234 - DNA, 20 bp, Artificial Sequence
  Artificially Synthesized Primer Sequence
ttcttcgtcggctaactcgt

SEQ ID NO: 10235 - DNA, 20 bp, Artificial Sequence
  Artificially Synthesized Primer Sequence
gaagacgttggtggcaattt

SEQ ID NO: 10236 - DNA, 20 bp, Artificial Sequence
  Artificially Synthesized Primer Sequence
gcgtaatttggacagggcta

SEQ ID NO: 10237 - DNA, 20 bp, Artificial Sequence
  Artificially Synthesized Primer Sequence
aaatcgcccaacaagttcag

SEQ ID NO: 10238 - DNA, 20 bp, Artificial Sequence
  Artificially Synthesized Primer Sequence
cttgatcacggagaagaggc

SEQ ID NO: 10239 - DNA, 20 bp, Artificial Sequence
  Artificially Synthesized Primer Sequence
ttgatagggacaaggctgct

SEQ ID NO: 10240 - DNA, 18 bp, Artificial Sequence
  Artificially Synthesized Primer Sequence
cttttccgcgcatcactt

SEQ ID NO: 10241 - DNA, 20 bp, Artificial Sequence
  Artificially Synthesized Primer Sequence
tcatctcgcagatggttgag

SEQ ID NO: 10242 - DNA, 20 bp, Artificial Sequence
  Artificially Synthesized Primer Sequence
gaacagcacgagaacgatga

SEQ ID NO: 10243 - DNA, 20 bp, Artificial Sequence
  Artificially Synthesized Primer Sequence
atcccatcatggcttgctac

SEQ ID NO: 10244 - DNA, 20 bp, Artificial Sequence
  Artificially Synthesized Primer Sequence
cactactcccctatgggcaa

SEQ ID NO: 10245 - DNA, 20 bp, Artificial Sequence
  Artificially Synthesized Primer Sequence
cacctccacaagaacggagt

SEQ ID NO: 10246 - DNA, 20 bp, Artificial Sequence
  Artificially Synthesized Primer Sequence
gttccatggacaaagcacct

SEQ ID NO: 10247 - DNA, 20 bp, Artificial Sequence
  Artificially Synthesized Primer Sequence
attcagatgaggctgggatg

SEQ ID NO: 10248 - DNA, 20 bp, Artificial Sequence
  Artificially Synthesized Primer Sequence
gctcagataggtgatgcggt

SEQ ID NO: 10249 - DNA, 20 bp, Artificial Sequence
  Artificially Synthesized Primer Sequence
tcgatttccggcaaattaac

SEQ ID NO: 10250 - DNA, 20 bp, Artificial Sequence
  Artificially Synthesized Primer Sequence
ggaaaacagggaacaaacga

SEQ ID NO: 10251 - DNA, 20 bp, Artificial Sequence
  Artificially Synthesized Primer Sequence
tttcacatgcctcagtggag

SEQ ID NO: 10252 - DNA, 20 bp, Artificial Sequence
  Artificially Synthesized Primer Sequence
ctgagttgcactcgcagaag

SEQ ID NO: 10253 - DNA, 20 bp, Artificial Sequence
  Artificially Synthesized Primer Sequence
taattgggtagcaaccctcg

SEQ ID NO: 10254 - DNA, 20 bp, Artificial Sequence
  Artificially Synthesized Primer Sequence
ggaattttccggatccaagt

SEQ ID NO: 10255 - DNA, 20 bp, Artificial Sequence
  Artificially Synthesized Primer Sequence
aagcctacatacaggaggcg

SEQ ID NO: 10256 - DNA, 20 bp, Artificial Sequence
  Artificially Synthesized Primer Sequence
gtgaaccagatgctcccaac

SEQ ID NO: 10257 - DNA, 20 bp, Artificial Sequence
  Artificially Synthesized Primer Sequence
cagtgcaaaaccacttggaa

SEQ ID NO: 10258 - DNA, 20 bp, Artificial Sequence
  Artificially Synthesized Primer Sequence
ccatttggagccttgacaat

SEQ ID NO: 10259 - DNA, 20 bp, Artificial Sequence
  Artificially Synthesized Primer Sequence
tttagaagaaggtggggctg

SEQ ID NO: 10260 - DNA, 20 bp, Artificial Sequence
  Artificially Synthesized Primer Sequence
aaggccctcattgacatcag

SEQ ID NO: 10261 - DNA, 20 bp, Artificial Sequence
  Artificially Synthesized Primer Sequence
aggggaagtagatcgaggga

SEQ ID NO: 10262 - DNA, 20 bp, Artificial Sequence
  Artificially Synthesized Primer Sequence
tcagccagaaggagtccagt

SEQ ID NO: 10263 - DNA, 20 bp, Artificial Sequence
  Artificially Synthesized Primer Sequence
ggtgactttccggtccaata

SEQ ID NO: 10264 - DNA, 20 bp, Artificial Sequence
  Artificially Synthesized Primer Sequence
ggggaagtagatcgagggag

SEQ ID NO: 10265 - DNA, 20 bp, Artificial Sequence
  Artificially Synthesized Primer Sequence
ctacatcccacagccaacct

SEQ ID NO: 10266 - DNA, 20 bp, Artificial Sequence
  Artificially Synthesized Primer Sequence
agaatggcagcaatgctttt

SEQ ID NO: 10267 - DNA, 20 bp, Artificial Sequence
  Artificially Synthesized Primer Sequence
aacacctcagcattcaaggg

SEQ ID NO: 10268 - DNA, 20 bp, Artificial Sequence
  Artificially Synthesized Primer Sequence
gccttcatgaggcaggaata

SEQ ID NO: 10269 - DNA, 20 bp, Artificial Sequence
  Artificially Synthesized Primer Sequence
accgcagaaaaatgaacacc

SEQ ID NO: 10270 - DNA, 20 bp, Artificial Sequence
  Artificially Synthesized Primer Sequence
cgcgcgtaggagattaaaag

SEQ ID NO: 10271 - DNA, 20 bp, Artificial Sequence
  Artificially Synthesized Primer Sequence
aggggtcagagctgcagtaa

SEQ ID NO: 10272 - DNA, 20 bp, Artificial Sequence
  Artificially Synthesized Primer Sequence
gacgacgatggcactacaga

SEQ ID NO: 10273 - DNA, 20 bp, Artificial Sequence
  Artificially Synthesized Primer Sequence
gtccgtccctctgtcatgtt

SEQ ID NO: 10274 - DNA, 20 bp, Artificial Sequence
  Artificially Synthesized Primer Sequence
aaaccagccagtaacgttgg

SEQ ID NO: 10275 - DNA, 20 bp, Artificial Sequence
  Artificially Synthesized Primer Sequence
gcagtgactttgctggaaca

SEQ ID NO: 10276 - DNA, 20 bp, Artificial Sequence
  Artificially Synthesized Primer Sequence
ctcggtccgtggaaagatac

SEQ ID NO: 10277 - DNA, 20 bp, Artificial Sequence
  Artificially Synthesized Primer Sequence
cctcaaagtgcgtagaagcc

SEQ ID NO: 10278 - DNA, 20 bp, Artificial Sequence
  Artificially Synthesized Primer Sequence
aagaaagactgacaggcgga

SEQ ID NO: 10279 - DNA, 20 bp, Artificial Sequence
  Artificially Synthesized Primer Sequence
ggcatcgtgatgacgtacag

SEQ ID NO: 10280 - DNA, 20 bp, Artificial Sequence
  Artificially Synthesized Primer Sequence
tccgcctgtcagtctttctt

SEQ ID NO: 10281 - DNA, 20 bp, Artificial Sequence
  Artificially Synthesized Primer Sequence
ctacatcccacagccaacct

SEQ ID NO: 10282 - DNA, 20 bp, Artificial Sequence
  Artificially Synthesized Primer Sequence
cagctatgtcagcactccca

SEQ ID NO: 10283 - DNA, 20 bp, Artificial Sequence
  Artificially Synthesized Primer Sequence
ccaataacacgcctctggtt

SEQ ID NO: 10284 - DNA, 20 bp, Artificial Sequence
  Artificially Synthesized Primer Sequence
ggccatggctgataggataa

SEQ ID NO: 10285 - DNA, 20 bp, Artificial Sequence
  Artificially Synthesized Primer Sequence
agcactcccttctccactca

SEQ ID NO: 10286 - DNA, 20 bp, Artificial Sequence
  Artificially Synthesized Primer Sequence
acagtgtcgtgctccaacag

SEQ ID NO: 10287 - DNA, 20 bp, Artificial Sequence
  Artificially Synthesized Primer Sequence
taacctttcccatggcattc

SEQ ID NO: 10288 - DNA, 20 bp, Artificial Sequence
  Artificially Synthesized Primer Sequence
agcattagaaattgaggcgg

SEQ ID NO: 10289 - DNA, 20 bp, Artificial Sequence
  Artificially Synthesized Primer Sequence
cgacatcaaggagtcagcaa

SEQ ID NO: 10290 - DNA, 20 bp, Artificial Sequence
  Artificially Synthesized Primer Sequence
ttatttcgacgaacaagccc

SEQ ID NO: 10291 - DNA, 20 bp, Artificial Sequence
  Artificially Synthesized Primer Sequence
ggtgacacacctcggcttat

SEQ ID NO: 10292 - DNA, 20 bp, Artificial Sequence
  Artificially Synthesized Primer Sequence
cgacatcaaggagtcagcaa

SEQ ID NO: 10293 - DNA, 20 bp, Artificial Sequence
  Artificially Synthesized Primer Sequence
tagttcttgctgatggtgcg

SEQ ID NO: 10294 - DNA, 20 bp, Artificial Sequence
  Artificially Synthesized Primer Sequence
gagagctccacttgacctgg

SEQ ID NO: 10295 - DNA, 20 bp, Artificial Sequence
  Artificially Synthesized Primer Sequence
ctaagcgcttttgctttgct

SEQ ID NO: 10296 - DNA, 20 bp, Artificial Sequence
  Artificially Synthesized Primer Sequence
actttgtgagacgtggaggg

SEQ ID NO: 10297 - DNA, 20 bp, Artificial Sequence
  Artificially Synthesized Primer Sequence
tgatgacattatcgcccaga

SEQ ID NO: 10298 - DNA, 20 bp, Artificial Sequence
  Artificially Synthesized Primer Sequence
ctctgctgtttcgtggatca

SEQ ID NO: 10299 - DNA, 20 bp, Artificial Sequence
  Artificially Synthesized Primer Sequence
ctctgctgtttcgtggatca

SEQ ID NO: 10300 - DNA, 20 bp, Artificial Sequence
  Artificially Synthesized Primer Sequence
tgatgacattatcgcccaga

SEQ ID NO: 10301 - DNA, 20 bp, Artificial Sequence
  Artificially Synthesized Primer Sequence
gctcaagctcaaaaggttgg

SEQ ID NO: 10302 - DNA, 20 bp, Artificial Sequence
  Artificially Synthesized Primer Sequence
gctttgttctccactcaggc

SEQ ID NO: 10303 - DNA, 20 bp, Artificial Sequence
  Artificially Synthesized Primer Sequence
ccctccacgtctcacaaagt

SEQ ID NO: 10304 - DNA, 20 bp, Artificial Sequence
  Artificially Synthesized Primer Sequence
tgaggaactactggcgaagg

SEQ ID NO: 10305 - DNA, 20 bp, Artificial Sequence
  Artificially Synthesized Primer Sequence
cagaaagcagcaatgttcca

SEQ ID NO: 10306 - DNA, 20 bp, Artificial Sequence
  Artificially Synthesized Primer Sequence
ctccagatcgctgaatgaca

SEQ ID NO: 10307 - DNA, 20 bp, Artificial Sequence
  Artificially Synthesized Primer Sequence
tcagaatcctgcatcgacac

SEQ ID NO: 10308 - DNA, 20 bp, Artificial Sequence
  Artificially Synthesized Primer Sequence
tacactccggatgatgacga

SEQ ID NO: 10309 - DNA, 20 bp, Artificial Sequence
  Artificially Synthesized Primer Sequence
cattgcactgcagcagattt

SEQ ID NO: 10310 - DNA, 20 bp, Artificial Sequence
  Artificially Synthesized Primer Sequence
gaagcacctgaacaagctcc

SEQ ID NO: 10311 - DNA, 20 bp, Artificial Sequence
  Artificially Synthesized Primer Sequence
cagccttgatccacagttca

SEQ ID NO: 10312 - DNA, 20 bp, Artificial Sequence
  Artificially Synthesized Primer Sequence
ggagcttgttcaggtgcttc

SEQ ID NO: 10313 - DNA, 20 bp, Artificial Sequence
  Artificially Synthesized Primer Sequence
ttttcttggatgggagatgc

SEQ ID NO: 10314 - DNA, 20 bp, Artificial Sequence
  Artificially Synthesized Primer Sequence
tcacacacagccatgcatta

SEQ ID NO: 10315 - DNA, 20 bp, Artificial Sequence
  Artificially Synthesized Primer Sequence
atctactggccgatgacctg

SEQ ID NO: 10316 - DNA, 20 bp, Artificial Sequence
  Artificially Synthesized Primer Sequence
gggtgtcgctgatgtcctat

SEQ ID NO: 10317 - DNA, 20 bp, Artificial Sequence
  Artificially Synthesized Primer Sequence
acaatgtgacttgcatccca

SEQ ID NO: 10318 - DNA, 20 bp, Artificial Sequence
  Artificially Synthesized Primer Sequence
atgaacaatgcggaaaggag

SEQ ID NO: 10319 - DNA, 20 bp, Artificial Sequence
  Artificially Synthesized Primer Sequence
aatcggctgatacaacccac

SEQ ID NO: 10320 - DNA, 20 bp, Artificial Sequence
  Artificially Synthesized Primer Sequence
atcctcgacatcaagaaccg

SEQ ID NO: 10321 - DNA, 20 bp, Artificial Sequence
  Artificially Synthesized Primer Sequence
accacacgattgcatctgaa

SEQ ID NO: 10322 - DNA, 20 bp, Artificial Sequence
  Artificially Synthesized Primer Sequence
ggactacgatctggggttga

SEQ ID NO: 10323 - DNA, 20 bp, Artificial Sequence
  Artificially Synthesized Primer Sequence
tgacaccgaaaaccatttga

SEQ ID NO: 10324 - DNA, 20 bp, Artificial Sequence
  Artificially Synthesized Primer Sequence
tcagggagctgacgaagact

SEQ ID NO: 10325 - DNA, 20 bp, Artificial Sequence
  Artificially Synthesized Primer Sequence
tccgcggatagtccaaatag

SEQ ID NO: 10326 - DNA, 20 bp, Artificial Sequence
  Artificially Synthesized Primer Sequence
aagcatcgttggagcatctt

SEQ ID NO: 10327 - DNA, 20 bp, Artificial Sequence
  Artificially Synthesized Primer Sequence
atatgcctcacgaaacgagg

SEQ ID NO: 10328 - DNA, 20 bp, Artificial Sequence
  Artificially Synthesized Primer Sequence
tgatggcagtacccaaaaca

SEQ ID NO: 10329 - DNA, 20 bp, Artificial Sequence
  Artificially Synthesized Primer Sequence
caactcttcatgtgcggaga

SEQ ID NO: 10330 - DNA, 20 bp, Artificial Sequence
  Artificially Synthesized Primer Sequence
gatgccatcctaatgccact

SEQ ID NO: 10331 - DNA, 20 bp, Artificial Sequence
  Artificially Synthesized Primer Sequence
aaatgctccagttgacaggc

SEQ ID NO: 10332 - DNA, 20 bp, Artificial Sequence
  Artificially Synthesized Primer Sequence
cggcactgaacattctgcta

SEQ ID NO: 10333 - DNA, 20 bp, Artificial Sequence
  Artificially Synthesized Primer Sequence
gggctagggttttggatttc

SEQ ID NO: 10334 - DNA, 20 bp, Artificial Sequence
  Artificially Synthesized Primer Sequence
caactcccccaaactgaaaa

SEQ ID NO: 10335 - DNA, 22 bp, Artificial Sequence
  Artificially Synthesized Primer Sequence
tgcatcacatgcaataactgag

SEQ ID NO: 10336 - DNA, 20 bp, Artificial Sequence
  Artificially Synthesized Primer Sequence
gggctagggttttggatttc

SEQ ID NO: 10337 - DNA, 20 bp, Artificial Sequence
  Artificially Synthesized Primer Sequence
ggaaaagaaatcggcattga

SEQ ID NO: 10338 - DNA, 20 bp, Artificial Sequence
  Artificially Synthesized Primer Sequence
atcgatacctactggtggcg

SEQ ID NO: 10339 - DNA, 20 bp, Artificial Sequence
  Artificially Synthesized Primer Sequence
aacaacgcagctcgataacc

SEQ ID NO: 10340 - DNA, 20 bp, Artificial Sequence
  Artificially Synthesized Primer Sequence
gtggctccgagaagttgaga

SEQ ID NO: 10341 - DNA, 20 bp, Artificial Sequence
  Artificially Synthesized Primer Sequence
tctgttttgccatgctcttg

SEQ ID NO: 10342 - DNA, 20 bp, Artificial Sequence
  Artificially Synthesized Primer Sequence
aagcgaggccataaacacac

SEQ ID NO: 10343 - DNA, 20 bp, Artificial Sequence
  Artificially Synthesized Primer Sequence
atatgacccacagtagcggg

SEQ ID NO: 10344 - DNA, 20 bp, Artificial Sequence
  Artificially Synthesized Primer Sequence
atagtgcgtttatggcctcg

SEQ ID NO: 10345 - DNA, 20 bp, Artificial Sequence
  Artificially Synthesized Primer Sequence
agctgtggaaagaaggcaaa

SEQ ID NO: 10346 - DNA, 20 bp, Artificial Sequence
  Artificially Synthesized Primer Sequence
cctaccatccagggcagtaa

SEQ ID NO: 10347 - DNA, 20 bp, Artificial Sequence
  Artificially Synthesized Primer Sequence
gccgcatctaatggagaaag

SEQ ID NO: 10348 - DNA, 20 bp, Artificial Sequence
  Artificially Synthesized Primer Sequence
ggacatggcaactccctaaa

SEQ ID NO: 10349 - DNA, 20 bp, Artificial Sequence
  Artificially Synthesized Primer Sequence
agctgagcttggatttgcat

SEQ ID NO: 10350 - DNA, 20 bp, Artificial Sequence
  Artificially Synthesized Primer Sequence
cgttaattgaccgcgatttt

SEQ ID NO: 10351 - DNA, 20 bp, Artificial Sequence
  Artificially Synthesized Primer Sequence
tatacaatgcgatcacgcct

SEQ ID NO: 10352 - DNA, 20 bp, Artificial Sequence
  Artificially Synthesized Primer Sequence
atggagcatctgatggtggt

SEQ ID NO: 10353 - DNA, 20 bp, Artificial Sequence
  Artificially Synthesized Primer Sequence
gttagaggagtcgctgtgcc

SEQ ID NO: 10354 - DNA, 20 bp, Artificial Sequence
  Artificially Synthesized Primer Sequence
gcccttcagtcttgctgttc

SEQ ID NO: 10355 - DNA, 20 bp, Artificial Sequence
  Artificially Synthesized Primer Sequence
cgctcgctcaaatgtacaaa

SEQ ID NO: 10356 - DNA, 20 bp, Artificial Sequence
  Artificially Synthesized Primer Sequence
gttcttgccgggttactgaa

SEQ ID NO: 10357 - DNA, 20 bp, Artificial Sequence
  Artificially Synthesized Primer Sequence
gccaggtctacttcctcacg

SEQ ID NO: 10358 - DNA, 18 bp, Artificial Sequence
  Artificially Synthesized Primer Sequence
gagttgggggaggagagg

SEQ ID NO: 10359 - DNA, 20 bp, Artificial Sequence
  Artificially Synthesized Primer Sequence
cacttcctagcccacttgct

SEQ ID NO: 10360 - DNA, 20 bp, Artificial Sequence
  Artificially Synthesized Primer Sequence
ctcgagttatctcccctccc

SEQ ID NO: 10361 - DNA, 20 bp, Artificial Sequence
  Artificially Synthesized Primer Sequence
ccatccgaatgagcgagtat

SEQ ID NO: 10362 - DNA, 20 bp, Artificial Sequence
  Artificially Synthesized Primer Sequence
cccaagctacacctccatgt

SEQ ID NO: 10363 - DNA, 20 bp, Artificial Sequence
  Artificially Synthesized Primer Sequence
cgggcaacgactacttcaat

SEQ ID NO: 10364 - DNA, 20 bp, Artificial Sequence
  Artificially Synthesized Primer Sequence
ccatccgaatgagcgagtat

SEQ ID NO: 10365 - DNA, 20 bp, Artificial Sequence
  Artificially Synthesized Primer Sequence
agaagcgcggactaggtgta

SEQ ID NO: 10366 - DNA, 20 bp, Artificial Sequence
  Artificially Synthesized Primer Sequence
agagacccccacagaaaggt

SEQ ID NO: 10367 - DNA, 20 bp, Artificial Sequence
  Artificially Synthesized Primer Sequence
aagcctgttattgcgatgct

SEQ ID NO: 10368 - DNA, 20 bp, Artificial Sequence
  Artificially Synthesized Primer Sequence
aatacagcccttgccctctt

SEQ ID NO: 10369 - DNA, 20 bp, Artificial Sequence
  Artificially Synthesized Primer Sequence
gcaagtaccggcagaagaag

SEQ ID NO: 10370 - DNA, 20 bp, Artificial Sequence
  Artificially Synthesized Primer Sequence
attcgaggaatccgaggtct

SEQ ID NO: 10371 - DNA, 20 bp, Artificial Sequence
  Artificially Synthesized Primer Sequence
acacttctgctcccatccac

SEQ ID NO: 10372 - DNA, 20 bp, Artificial Sequence
  Artificially Synthesized Primer Sequence
tactgctgcagaactcacgc

SEQ ID NO: 10373 - DNA, 20 bp, Artificial Sequence
  Artificially Synthesized Primer Sequence
agatggcaggccataaacac

SEQ ID NO: 10374 - DNA, 20 bp, Artificial Sequence
  Artificially Synthesized Primer Sequence
accttcagtgacccgaattg

SEQ ID NO: 10375 - DNA, 20 bp, Artificial Sequence
  Artificially Synthesized Primer Sequence
tgctaattgcttcccaaggt

SEQ ID NO: 10376 - DNA, 20 bp, Artificial Sequence
  Artificially Synthesized Primer Sequence
atcccctttgttttgcatga

SEQ ID NO: 10377 - DNA, 20 bp, Artificial Sequence
  Artificially Synthesized Primer Sequence
cacattggtgttatgcctgc

SEQ ID NO: 10378 - DNA, 20 bp, Artificial Sequence
  Artificially Synthesized Primer Sequence
gaagctgccgaagttttgac

SEQ ID NO: 10379 - DNA, 20 bp, Artificial Sequence
  Artificially Synthesized Primer Sequence
gaactcagggagcgtctgtc

SEQ ID NO: 10380 - DNA, 20 bp, Artificial Sequence
  Artificially Synthesized Primer Sequence
cacctgtaccatgccaactg

SEQ ID NO: 10381 - DNA, 20 bp, Artificial Sequence
  Artificially Synthesized Primer Sequence
gtactacggcctcaagcgag

SEQ ID NO: 10382 - DNA, 20 bp, Artificial Sequence
  Artificially Synthesized Primer Sequence
atccttaagaatggcggctt

SEQ ID NO: 10383 - DNA, 19 bp, Artificial Sequence
  Artificially Synthesized Primer Sequence
gagctgcagagccttccat

SEQ ID NO: 10384 - DNA, 20 bp, Artificial Sequence
  Artificially Synthesized Primer Sequence
gtactacggcctcaagcgag

SEQ ID NO: 10385 - DNA, 20 bp, Artificial Sequence
  Artificially Synthesized Primer Sequence
aggaaagacgtgctgctgat

SEQ ID NO: 10386 - DNA, 20 bp, Artificial Sequence
  Artificially Synthesized Primer Sequence
agttggcagtggtttgatcc

SEQ ID NO: 10387 - DNA, 20 bp, Artificial Sequence
  Artificially Synthesized Primer Sequence
gttggcagtggtttgatcct

SEQ ID NO: 10388 - DNA, 20 bp, Artificial Sequence
  Artificially Synthesized Primer Sequence
aggaaagacgtgctgctgat

SEQ ID NO: 10389 - DNA, 20 bp, Artificial Sequence
  Artificially Synthesized Primer Sequence
taaagtgccatttgctcacg

SEQ ID NO: 10390 - DNA, 20 bp, Artificial Sequence
  Artificially Synthesized Primer Sequence
gctgaacttcggacaaaagc

SEQ ID NO: 10391 - DNA, 20 bp, Artificial Sequence
  Artificially Synthesized Primer Sequence
ttgtgcacgagtgtgtgaga

SEQ ID NO: 10392 - DNA, 20 bp, Artificial Sequence
  Artificially Synthesized Primer Sequence
gttgatgcatgcgtttcttg

SEQ ID NO: 10393 - DNA, 20 bp, Artificial Sequence
  Artificially Synthesized Primer Sequence
tatatttggcagggctccag

SEQ ID NO: 10394 - DNA, 20 bp, Artificial Sequence
  Artificially Synthesized Primer Sequence
acgatcaaaacccatggaga

SEQ ID NO: 10395 - DNA, 20 bp, Artificial Sequence
  Artificially Synthesized Primer Sequence
attaaaaaccccgggaaatg

SEQ ID NO: 10396 - DNA, 20 bp, Artificial Sequence
  Artificially Synthesized Primer Sequence
ctttgtattttgtcgccggt

SEQ ID NO: 10397 - DNA, 20 bp, Artificial Sequence
  Artificially Synthesized Primer Sequence
aaggtcatgatggccaagag

SEQ ID NO: 10398 - DNA, 20 bp, Artificial Sequence
  Artificially Synthesized Primer Sequence
aaaaatatgacagccgacgc

SEQ ID NO: 10399 - DNA, 20 bp, Artificial Sequence
  Artificially Synthesized Primer Sequence
catacaacagctcagacgcc

SEQ ID NO: 10400 - DNA, 20 bp, Artificial Sequence
  Artificially Synthesized Primer Sequence
gaccagaacggcttcatctc

SEQ ID NO: 10401 - DNA, 20 bp, Artificial Sequence
  Artificially Synthesized Primer Sequence
tgatagtggcgtggtgtgat

SEQ ID NO: 10402 - DNA, 20 bp, Artificial Sequence
  Artificially Synthesized Primer Sequence
gccatgagcctcttaactgc

SEQ ID NO: 10403 - DNA, 20 bp, Artificial Sequence
  Artificially Synthesized Primer Sequence
atttcaagcatcggttttgg

SEQ ID NO: 10404 - DNA, 20 bp, Artificial Sequence
  Artificially Synthesized Primer Sequence
tctttgctggtgtgcctatg

SEQ ID NO: 10405 - DNA, 20 bp, Artificial Sequence
  Artificially Synthesized Primer Sequence
tgaaacccttgagaagtggg

SEQ ID NO: 10406 - DNA, 20 bp, Artificial Sequence
  Artificially Synthesized Primer Sequence
aatccaagctgctgtctcgt

SEQ ID NO: 10407 - DNA, 20 bp, Artificial Sequence
  Artificially Synthesized Primer Sequence
aagccagacgtggagcttta

SEQ ID NO: 10408 - DNA, 20 bp, Artificial Sequence
  Artificially Synthesized Primer Sequence
gtggtgcaacaaagacgaca

SEQ ID NO: 10409 - DNA, 20 bp, Artificial Sequence
  Artificially Synthesized Primer Sequence
atgttatcagggttgagcgg

SEQ ID NO: 10410 - DNA, 20 bp, Artificial Sequence
  Artificially Synthesized Primer Sequence
cgtatcttcccaccagcatt

SEQ ID NO: 10411 - DNA, 20 bp, Artificial Sequence
  Artificially Synthesized Primer Sequence
aacgagtgtaacagtggggc

SEQ ID NO: 10412 - DNA, 20 bp, Artificial Sequence
  Artificially Synthesized Primer Sequence
aactgatgctgtgcaacctg

SEQ ID NO: 10413 - DNA, 20 bp, Artificial Sequence
  Artificially Synthesized Primer Sequence
ttctggcgaggatatgttcc

SEQ ID NO: 10414 - DNA, 20 bp, Artificial Sequence
  Artificially Synthesized Primer Sequence
gctccttcagaatgtcgagg

SEQ ID NO: 10415 - DNA, 20 bp, Artificial Sequence
  Artificially Synthesized Primer Sequence
acacacgcaaccgacaagta

SEQ ID NO: 10416 - DNA, 20 bp, Artificial Sequence
  Artificially Synthesized Primer Sequence
ttctggcgaggatatgttcc

SEQ ID NO: 10417 - DNA, 20 bp, Artificial Sequence
  Artificially Synthesized Primer Sequence
catcaccgctaccaacctct

SEQ ID NO: 10418 - DNA, 20 bp, Artificial Sequence
  Artificially Synthesized Primer Sequence
tgaacctttccctccctctt

SEQ ID NO: 10419 - DNA, 20 bp, Artificial Sequence
  Artificially Synthesized Primer Sequence
cccacaaacatttcccaatc

SEQ ID NO: 10420 - DNA, 20 bp, Artificial Sequence
  Artificially Synthesized Primer Sequence
aagaggcctttggctattcc

SEQ ID NO: 10421 - DNA, 20 bp, Artificial Sequence
  Artificially Synthesized Primer Sequence
tgatgaaatggtagcgcttg

SEQ ID NO: 10422 - DNA, 20 bp, Artificial Sequence
  Artificially Synthesized Primer Sequence
aattccacgaaaacgcaaac

SEQ ID NO: 10423 - DNA, 20 bp, Artificial Sequence
  Artificially Synthesized Primer Sequence
caagcgctaccatttcatca

SEQ ID NO: 10424 - DNA, 20 bp, Artificial Sequence
  Artificially Synthesized Primer Sequence
atcaccagcagtaaaagccg

SEQ ID NO: 10425 - DNA, 20 bp, Artificial Sequence
  Artificially Synthesized Primer Sequence
taacacatcaagcagggcag

SEQ ID NO: 10426 - DNA, 20 bp, Artificial Sequence
  Artificially Synthesized Primer Sequence
aatctgaacgaacccaatcg

SEQ ID NO: 10427 - DNA, 20 bp, Artificial Sequence
  Artificially Synthesized Primer Sequence
catgtttcaccgagttccaa

SEQ ID NO: 10428 - DNA, 20 bp, Artificial Sequence
  Artificially Synthesized Primer Sequence
gtggccaaaagacctgaaaa

SEQ ID NO: 10429 - DNA, 20 bp, Artificial Sequence
  Artificially Synthesized Primer Sequence
agccttccatctacgagggt

SEQ ID NO: 10430 - DNA, 20 bp, Artificial Sequence
  Artificially Synthesized Primer Sequence
gaaagaaaaggagggaacgg

SEQ ID NO: 10431 - DNA, 20 bp, Artificial Sequence
  Artificially Synthesized Primer Sequence
cttgacccaccccaaaacta

SEQ ID NO: 10432 - DNA, 20 bp, Artificial Sequence
  Artificially Synthesized Primer Sequence
cacagctgatcatggaaacg

SEQ ID NO: 10433 - DNA, 20 bp, Artificial Sequence
  Artificially Synthesized Primer Sequence
ctcctcctgttgctgcagtt

SEQ ID NO: 10434 - DNA, 20 bp, Artificial Sequence
  Artificially Synthesized Primer Sequence
ggtgttcttctcagtcccga

SEQ ID NO: 10435 - DNA, 20 bp, Artificial Sequence
  Artificially Synthesized Primer Sequence
gctgcaacagattcctcaca

SEQ ID NO: 10436 - DNA, 20 bp, Artificial Sequence
  Artificially Synthesized Primer Sequence
ggttccagcaccacaaatct

SEQ ID NO: 10437 - DNA, 20 bp, Artificial Sequence
  Artificially Synthesized Primer Sequence
tgattccaaacctcccagag

SEQ ID NO: 10438 - DNA, 20 bp, Artificial Sequence
  Artificially Synthesized Primer Sequence
gccacatgctgcagtctaaa

SEQ ID NO: 10439 - DNA, 20 bp, Artificial Sequence
  Artificially Synthesized Primer Sequence
gcattacgacgtatggctcc

SEQ ID NO: 10440 - DNA, 20 bp, Artificial Sequence
  Artificially Synthesized Primer Sequence
gaacctggacataaagccga

SEQ ID NO: 10441 - DNA, 20 bp, Artificial Sequence
  Artificially Synthesized Primer Sequence
ggtgcacgttgtttcaaatg

SEQ ID NO: 10442 - DNA, 20 bp, Artificial Sequence
  Artificially Synthesized Primer Sequence
caccatatttcccaacaggg

SEQ ID NO: 10443 - DNA, 20 bp, Artificial Sequence
  Artificially Synthesized Primer Sequence
agggcgaacatttcaatcac

SEQ ID NO: 10444 - DNA, 20 bp, Artificial Sequence
  Artificially Synthesized Primer Sequence
gttgaccctgcaaaaatggt

SEQ ID NO: 10445 - DNA, 20 bp, Artificial Sequence
  Artificially Synthesized Primer Sequence
gtgcctgctctccttcaatc

SEQ ID NO: 10446 - DNA, 20 bp, Artificial Sequence
  Artificially Synthesized Primer Sequence
tcctaaatggggtgcttctg

SEQ ID NO: 10447 - DNA, 20 bp, Artificial Sequence
  Artificially Synthesized Primer Sequence
gggtgtttttgcgtttgttt

SEQ ID NO: 10448 - DNA, 20 bp, Artificial Sequence
  Artificially Synthesized Primer Sequence
gaaggttttcgactgcaagc

SEQ ID NO: 10449 - DNA, 20 bp, Artificial Sequence
  Artificially Synthesized Primer Sequence
gaaccagaggaagctcgttg

SEQ ID NO: 10450 - DNA, 20 bp, Artificial Sequence
  Artificially Synthesized Primer Sequence
cccaatatcctgccattttg

SEQ ID NO: 10451 - DNA, 20 bp, Artificial Sequence
  Artificially Synthesized Primer Sequence
atggccacaaaatgatggtt

SEQ ID NO: 10452 - DNA, 20 bp, Artificial Sequence
  Artificially Synthesized Primer Sequence
aattcacatggagggctcac

SEQ ID NO: 10453 - DNA, 20 bp, Artificial Sequence
  Artificially Synthesized Primer Sequence
tgagggtttgatgcttttcc

SEQ ID NO: 10454 - DNA, 20 bp, Artificial Sequence
  Artificially Synthesized Primer Sequence
ctggaggattcggttcaaaa

SEQ ID NO: 10455 - DNA, 20 bp, Artificial Sequence
  Artificially Synthesized Primer Sequence
gaaagaggcatggaccaaaa

SEQ ID NO: 10456 - DNA, 20 bp, Artificial Sequence
  Artificially Synthesized Primer Sequence
atggacgacatggtagggag

SEQ ID NO: 10457 - DNA, 20 bp, Artificial Sequence
  Artificially Synthesized Primer Sequence
cgctggatctgattaggctc

SEQ ID NO: 10458 - DNA, 20 bp, Artificial Sequence
  Artificially Synthesized Primer Sequence
aaccctacggtccaacagtg

SEQ ID NO: 10459 - DNA, 20 bp, Artificial Sequence
  Artificially Synthesized Primer Sequence
aaccctacggtccaacagtg

SEQ ID NO: 10460 - DNA, 20 bp, Artificial Sequence
  Artificially Synthesized Primer Sequence
cgctggatctgattaggctc

SEQ ID NO: 10461 - DNA, 20 bp, Artificial Sequence
  Artificially Synthesized Primer Sequence
tcggtttaccaaggagaacg

SEQ ID NO: 10462 - DNA, 20 bp, Artificial Sequence
  Artificially Synthesized Primer Sequence
gtgatgatctccccgatgat

SEQ ID NO: 10463 - DNA, 20 bp, Artificial Sequence
  Artificially Synthesized Primer Sequence
gatctagtcgtcgtcctcgc

SEQ ID NO: 10464 - DNA, 20 bp, Artificial Sequence
  Artificially Synthesized Primer Sequence
cccctcctcctcttcttcat

SEQ ID NO: 10465 - DNA, 20 bp, Artificial Sequence
  Artificially Synthesized Primer Sequence
cactggaaatggtgtcaacg

SEQ ID NO: 10466 - DNA, 20 bp, Artificial Sequence
  Artificially Synthesized Primer Sequence
ggtacagaaatatgcgccgt

SEQ ID NO: 10467 - DNA, 20 bp, Artificial Sequence
  Artificially Synthesized Primer Sequence
gatctctcgtggatgtcggt

SEQ ID NO: 10468 - DNA, 20 bp, Artificial Sequence
  Artificially Synthesized Primer Sequence
tcacgcttgacccttctctt

SEQ ID NO: 10469 - DNA, 20 bp, Artificial Sequence
  Artificially Synthesized Primer Sequence
ttcatctggttcagcgtcag

SEQ ID NO: 10470 - DNA, 20 bp, Artificial Sequence
  Artificially Synthesized Primer Sequence
caccccagaacctcactgtt

SEQ ID NO: 10471 - DNA, 20 bp, Artificial Sequence
  Artificially Synthesized Primer Sequence
ccgctagtgtggctgaattt

SEQ ID NO: 10472 - DNA, 20 bp, Artificial Sequence
  Artificially Synthesized Primer Sequence
caaaagcttggtgaaggagc

SEQ ID NO: 10473 - DNA, 20 bp, Artificial Sequence
  Artificially Synthesized Primer Sequence
ttttaagctggcaggcaagt

SEQ ID NO: 10474 - DNA, 20 bp, Artificial Sequence
  Artificially Synthesized Primer Sequence
acttggcaaataaatccccc

SEQ ID NO: 10475 - DNA, 20 bp, Artificial Sequence
  Artificially Synthesized Primer Sequence
aaagggagattggacgactg

SEQ ID NO: 10476 - DNA, 20 bp, Artificial Sequence
  Artificially Synthesized Primer Sequence
ttttggcgaccagttcttct

SEQ ID NO: 10477 - DNA, 20 bp, Artificial Sequence
  Artificially Synthesized Primer Sequence
gatctccgagactgacctgc

SEQ ID NO: 10478 - DNA, 20 bp, Artificial Sequence
  Artificially Synthesized Primer Sequence
tgcttgtattgcactctgcc

SEQ ID NO: 10479 - DNA, 20 bp, Artificial Sequence
  Artificially Synthesized Primer Sequence
tgttctgcatctgggagaaa

SEQ ID NO: 10480 - DNA, 20 bp, Artificial Sequence
  Artificially Synthesized Primer Sequence
gggcagaaactggaagtgaa

SEQ ID NO: 10481 - DNA, 20 bp, Artificial Sequence
  Artificially Synthesized Primer Sequence
acctgaacgaccttaccgtg

SEQ ID NO: 10482 - DNA, 20 bp, Artificial Sequence
  Artificially Synthesized Primer Sequence
aaaacccgaataaaccccac

SEQ ID NO: 10483 - DNA, 20 bp, Artificial Sequence
  Artificially Synthesized Primer Sequence
tgttttctcagggtgcacag

SEQ ID NO: 10484 - DNA, 20 bp, Artificial Sequence
  Artificially Synthesized Primer Sequence
cgaagactggatcgaagagg

SEQ ID NO: 10485 - DNA, 20 bp, Artificial Sequence
  Artificially Synthesized Primer Sequence
gtccctgacgtcaaccagat

SEQ ID NO: 10486 - DNA, 20 bp, Artificial Sequence
  Artificially Synthesized Primer Sequence
atctcgttcttggagccgta

SEQ ID NO: 10487 - DNA, 20 bp, Artificial Sequence
  Artificially Synthesized Primer Sequence
atctcgttcttggagccgta

SEQ ID NO: 10488 - DNA, 20 bp, Artificial Sequence
  Artificially Synthesized Primer Sequence
accacaagcattggagaagg

SEQ ID NO: 10489 - DNA, 20 bp, Artificial Sequence
  Artificially Synthesized Primer Sequence
ctgttcttttgtttgccggt

SEQ ID NO: 10490 - DNA, 20 bp, Artificial Sequence
  Artificially Synthesized Primer Sequence
aaagcgaacaagaacgaagg

SEQ ID NO: 10491 - DNA, 20 bp, Artificial Sequence
  Artificially Synthesized Primer Sequence
accaataatcacggcaggag

SEQ ID NO: 10492 - DNA, 20 bp, Artificial Sequence
  Artificially Synthesized Primer Sequence
aggaacctggtgtcagttgg

SEQ ID NO: 10493 - DNA, 20 bp, Artificial Sequence
  Artificially Synthesized Primer Sequence
attcataggtggtgccgaag

SEQ ID NO: 10494 - DNA, 20 bp, Artificial Sequence
  Artificially Synthesized Primer Sequence
tcccacaaaaagccgtaaac

SEQ ID NO: 10495 - DNA, 20 bp, Artificial Sequence
  Artificially Synthesized Primer Sequence
aagtctttcagtggcggaga

SEQ ID NO: 10496 - DNA, 20 bp, Artificial Sequence
  Artificially Synthesized Primer Sequence
ggttctggcgatgctattgt

SEQ ID NO: 10497 - DNA, 20 bp, Artificial Sequence
  Artificially Synthesized Primer Sequence
atgcaagaaccatctgggag

SEQ ID NO: 10498 - DNA, 20 bp, Artificial Sequence
  Artificially Synthesized Primer Sequence
gcgcttcacattccaacttt

SEQ ID NO: 10499 - DNA, 20 bp, Artificial Sequence
  Artificially Synthesized Primer Sequence
gcgcttcacattccaacttt

SEQ ID NO: 10500 - DNA, 20 bp, Artificial Sequence
  Artificially Synthesized Primer Sequence
atgcaagaaccatctgggag

SEQ ID NO: 10501 - DNA, 20 bp, Artificial Sequence
  Artificially Synthesized Primer Sequence
gtccctgacgtcaaccagat

SEQ ID NO: 10502 - DNA, 20 bp, Artificial Sequence
  Artificially Synthesized Primer Sequence
cgctgtattaccagttcgca

SEQ ID NO: 10503 - DNA, 20 bp, Artificial Sequence
  Artificially Synthesized Primer Sequence
accagttcgcatcatcacaa

SEQ ID NO: 10504 - DNA, 20 bp, Artificial Sequence
  Artificially Synthesized Primer Sequence
gtccctgacgtcaaccagat

SEQ ID NO: 10505 - DNA, 20 bp, Artificial Sequence
  Artificially Synthesized Primer Sequence
tatggatgtggaatcgctga

SEQ ID NO: 10506 - DNA, 20 bp, Artificial Sequence
  Artificially Synthesized Primer Sequence
tcatctgcacgttctggaag

SEQ ID NO: 10507 - DNA, 21 bp, Artificial Sequence
  Artificially Synthesized Primer Sequence
tcccaagttgtcaatctcctg

SEQ ID NO: 10508 - DNA, 20 bp, Artificial Sequence
  Artificially Synthesized Primer Sequence
tcatgctttccttgcatctg

SEQ ID NO: 10509 - DNA, 20 bp, Artificial Sequence
  Artificially Synthesized Primer Sequence
gcaatcggagatgaggtgat

SEQ ID NO: 10510 - DNA, 20 bp, Artificial Sequence
  Artificially Synthesized Primer Sequence
tcgacattcactcttgcgtc

SEQ ID NO: 10511 - DNA, 20 bp, Artificial Sequence
  Artificially Synthesized Primer Sequence
agcgacaacggcaacttatt

SEQ ID NO: 10512 - DNA, 20 bp, Artificial Sequence
  Artificially Synthesized Primer Sequence
ggtacatatgggtgcaaggc

SEQ ID NO: 10513 - DNA, 20 bp, Artificial Sequence
  Artificially Synthesized Primer Sequence
aatgcagttttcaaatgggc

SEQ ID NO: 10514 - DNA, 20 bp, Artificial Sequence
  Artificially Synthesized Primer Sequence
tcaacatagcgacaggcaag

SEQ ID NO: 10515 - DNA, 20 bp, Artificial Sequence
  Artificially Synthesized Primer Sequence
tcagcgatgaatatttcccc

SEQ ID NO: 10516 - DNA, 20 bp, Artificial Sequence
  Artificially Synthesized Primer Sequence
ctgtttcggtcgctacaaga

SEQ ID NO: 10517 - DNA, 20 bp, Artificial Sequence
  Artificially Synthesized Primer Sequence
tttctaaatggccaacctgg

SEQ ID NO: 10518 - DNA, 20 bp, Artificial Sequence
  Artificially Synthesized Primer Sequence
gtggagcgatctcctgaaag

SEQ ID NO: 10519 - DNA, 20 bp, Artificial Sequence
  Artificially Synthesized Primer Sequence
actaccattgccagtttgcc

SEQ ID NO: 10520 - DNA, 20 bp, Artificial Sequence
  Artificially Synthesized Primer Sequence
cgtgttgattttgatggcac

SEQ ID NO: 10521 - DNA, 20 bp, Artificial Sequence
  Artificially Synthesized Primer Sequence
cgtgtcgaggcatcagtcta

SEQ ID NO: 10522 - DNA, 20 bp, Artificial Sequence
  Artificially Synthesized Primer Sequence
cagctcgtcgatgttgagaa

SEQ ID NO: 10523 - DNA, 20 bp, Artificial Sequence
  Artificially Synthesized Primer Sequence
gaggcaagcagcaatacaca

SEQ ID NO: 10524 - DNA, 20 bp, Artificial Sequence
  Artificially Synthesized Primer Sequence
tttgtgacggcttacaccac

SEQ ID NO: 10525 - DNA, 20 bp, Artificial Sequence
  Artificially Synthesized Primer Sequence
tgaggggtctgatttcatcc

SEQ ID NO: 10526 - DNA, 20 bp, Artificial Sequence
  Artificially Synthesized Primer Sequence
gccaggggtatttcagcata

SEQ ID NO: 10527 - DNA, 20 bp, Artificial Sequence
  Artificially Synthesized Primer Sequence
catgacggatggcctatctt

SEQ ID NO: 10528 - DNA, 20 bp, Artificial Sequence
  Artificially Synthesized Primer Sequence
gatgcggttatgagggctaa

SEQ ID NO: 10529 - DNA, 20 bp, Artificial Sequence
  Artificially Synthesized Primer Sequence
gctgttactgctgcatccaa

SEQ ID NO: 10530 - DNA, 20 bp, Artificial Sequence
  Artificially Synthesized Primer Sequence
tcagggtcatcctagcaacc

SEQ ID NO: 10531 - DNA, 20 bp, Artificial Sequence
  Artificially Synthesized Primer Sequence
cacaactcccttgtctccgt

SEQ ID NO: 10532 - DNA, 20 bp, Artificial Sequence
  Artificially Synthesized Primer Sequence
ggacctgttgcacatgacac

SEQ ID NO: 10533 - DNA, 20 bp, Artificial Sequence
  Artificially Synthesized Primer Sequence
aagaggcagaccttcgacaa

SEQ ID NO: 10534 - DNA, 20 bp, Artificial Sequence
  Artificially Synthesized Primer Sequence
gtgagggggagaactaagcc

SEQ ID NO: 10535 - DNA, 20 bp, Artificial Sequence
  Artificially Synthesized Primer Sequence
aagaaccttttgcgttggtg

SEQ ID NO: 10536 - DNA, 20 bp, Artificial Sequence
  Artificially Synthesized Primer Sequence
aagaggcagaccttcgacaa

SEQ ID NO: 10537 - DNA, 20 bp, Artificial Sequence
  Artificially Synthesized Primer Sequence
aatacgtgtgctgccatcaa

SEQ ID NO: 10538 - DNA, 20 bp, Artificial Sequence
  Artificially Synthesized Primer Sequence
atagggcgaaaagagggaaa

SEQ ID NO: 10539 - DNA, 20 bp, Artificial Sequence
  Artificially Synthesized Primer Sequence
tagcctggcagctttctgtt

SEQ ID NO: 10540 - DNA, 19 bp, Artificial Sequence
  Artificially Synthesized Primer Sequence
ctacttcccccgtttcgac

SEQ ID NO: 10541 - DNA, 20 bp, Artificial Sequence
  Artificially Synthesized Primer Sequence
tttgaagaggcgagcagatt

SEQ ID NO: 10542 - DNA, 20 bp, Artificial Sequence
  Artificially Synthesized Primer Sequence
ctctagagcatgtctccccg

SEQ ID NO: 10543 - DNA, 20 bp, Artificial Sequence
  Artificially Synthesized Primer Sequence
gactgaccatgcaagaagca

SEQ ID NO: 10544 - DNA, 20 bp, Artificial Sequence
  Artificially Synthesized Primer Sequence
ggccagagacctacaagcag

SEQ ID NO: 10545 - DNA, 20 bp, Artificial Sequence
  Artificially Synthesized Primer Sequence
aattcctcgagcactgttgg

SEQ ID NO: 10546 - DNA, 20 bp, Artificial Sequence
  Artificially Synthesized Primer Sequence
aggtctctcgctgagcattc

SEQ ID NO: 10547 - DNA, 20 bp, Artificial Sequence
  Artificially Synthesized Primer Sequence
ttatacacacgggacagcga

SEQ ID NO: 10548 - DNA, 20 bp, Artificial Sequence
  Artificially Synthesized Primer Sequence
gagcgagtttacccacctga

SEQ ID NO: 10549 - DNA, 20 bp, Artificial Sequence
  Artificially Synthesized Primer Sequence
ctcaggttagcaggagaccg

SEQ ID NO: 10550 - DNA, 20 bp, Artificial Sequence
  Artificially Synthesized Primer Sequence
ccaccaccagacctcatctt

SEQ ID NO: 10551 - DNA, 20 bp, Artificial Sequence
  Artificially Synthesized Primer Sequence
tcgccaacatgcaaaatcta

SEQ ID NO: 10552 - DNA, 20 bp, Artificial Sequence
  Artificially Synthesized Primer Sequence
tcaaggttagcaggagaccg

SEQ ID NO: 10553 - DNA, 20 bp, Artificial Sequence
  Artificially Synthesized Primer Sequence
ttcgtccaaccaattaagcc

SEQ ID NO: 10554 - DNA, 20 bp, Artificial Sequence
  Artificially Synthesized Primer Sequence
tcgtcgacacacagaacaca

SEQ ID NO: 10555 - DNA, 20 bp, Artificial Sequence
  Artificially Synthesized Primer Sequence
agaaacaggcccacgatatg

SEQ ID NO: 10556 - DNA, 20 bp, Artificial Sequence
  Artificially Synthesized Primer Sequence
gccaagcttgaggcatactt

SEQ ID NO: 10557 - DNA, 20 bp, Artificial Sequence
  Artificially Synthesized Primer Sequence
tgtattcctgtttgtggcga

SEQ ID NO: 10558 - DNA, 20 bp, Artificial Sequence
  Artificially Synthesized Primer Sequence
aatgaaggaacgccaatgag

SEQ ID NO: 10559 - DNA, 20 bp, Artificial Sequence
  Artificially Synthesized Primer Sequence
gttggcatgacaaaaacacg

SEQ ID NO: 10560 - DNA, 20 bp, Artificial Sequence
  Artificially Synthesized Primer Sequence
cgtgtacgtagctcctgtcg

SEQ ID NO: 10561 - DNA, 20 bp, Artificial Sequence
  Artificially Synthesized Primer Sequence
ctccacatcacggtcctctt

SEQ ID NO: 10562 - DNA, 20 bp, Artificial Sequence
  Artificially Synthesized Primer Sequence
tatcatgaaccctgtctgcg

SEQ ID NO: 10563 - DNA, 20 bp, Artificial Sequence
  Artificially Synthesized Primer Sequence
ctccacatcacggtcctctt

SEQ ID NO: 10564 - DNA, 20 bp, Artificial Sequence
  Artificially Synthesized Primer Sequence
agcagcatgagctggaagtc

SEQ ID NO: 10565 - DNA, 20 bp, Artificial Sequence
  Artificially Synthesized Primer Sequence
aaaacaaagacccccattcc

SEQ ID NO: 10566 - DNA, 20 bp, Artificial Sequence
  Artificially Synthesized Primer Sequence
aggcctttttccaaggtcat

SEQ ID NO: 10567 - DNA, 20 bp, Artificial Sequence
  Artificially Synthesized Primer Sequence
agacacccaatcccaaagtg

SEQ ID NO: 10568 - DNA, 20 bp, Artificial Sequence
  Artificially Synthesized Primer Sequence
atcaggccttcttccaaggt

SEQ ID NO: 10569 - DNA, 20 bp, Artificial Sequence
  Artificially Synthesized Primer Sequence
ttggctttggtaattcctgg

SEQ ID NO: 10570 - DNA, 20 bp, Artificial Sequence
  Artificially Synthesized Primer Sequence
aattttggagagcagcctca

SEQ ID NO: 10571 - DNA, 20 bp, Artificial Sequence
  Artificially Synthesized Primer Sequence
gtgggcatgaagaacgctac

SEQ ID NO: 10572 - DNA, 20 bp, Artificial Sequence
  Artificially Synthesized Primer Sequence
cgaagtggttccatggagtt

SEQ ID NO: 10573 - DNA, 20 bp, Artificial Sequence
  Artificially Synthesized Primer Sequence
tcagcccagtctgaggagat

SEQ ID NO: 10574 - DNA, 20 bp, Artificial Sequence
  Artificially Synthesized Primer Sequence
tccttcagtgggagcagtct

SEQ ID NO: 10575 - DNA, 20 bp, Artificial Sequence
  Artificially Synthesized Primer Sequence
tacactgaaaaccaagcgca

SEQ ID NO: 10576 - DNA, 20 bp, Artificial Sequence
  Artificially Synthesized Primer Sequence
cggcagataagctgaaggaa

SEQ ID NO: 10577 - DNA, 20 bp, Artificial Sequence
  Artificially Synthesized Primer Sequence
acaaccctactccttcgggt

SEQ ID NO: 10578 - DNA, 20 bp, Artificial Sequence
  Artificially Synthesized Primer Sequence
accaacctgtccaatgcttc

SEQ ID NO: 10579 - DNA, 20 bp, Artificial Sequence
  Artificially Synthesized Primer Sequence
ccagcatgcatagactggaa

SEQ ID NO: 10580 - DNA, 20 bp, Artificial Sequence
  Artificially Synthesized Primer Sequence
aggcctcgaaaggatagagc

SEQ ID NO: 10581 - DNA, 20 bp, Artificial Sequence
  Artificially Synthesized Primer Sequence
tacagtattcgcgctgaacg

SEQ ID NO: 10582 - DNA, 20 bp, Artificial Sequence
  Artificially Synthesized Primer Sequence
cataagccggagaagcaaag

SEQ ID NO: 10583 - DNA, 20 bp, Artificial Sequence
  Artificially Synthesized Primer Sequence
caacttgtgttgccgaattg

SEQ ID NO: 10584 - DNA, 20 bp, Artificial Sequence
  Artificially Synthesized Primer Sequence
caggtgagcagacatagcca

SEQ ID NO: 10585 - DNA, 20 bp, Artificial Sequence
  Artificially Synthesized Primer Sequence
tcaccagcttcagcaacatc

SEQ ID NO: 10586 - DNA, 20 bp, Artificial Sequence
  Artificially Synthesized Primer Sequence
tggagactacttgacgtgcg

SEQ ID NO: 10587 - DNA, 20 bp, Artificial Sequence
  Artificially Synthesized Primer Sequence
tggagactacttgacgtgcg

SEQ ID NO: 10588 - DNA, 21 bp, Artificial Sequence
  Artificially Synthesized Primer Sequence
ctcacagtttggctcgtctct

SEQ ID NO: 10589 - DNA, 20 bp, Artificial Sequence
  Artificially Synthesized Primer Sequence
gttcatcaggcgaagaggag

SEQ ID NO: 10590 - DNA, 20 bp, Artificial Sequence
  Artificially Synthesized Primer Sequence
agatgtcggaatttatgcgg

SEQ ID NO: 10591 - DNA, 20 bp, Artificial Sequence
  Artificially Synthesized Primer Sequence
gctatactggggtctgccaa

SEQ ID NO: 10592 - DNA, 20 bp, Artificial Sequence
  Artificially Synthesized Primer Sequence
ctatgtgcgcaagatgagga

SEQ ID NO: 10593 - DNA, 20 bp, Artificial Sequence
  Artificially Synthesized Primer Sequence
ggagaagagccatgcttcac

SEQ ID NO: 10594 - DNA, 20 bp, Artificial Sequence
  Artificially Synthesized Primer Sequence
gccatgacgttctcctcaat

SEQ ID NO: 10595 - DNA, 20 bp, Artificial Sequence
  Artificially Synthesized Primer Sequence
ccagggatccatcaaacact

SEQ ID NO: 10596 - DNA, 20 bp, Artificial Sequence
  Artificially Synthesized Primer Sequence
atgccatgtgcatcaactgt

SEQ ID NO: 10597 - DNA, 20 bp, Artificial Sequence
  Artificially Synthesized Primer Sequence
ctaggagttgccacgaggag

SEQ ID NO: 10598 - DNA, 20 bp, Artificial Sequence
  Artificially Synthesized Primer Sequence
caaaactatcgcccatgctt

SEQ ID NO: 10599 - DNA, 20 bp, Artificial Sequence
  Artificially Synthesized Primer Sequence
agtagtggggagtcgggaac

SEQ ID NO: 10600 - DNA, 20 bp, Artificial Sequence
  Artificially Synthesized Primer Sequence
ggccaactcagaagctatgc

SEQ ID NO: 10601 - DNA, 20 bp, Artificial Sequence
  Artificially Synthesized Primer Sequence
ggactgccccaagatttaca

SEQ ID NO: 10602 - DNA, 20 bp, Artificial Sequence
  Artificially Synthesized Primer Sequence
tctcaagggtttccaaatgc

SEQ ID NO: 10603 - DNA, 20 bp, Artificial Sequence
  Artificially Synthesized Primer Sequence
tggcacaccatctctgaaaa

SEQ ID NO: 10604 - DNA, 20 bp, Artificial Sequence
  Artificially Synthesized Primer Sequence
tgccatgtgattgtgtgttg

SEQ ID NO: 10605 - DNA, 20 bp, Artificial Sequence
  Artificially Synthesized Primer Sequence
ggagcagtcagcacatttca

SEQ ID NO: 10606 - DNA, 20 bp, Artificial Sequence
  Artificially Synthesized Primer Sequence
ttgtcaatttcaccaacgga

SEQ ID NO: 10607 - DNA, 20 bp, Artificial Sequence
  Artificially Synthesized Primer Sequence
ctaccaaggccagctctcac

SEQ ID NO: 10608 - DNA, 20 bp, Artificial Sequence
  Artificially Synthesized Primer Sequence
gttctctgaggcaccaggac

SEQ ID NO: 10609 - DNA, 20 bp, Artificial Sequence
  Artificially Synthesized Primer Sequence
gagccacaagattcagctcc

SEQ ID NO: 10610 - DNA, 20 bp, Artificial Sequence
  Artificially Synthesized Primer Sequence
aattttcattcgctgcatcc

SEQ ID NO: 10611 - DNA, 20 bp, Artificial Sequence
  Artificially Synthesized Primer Sequence
ttggcttgcatatcatcagc

SEQ ID NO: 10612 - DNA, 20 bp, Artificial Sequence
  Artificially Synthesized Primer Sequence
ttttggggttgttctcttgg

SEQ ID NO: 10613 - DNA, 20 bp, Artificial Sequence
  Artificially Synthesized Primer Sequence
gcactgttggcctattggat

SEQ ID NO: 10614 - DNA, 20 bp, Artificial Sequence
  Artificially Synthesized Primer Sequence
cgtctagcttgtcctcgacc

SEQ ID NO: 10615 - DNA, 20 bp, Artificial Sequence
  Artificially Synthesized Primer Sequence
agcaacgacaaacatttcca

SEQ ID NO: 10616 - DNA, 20 bp, Artificial Sequence
  Artificially Synthesized Primer Sequence
gatttgatcagctgggtggt

SEQ ID NO: 10617 - DNA, 20 bp, Artificial Sequence
  Artificially Synthesized Primer Sequence
gattggtggttcctgcaagt

SEQ ID NO: 10618 - DNA, 20 bp, Artificial Sequence
  Artificially Synthesized Primer Sequence
aggatgaactttgtgacccg

SEQ ID NO: 10619 - DNA, 20 bp, Artificial Sequence
  Artificially Synthesized Primer Sequence
tcatcaatggtgtgctgtca

SEQ ID NO: 10620 - DNA, 20 bp, Artificial Sequence
  Artificially Synthesized Primer Sequence
tcaatgtgatcctggagctg

SEQ ID NO: 10621 - DNA, 20 bp, Artificial Sequence
  Artificially Synthesized Primer Sequence
atcaaaggacgttggcaatc

SEQ ID NO: 10622 - DNA, 20 bp, Artificial Sequence
  Artificially Synthesized Primer Sequence
caaggttacaatggtgtgcg

SEQ ID NO: 10623 - DNA, 20 bp, Artificial Sequence
  Artificially Synthesized Primer Sequence
caaggttacaatggtgtgcg

SEQ ID NO: 10624 - DNA, 20 bp, Artificial Sequence
  Artificially Synthesized Primer Sequence
gatcaaaggacgttggcaat

SEQ ID NO: 10625 - DNA, 20 bp, Artificial Sequence
  Artificially Synthesized Primer Sequence
tgaaagaagtcgtggtggtg

SEQ ID NO: 10626 - DNA, 20 bp, Artificial Sequence
  Artificially Synthesized Primer Sequence
ccgcagcatcttctaagacc

SEQ ID NO: 10627 - DNA, 20 bp, Artificial Sequence
  Artificially Synthesized Primer Sequence
tgaaagaagtcgtggtggtg

SEQ ID NO: 10628 - DNA, 20 bp, Artificial Sequence
  Artificially Synthesized Primer Sequence
acgacgaaagaatcgctgtt

SEQ ID NO: 10629 - DNA, 20 bp, Artificial Sequence
  Artificially Synthesized Primer Sequence
ttttgactggcatcaactcg

SEQ ID NO: 10630 - DNA, 20 bp, Artificial Sequence
  Artificially Synthesized Primer Sequence
aaaaaggcaagcaggggtat

SEQ ID NO: 10631 - DNA, 20 bp, Artificial Sequence
  Artificially Synthesized Primer Sequence
aaaaaggcaagcaggggtat

SEQ ID NO: 10632 - DNA, 20 bp, Artificial Sequence
  Artificially Synthesized Primer Sequence
ttttgactggcatcaactcg

SEQ ID NO: 10633 - DNA, 20 bp, Artificial Sequence
  Artificially Synthesized Primer Sequence
tttctctcttgcgcacacac

SEQ ID NO: 10634 - DNA, 20 bp, Artificial Sequence
  Artificially Synthesized Primer Sequence
agaaatgtggggcagaacac

SEQ ID NO: 10635 - DNA, 20 bp, Artificial Sequence
  Artificially Synthesized Primer Sequence
aggcacaggctcttttgcta

SEQ ID NO: 10636 - DNA, 20 bp, Artificial Sequence
  Artificially Synthesized Primer Sequence
gagccttgctactgaatggg

SEQ ID NO: 10637 - DNA, 20 bp, Artificial Sequence
  Artificially Synthesized Primer Sequence
gctactcctggcaaagttcg

SEQ ID NO: 10638 - DNA, 20 bp, Artificial Sequence
  Artificially Synthesized Primer Sequence
ttctttcggccttgagaaaa

SEQ ID NO: 10639 - DNA, 20 bp, Artificial Sequence
  Artificially Synthesized Primer Sequence
acacggtccatggaagaaac

SEQ ID NO: 10640 - DNA, 20 bp, Artificial Sequence
  Artificially Synthesized Primer Sequence
catagatgggcccttgaaga

SEQ ID NO: 10641 - DNA, 20 bp, Artificial Sequence
  Artificially Synthesized Primer Sequence
tctggaaatcttcattgggc

SEQ ID NO: 10642 - DNA, 20 bp, Artificial Sequence
  Artificially Synthesized Primer Sequence
tgacataatcgacggatgga

SEQ ID NO: 10643 - DNA, 20 bp, Artificial Sequence
  Artificially Synthesized Primer Sequence
agatgtacatgcacgcaagc

SEQ ID NO: 10644 - DNA, 20 bp, Artificial Sequence
  Artificially Synthesized Primer Sequence
cattcttccatccgtcgatt

SEQ ID NO: 10645 - DNA, 20 bp, Artificial Sequence
  Artificially Synthesized Primer Sequence
atggaaagggagctggagat

SEQ ID NO: 10646 - DNA, 20 bp, Artificial Sequence
  Artificially Synthesized Primer Sequence
tgctaaatggaaaagacggg

SEQ ID NO: 10647 - DNA, 20 bp, Artificial Sequence
  Artificially Synthesized Primer Sequence
atttattggaggcgtcaagc

SEQ ID NO: 10648 - DNA, 20 bp, Artificial Sequence
  Artificially Synthesized Primer Sequence
gtcgccaaaaccatcaaatc

SEQ ID NO: 10649 - DNA, 20 bp, Artificial Sequence
  Artificially Synthesized Primer Sequence
gaccagcgaatggaatcagt

SEQ ID NO: 10650 - DNA, 20 bp, Artificial Sequence
  Artificially Synthesized Primer Sequence
taatttggacagcgtccctc

SEQ ID NO: 10651 - DNA, 20 bp, Artificial Sequence
  Artificially Synthesized Primer Sequence
agcgaacagatgagcattca

SEQ ID NO: 10652 - DNA, 20 bp, Artificial Sequence
  Artificially Synthesized Primer Sequence
gagggacgctgtccaaatta

SEQ ID NO: 10653 - DNA, 20 bp, Artificial Sequence
  Artificially Synthesized Primer Sequence
gggttcctctcctctccatc

SEQ ID NO: 10654 - DNA, 20 bp, Artificial Sequence
  Artificially Synthesized Primer Sequence
gcctcttttgagatgccaag

SEQ ID NO: 10655 - DNA, 20 bp, Artificial Sequence
  Artificially Synthesized Primer Sequence
ctacgcgcacccatatacct

SEQ ID NO: 10656 - DNA, 20 bp, Artificial Sequence
  Artificially Synthesized Primer Sequence
tgaatacaagtggtgccctg

SEQ ID NO: 10657 - DNA, 20 bp, Artificial Sequence
  Artificially Synthesized Primer Sequence
tgcaagatgaatgcaagtcc

SEQ ID NO: 10658 - DNA, 20 bp, Artificial Sequence
  Artificially Synthesized Primer Sequence
tttaaaagcggagacgcagt

SEQ ID NO: 10659 - DNA, 20 bp, Artificial Sequence
  Artificially Synthesized Primer Sequence
tcagcagtctgcattgacct

SEQ ID NO: 10660 - DNA, 19 bp, Artificial Sequence
  Artificially Synthesized Primer Sequence
gcctcggggtcaagattta

SEQ ID NO: 10661 - DNA, 20 bp, Artificial Sequence
  Artificially Synthesized Primer Sequence
agacccattagtttcccgct

SEQ ID NO: 10662 - DNA, 20 bp, Artificial Sequence
  Artificially Synthesized Primer Sequence
ccaacagccagaaattggtt

SEQ ID NO: 10663 - DNA, 20 bp, Artificial Sequence
  Artificially Synthesized Primer Sequence
actcccatggcaaacagaag

SEQ ID NO: 10664 - DNA, 20 bp, Artificial Sequence
  Artificially Synthesized Primer Sequence
gagctccattggtttcttcg

SEQ ID NO: 10665 - DNA, 20 bp, Artificial Sequence
  Artificially Synthesized Primer Sequence
cccttcctcgtctagtgcag

SEQ ID NO: 10666 - DNA, 20 bp, Artificial Sequence
  Artificially Synthesized Primer Sequence
aacagggtggatcaggtcag

SEQ ID NO: 10667 - DNA, 20 bp, Artificial Sequence
  Artificially Synthesized Primer Sequence
gtccatatccctgctaacgc

SEQ ID NO: 10668 - DNA, 20 bp, Artificial Sequence
  Artificially Synthesized Primer Sequence
atacctgcaaccaacaggct

SEQ ID NO: 10669 - DNA, 20 bp, Artificial Sequence
  Artificially Synthesized Primer Sequence
aattcctcgagcactgttgg

SEQ ID NO: 10670 - DNA, 20 bp, Artificial Sequence
  Artificially Synthesized Primer Sequence
ccgtagatcacgctgtggta

SEQ ID NO: 10671 - DNA, 20 bp, Artificial Sequence
  Artificially Synthesized Primer Sequence
aggaagcaaagactggagca

SEQ ID NO: 10672 - DNA, 20 bp, Artificial Sequence
  Artificially Synthesized Primer Sequence
gaggaactggcacaccagag

SEQ ID NO: 10673 - DNA, 20 bp, Artificial Sequence
  Artificially Synthesized Primer Sequence
tcattccaagccctagatgg

SEQ ID NO: 10674 - DNA, 20 bp, Artificial Sequence
  Artificially Synthesized Primer Sequence
gacccattgggctcaagata

SEQ ID NO: 10675 - DNA, 20 bp, Artificial Sequence
  Artificially Synthesized Primer Sequence
tacagaacttgattccgggg

SEQ ID NO: 10676 - DNA, 20 bp, Artificial Sequence
  Artificially Synthesized Primer Sequence
catctgcaagtttggcgtaa

SEQ ID NO: 10677 - DNA, 20 bp, Artificial Sequence
  Artificially Synthesized Primer Sequence
cacgtggtcttggtatggtg

SEQ ID NO: 10678 - DNA, 20 bp, Artificial Sequence
  Artificially Synthesized Primer Sequence
cacagtgctccatggtctgt

SEQ ID NO: 10679 - DNA, 20 bp, Artificial Sequence
  Artificially Synthesized Primer Sequence
aacggttaccaccataccca

SEQ ID NO: 10680 - DNA, 20 bp, Artificial Sequence
  Artificially Synthesized Primer Sequence
ccttcacgttcttcacccat

SEQ ID NO: 10681 - DNA, 20 bp, Artificial Sequence
  Artificially Synthesized Primer Sequence
atttgactggctttgccaac

SEQ ID NO: 10682 - DNA, 20 bp, Artificial Sequence
  Artificially Synthesized Primer Sequence
ccaaatcacgaacaggatca

SEQ ID NO: 10683 - DNA, 20 bp, Artificial Sequence
  Artificially Synthesized Primer Sequence
tacacttggcagttgggaca

SEQ ID NO: 10684 - DNA, 20 bp, Artificial Sequence
  Artificially Synthesized Primer Sequence
tggcagatcagacgtcaaag

SEQ ID NO: 10685 - DNA, 20 bp, Artificial Sequence
  Artificially Synthesized Primer Sequence
atgtgaccgacgatgacaaa

SEQ ID NO: 10686 - DNA, 20 bp, Artificial Sequence
  Artificially Synthesized Primer Sequence
agaaatcggggttgacactg

SEQ ID NO: 10687 - DNA, 20 bp, Artificial Sequence
  Artificially Synthesized Primer Sequence
tgcatacgttacacccttcg

SEQ ID NO: 10688 - DNA, 20 bp, Artificial Sequence
  Artificially Synthesized Primer Sequence
atgtgaccgacgatgacaaa

SEQ ID NO: 10689 - DNA, 20 bp, Artificial Sequence
  Artificially Synthesized Primer Sequence
gggaagatgacggagaatca

SEQ ID NO: 10690 - DNA, 20 bp, Artificial Sequence
  Artificially Synthesized Primer Sequence
tcattgaggagtgcaacagc

SEQ ID NO: 10691 - DNA, 20 bp, Artificial Sequence
  Artificially Synthesized Primer Sequence
ggccagcagattgcttagac

SEQ ID NO: 10692 - DNA, 20 bp, Artificial Sequence
  Artificially Synthesized Primer Sequence
actacgggcaacaaaactgg

SEQ ID NO: 10693 - DNA, 20 bp, Artificial Sequence
  Artificially Synthesized Primer Sequence
gtggtcggagatcctttcaa

SEQ ID NO: 10694 - DNA, 20 bp, Artificial Sequence
  Artificially Synthesized Primer Sequence
catggtgtcgatgttcttgg

SEQ ID NO: 10695 - DNA, 20 bp, Artificial Sequence
  Artificially Synthesized Primer Sequence
tgtgcaggtacttgtcgagg

SEQ ID NO: 10696 - DNA, 20 bp, Artificial Sequence
  Artificially Synthesized Primer Sequence
tggtcggagatcctttcaac

SEQ ID NO: 10697 - DNA, 20 bp, Artificial Sequence
  Artificially Synthesized Primer Sequence
ccttcagctgggtgtatggt

SEQ ID NO: 10698 - DNA, 20 bp, Artificial Sequence
  Artificially Synthesized Primer Sequence
tggagctccgcattattacc

SEQ ID NO: 10699 - DNA, 20 bp, Artificial Sequence
  Artificially Synthesized Primer Sequence
caaaactcaagggatccgaa

SEQ ID NO: 10700 - DNA, 20 bp, Artificial Sequence
  Artificially Synthesized Primer Sequence
ccttcagctgggtgtatggt

SEQ ID NO: 10701 - DNA, 20 bp, Artificial Sequence
  Artificially Synthesized Primer Sequence
cgaccaagacgaggaagaag

SEQ ID NO: 10702 - DNA, 20 bp, Artificial Sequence
  Artificially Synthesized Primer Sequence
tggtaagtccttggattggc

SEQ ID NO: 10703 - DNA, 20 bp, Artificial Sequence
  Artificially Synthesized Primer Sequence
cacgcctagcaaatgtgaga

SEQ ID NO: 10704 - DNA, 20 bp, Artificial Sequence
  Artificially Synthesized Primer Sequence
cgcaagatgctcgaaataca

SEQ ID NO: 10705 - DNA, 20 bp, Artificial Sequence
  Artificially Synthesized Primer Sequence
tgatgtggttgcgaaatgat

SEQ ID NO: 10706 - DNA, 20 bp, Artificial Sequence
  Artificially Synthesized Primer Sequence
cacaagcatgatcttcccct

SEQ ID NO: 10707 - DNA, 20 bp, Artificial Sequence
  Artificially Synthesized Primer Sequence
tcaaccttaccggattcagc

SEQ ID NO: 10708 - DNA, 20 bp, Artificial Sequence
  Artificially Synthesized Primer Sequence
ctggaaggaggtggacagaa

SEQ ID NO: 10709 - DNA, 20 bp, Artificial Sequence
  Artificially Synthesized Primer Sequence
cttctgcccaggaggctaac

SEQ ID NO: 10710 - DNA, 20 bp, Artificial Sequence
  Artificially Synthesized Primer Sequence
acgtcatgatcaccgtcttg

SEQ ID NO: 10711 - DNA, 20 bp, Artificial Sequence
  Artificially Synthesized Primer Sequence
tcctctgcacaactgctcac

SEQ ID NO: 10712 - DNA, 19 bp, Artificial Sequence
  Artificially Synthesized Primer Sequence
tcctcgacacagtgcacaa

SEQ ID NO: 10713 - DNA, 20 bp, Artificial Sequence
  Artificially Synthesized Primer Sequence
ttgaggaaagtgacccaagg

SEQ ID NO: 10714 - DNA, 20 bp, Artificial Sequence
  Artificially Synthesized Primer Sequence
aagctgaaaatgctagccca

SEQ ID NO: 10715 - DNA, 20 bp, Artificial Sequence
  Artificially Synthesized Primer Sequence
aagctgaaaatgctagccca

SEQ ID NO: 10716 - DNA, 20 bp, Artificial Sequence
  Artificially Synthesized Primer Sequence
ttgaggaaagtgacccaagg

SEQ ID NO: 10717 - DNA, 20 bp, Artificial Sequence
  Artificially Synthesized Primer Sequence
ctgagggcaatcttctccag

SEQ ID NO: 10718 - DNA, 20 bp, Artificial Sequence
  Artificially Synthesized Primer Sequence
tagaagcttccatccatgcc

SEQ ID NO: 10719 - DNA, 20 bp, Artificial Sequence
  Artificially Synthesized Primer Sequence
actcctccatttaccgggtc

SEQ ID NO: 10720 - DNA, 20 bp, Artificial Sequence
  Artificially Synthesized Primer Sequence
gaggtgctgacagagcagaa

SEQ ID NO: 10721 - DNA, 20 bp, Artificial Sequence
  Artificially Synthesized Primer Sequence
tatggagtgtatgacggcca

SEQ ID NO: 10722 - DNA, 20 bp, Artificial Sequence
  Artificially Synthesized Primer Sequence
tctagccaatgtgaccacca

SEQ ID NO: 10723 - DNA, 20 bp, Artificial Sequence
  Artificially Synthesized Primer Sequence
tctagccaatgtgaccacca

SEQ ID NO: 10724 - DNA, 20 bp, Artificial Sequence
  Artificially Synthesized Primer Sequence
tatggagtgtatgacggcca

SEQ ID NO: 10725 - DNA, 20 bp, Artificial Sequence
  Artificially Synthesized Primer Sequence
ggacaagccgttcagagttc

SEQ ID NO: 10726 - DNA, 20 bp, Artificial Sequence
  Artificially Synthesized Primer Sequence
atctccagcttgattctggc

SEQ ID NO: 10727 - DNA, 20 bp, Artificial Sequence
  Artificially Synthesized Primer Sequence
gacactgctggttcctggat

SEQ ID NO: 10728 - DNA, 20 bp, Artificial Sequence
  Artificially Synthesized Primer Sequence
ggttgtgttaaggccgactg

SEQ ID NO: 10729 - DNA, 20 bp, Artificial Sequence
  Artificially Synthesized Primer Sequence
tttgaatgcatccttgcttg

SEQ ID NO: 10730 - DNA, 20 bp, Artificial Sequence
  Artificially Synthesized Primer Sequence
tttcaagtgttgtcagccca

SEQ ID NO: 10731 - DNA, 20 bp, Artificial Sequence
  Artificially Synthesized Primer Sequence
aatcggtgtggaccattgtt

SEQ ID NO: 10732 - DNA, 20 bp, Artificial Sequence
  Artificially Synthesized Primer Sequence
gacaccgatggacgaaacat

SEQ ID NO: 10733 - DNA, 20 bp, Artificial Sequence
  Artificially Synthesized Primer Sequence
gtccgagtttagttggctgc

SEQ ID NO: 10734 - DNA, 20 bp, Artificial Sequence
  Artificially Synthesized Primer Sequence
tcgagggagctattgcagtt

SEQ ID NO: 10735 - DNA, 20 bp, Artificial Sequence
  Artificially Synthesized Primer Sequence
tctcctgtgtgtccttcgtg

SEQ ID NO: 10736 - DNA, 20 bp, Artificial Sequence
  Artificially Synthesized Primer Sequence
ccagggaagtcacttggtgt

SEQ ID NO: 10737 - DNA, 20 bp, Artificial Sequence
  Artificially Synthesized Primer Sequence
gggaacaagcaagctcgtag

SEQ ID NO: 10738 - DNA, 20 bp, Artificial Sequence
  Artificially Synthesized Primer Sequence
caagaaacatgcttcagcca

SEQ ID NO: 10739 - DNA, 20 bp, Artificial Sequence
  Artificially Synthesized Primer Sequence
caagaaacatgcttcagcca

SEQ ID NO: 10740 - DNA, 20 bp, Artificial Sequence
  Artificially Synthesized Primer Sequence
acccgactcagaaagcttga

SEQ ID NO: 10741 - DNA, 20 bp, Artificial Sequence
  Artificially Synthesized Primer Sequence
ttttggcggtcctaaagatg

SEQ ID NO: 10742 - DNA, 20 bp, Artificial Sequence
  Artificially Synthesized Primer Sequence
cattcgcaagcgaagttaca

SEQ ID NO: 10743 - DNA, 20 bp, Artificial Sequence
  Artificially Synthesized Primer Sequence
cattcgcaagcgaagttaca

SEQ ID NO: 10744 - DNA, 20 bp, Artificial Sequence
  Artificially Synthesized Primer Sequence
ttttggcggtcctaaagatg

SEQ ID NO: 10745 - DNA, 20 bp, Artificial Sequence
  Artificially Synthesized Primer Sequence
ctgcgaactctgtggattga

SEQ ID NO: 10746 - DNA, 20 bp, Artificial Sequence
  Artificially Synthesized Primer Sequence
tgagtcgcagatacgtgagg

SEQ ID NO: 10747 - DNA, 20 bp, Artificial Sequence
  Artificially Synthesized Primer Sequence
agactcgcaaatgatggctt

SEQ ID NO: 10748 - DNA, 20 bp, Artificial Sequence
  Artificially Synthesized Primer Sequence
tgcagattcctttcctcacc

SEQ ID NO: 10749 - DNA, 20 bp, Artificial Sequence
  Artificially Synthesized Primer Sequence
tctaccatctcgatttcccg

SEQ ID NO: 10750 - DNA, 20 bp, Artificial Sequence
  Artificially Synthesized Primer Sequence
atgccaacaactcccttttg

SEQ ID NO: 10751 - DNA, 20 bp, Artificial Sequence
  Artificially Synthesized Primer Sequence
tcactgttgagcatgggttc

SEQ ID NO: 10752 - DNA, 20 bp, Artificial Sequence
  Artificially Synthesized Primer Sequence
ccagaaggattgcgatttgt

SEQ ID NO: 10753 - DNA, 20 bp, Artificial Sequence
  Artificially Synthesized Primer Sequence
cgtgagaaaatcatcgctca

SEQ ID NO: 10754 - DNA, 20 bp, Artificial Sequence
  Artificially Synthesized Primer Sequence
gcattcatcgcatgtactgg

SEQ ID NO: 10755 - DNA, 20 bp, Artificial Sequence
  Artificially Synthesized Primer Sequence
gcattcatcgcatgtactgg

SEQ ID NO: 10756 - DNA, 20 bp, Artificial Sequence
  Artificially Synthesized Primer Sequence
cgtgagaaaatcatcgctca

SEQ ID NO: 10757 - DNA, 20 bp, Artificial Sequence
  Artificially Synthesized Primer Sequence
tttctttccccctttccttc

SEQ ID NO: 10758 - DNA, 20 bp, Artificial Sequence
  Artificially Synthesized Primer Sequence
ttggtgtgaaggtgacgaaa

SEQ ID NO: 10759 - DNA, 20 bp, Artificial Sequence
  Artificially Synthesized Primer Sequence
gcgtgattctagccgatgat

SEQ ID NO: 10760 - DNA, 20 bp, Artificial Sequence
  Artificially Synthesized Primer Sequence
aagggctgcacctagtgaga

SEQ ID NO: 10761 - DNA, 20 bp, Artificial Sequence
  Artificially Synthesized Primer Sequence
tggagtaaaaggctgggatg

SEQ ID NO: 10762 - DNA, 20 bp, Artificial Sequence
  Artificially Synthesized Primer Sequence
agggaaaggtggtgcttttt

SEQ ID NO: 10763 - DNA, 20 bp, Artificial Sequence
  Artificially Synthesized Primer Sequence
gaactggagtgagcgtgaca

SEQ ID NO: 10764 - DNA, 20 bp, Artificial Sequence
  Artificially Synthesized Primer Sequence
cttgaaaaggcagttgaggc

SEQ ID NO: 10765 - DNA, 20 bp, Artificial Sequence
  Artificially Synthesized Primer Sequence
cggataaaagcgttggtgat

SEQ ID NO: 10766 - DNA, 20 bp, Artificial Sequence
  Artificially Synthesized Primer Sequence
accctgtctccaaactccct

SEQ ID NO: 10767 - DNA, 20 bp, Artificial Sequence
  Artificially Synthesized Primer Sequence
accgccctcctcttttattc

SEQ ID NO: 10768 - DNA, 20 bp, Artificial Sequence
  Artificially Synthesized Primer Sequence
caccgacaggaccgaatact

SEQ ID NO: 10769 - DNA, 20 bp, Artificial Sequence
  Artificially Synthesized Primer Sequence
cctaggtgcctgaaccacat

SEQ ID NO: 10770 - DNA, 20 bp, Artificial Sequence
  Artificially Synthesized Primer Sequence
tcaaaggtctgaacaagggg

SEQ ID NO: 10771 - DNA, 20 bp, Artificial Sequence
  Artificially Synthesized Primer Sequence
cgagcaagcccattgagtat

SEQ ID NO: 10772 - DNA, 21 bp, Artificial Sequence
  Artificially Synthesized Primer Sequence
cccaccaacgtactacgaaga

SEQ ID NO: 10773 - DNA, 20 bp, Artificial Sequence
  Artificially Synthesized Primer Sequence
ccacccacctactacgagga

SEQ ID NO: 10774 - DNA, 20 bp, Artificial Sequence
  Artificially Synthesized Primer Sequence
aggatggtgtcaagtttcgg

SEQ ID NO: 10775 - DNA, 20 bp, Artificial Sequence
  Artificially Synthesized Primer Sequence
ggtgaccaggcacataacaa

SEQ ID NO: 10776 - DNA, 20 bp, Artificial Sequence
  Artificially Synthesized Primer Sequence
acaccatcctgacgtccatc

SEQ ID NO: 10777 - DNA, 20 bp, Artificial Sequence
  Artificially Synthesized Primer Sequence
gagtaaacggccacacccta

SEQ ID NO: 10778 - DNA, 20 bp, Artificial Sequence
  Artificially Synthesized Primer Sequence
tggtgcgccataatacaaaa

SEQ ID NO: 10779 - DNA, 20 bp, Artificial Sequence
  Artificially Synthesized Primer Sequence
taggataggccctcctcacc

SEQ ID NO: 10780 - DNA, 19 bp, Artificial Sequence
  Artificially Synthesized Primer Sequence
agcacgtcaccagcacttc

SEQ ID NO: 10781 - DNA, 20 bp, Artificial Sequence
  Artificially Synthesized Primer Sequence
tcgactgtcatctttggctg

SEQ ID NO: 10782 - DNA, 20 bp, Artificial Sequence
  Artificially Synthesized Primer Sequence
gtatcggtgtctgcaagggt

SEQ ID NO: 10783 - DNA, 20 bp, Artificial Sequence
  Artificially Synthesized Primer Sequence
tcatctcgttttgtgtccca

SEQ ID NO: 10784 - DNA, 20 bp, Artificial Sequence
  Artificially Synthesized Primer Sequence
acgcaagttaagcatttcgg

SEQ ID NO: 10785 - DNA, 20 bp, Artificial Sequence
  Artificially Synthesized Primer Sequence
tgtccgttgcttggatcata

SEQ ID NO: 10786 - DNA, 20 bp, Artificial Sequence
  Artificially Synthesized Primer Sequence
agcagaaggacctgtttgga

SEQ ID NO: 10787 - DNA, 20 bp, Artificial Sequence
  Artificially Synthesized Primer Sequence
accacaaacatgcccaaaat

SEQ ID NO: 10788 - DNA, 20 bp, Artificial Sequence
  Artificially Synthesized Primer Sequence
gcctccattcacgctagttc

SEQ ID NO: 10789 - DNA, 20 bp, Artificial Sequence
  Artificially Synthesized Primer Sequence
aatgttcaaattcggaacgc

SEQ ID NO: 10790 - DNA, 20 bp, Artificial Sequence
  Artificially Synthesized Primer Sequence
cagggtaaagtcgcggatta

SEQ ID NO: 10791 - DNA, 20 bp, Artificial Sequence
  Artificially Synthesized Primer Sequence
atgaagcagtgaggggaatg

SEQ ID NO: 10792 - DNA, 20 bp, Artificial Sequence
  Artificially Synthesized Primer Sequence
agaagatctgcgacgactcc

SEQ ID NO: 10793 - DNA, 20 bp, Artificial Sequence
  Artificially Synthesized Primer Sequence
gagcatggcatagggacatt

SEQ ID NO: 10794 - DNA, 20 bp, Artificial Sequence
  Artificially Synthesized Primer Sequence
tttccatggtgctgaaatga

SEQ ID NO: 10795 - DNA, 20 bp, Artificial Sequence
  Artificially Synthesized Primer Sequence
gccgccgtcatacagttatt

SEQ ID NO: 10796 - DNA, 20 bp, Artificial Sequence
  Artificially Synthesized Primer Sequence
aacagggtggacagcttgag

SEQ ID NO: 10797 - DNA, 20 bp, Artificial Sequence
  Artificially Synthesized Primer Sequence
gtgcgacaggtgatgaagaa

SEQ ID NO: 10798 - DNA, 20 bp, Artificial Sequence
  Artificially Synthesized Primer Sequence
cctttccaactagccaacca

SEQ ID NO: 10799 - DNA, 20 bp, Artificial Sequence
  Artificially Synthesized Primer Sequence
cctttccaactagccaacca

SEQ ID NO: 10800 - DNA, 18 bp, Artificial Sequence
  Artificially Synthesized Primer Sequence
ctgcttattgcccaaggc

SEQ ID NO: 10801 - DNA, 20 bp, Artificial Sequence
  Artificially Synthesized Primer Sequence
cagggtggttgagaaggtgt

SEQ ID NO: 10802 - DNA, 20 bp, Artificial Sequence
  Artificially Synthesized Primer Sequence
ccaagtacaagccaagagcc

SEQ ID NO: 10803 - DNA, 20 bp, Artificial Sequence
  Artificially Synthesized Primer Sequence
ccaagtacaagccaagagcc

SEQ ID NO: 10804 - DNA, 20 bp, Artificial Sequence
  Artificially Synthesized Primer Sequence
cagggtggttgagaaggtgt

SEQ ID NO: 10805 - DNA, 20 bp, Artificial Sequence
  Artificially Synthesized Primer Sequence
tcttcttcttctccctgcca

SEQ ID NO: 10806 - DNA, 20 bp, Artificial Sequence
  Artificially Synthesized Primer Sequence
ttcagacaccaccaaccaaa

SEQ ID NO: 10807 - DNA, 20 bp, Artificial Sequence
  Artificially Synthesized Primer Sequence
ttcagacaccaccaaccaaa

SEQ ID NO: 10808 - DNA, 20 bp, Artificial Sequence
  Artificially Synthesized Primer Sequence
cttcttcctcctcgtcctcc

SEQ ID NO: 10809 - DNA, 20 bp, Artificial Sequence
  Artificially Synthesized Primer Sequence
gtgatcaccacgaatcaacg

SEQ ID NO: 10810 - DNA, 20 bp, Artificial Sequence
  Artificially Synthesized Primer Sequence
ttgcatcctcctaaaccacc

SEQ ID NO: 10811 - DNA, 20 bp, Artificial Sequence
  Artificially Synthesized Primer Sequence
ccttgcatcctcctaaacca

SEQ ID NO: 10812 - DNA, 20 bp, Artificial Sequence
  Artificially Synthesized Primer Sequence
gtgatcaccacgaatcaacg

SEQ ID NO: 10813 - DNA, 20 bp, Artificial Sequence
  Artificially Synthesized Primer Sequence
cgagactcaggaaaacgagg

SEQ ID NO: 10814 - DNA, 20 bp, Artificial Sequence
  Artificially Synthesized Primer Sequence
ggcttcagaagggagctttt

SEQ ID NO: 10815 - DNA, 20 bp, Artificial Sequence
  Artificially Synthesized Primer Sequence
atgccagcaccaagctaaac

SEQ ID NO: 10816 - DNA, 20 bp, Artificial Sequence
  Artificially Synthesized Primer Sequence
tacacgggtcactgaagctg

SEQ ID NO: 10817 - DNA, 20 bp, Artificial Sequence
  Artificially Synthesized Primer Sequence
cgcgcttccttcatatcttc

SEQ ID NO: 10818 - DNA, 20 bp, Artificial Sequence
  Artificially Synthesized Primer Sequence
cttcacttgcaatgacccaa

SEQ ID NO: 10819 - DNA, 20 bp, Artificial Sequence
  Artificially Synthesized Primer Sequence
agaagactaatggcgcgaaa

SEQ ID NO: 10820 - DNA, 20 bp, Artificial Sequence
  Artificially Synthesized Primer Sequence
cagagacagcatccagctca

SEQ ID NO: 10821 - DNA, 20 bp, Artificial Sequence
  Artificially Synthesized Primer Sequence
ttcagcttctgggttcgtct

SEQ ID NO: 10822 - DNA, 20 bp, Artificial Sequence
  Artificially Synthesized Primer Sequence
ggttggccatcaagatcact

SEQ ID NO: 10823 - DNA, 20 bp, Artificial Sequence
  Artificially Synthesized Primer Sequence
aagcatagccttgtcggttg

SEQ ID NO: 10824 - DNA, 20 bp, Artificial Sequence
  Artificially Synthesized Primer Sequence
ggcagatttgccatcttcat

SEQ ID NO: 10825 - DNA, 20 bp, Artificial Sequence
  Artificially Synthesized Primer Sequence
gctactccaactacagcgcc

SEQ ID NO: 10826 - DNA, 20 bp, Artificial Sequence
  Artificially Synthesized Primer Sequence
aagtgcacatcccacatgaa

SEQ ID NO: 10827 - DNA, 20 bp, Artificial Sequence
  Artificially Synthesized Primer Sequence
acccatgactttggaatgga

SEQ ID NO: 10828 - DNA, 20 bp, Artificial Sequence
  Artificially Synthesized Primer Sequence
tgatcctgcagcttatgtgg

SEQ ID NO: 10829 - DNA, 20 bp, Artificial Sequence
  Artificially Synthesized Primer Sequence
ccatggacacaccaatacca

SEQ ID NO: 10830 - DNA, 20 bp, Artificial Sequence
  Artificially Synthesized Primer Sequence
accggtcaataagaacacgc

SEQ ID NO: 10831 - DNA, 20 bp, Artificial Sequence
  Artificially Synthesized Primer Sequence
cctcaattatttcccgacga

SEQ ID NO: 10832 - DNA, 20 bp, Artificial Sequence
  Artificially Synthesized Primer Sequence
gctgctgctgtaatggaaca

SEQ ID NO: 10833 - DNA, 19 bp, Artificial Sequence
  Artificially Synthesized Primer Sequence
atacctcaacgggccagac

SEQ ID NO: 10834 - DNA, 20 bp, Artificial Sequence
  Artificially Synthesized Primer Sequence
ttgatgccttgatgtatcgc

SEQ ID NO: 10835 - DNA, 20 bp, Artificial Sequence
  Artificially Synthesized Primer Sequence
ggttgaagcaaaccgaacat

SEQ ID NO: 10836 - DNA, 20 bp, Artificial Sequence
  Artificially Synthesized Primer Sequence
aaggtgtacaaggaggctcg

SEQ ID NO: 10837 - DNA, 20 bp, Artificial Sequence
  Artificially Synthesized Primer Sequence
ggatttgctgttcccgtcta

SEQ ID NO: 10838 - DNA, 20 bp, Artificial Sequence
  Artificially Synthesized Primer Sequence
acgcgattgggatacacttc

SEQ ID NO: 10839 - DNA, 20 bp, Artificial Sequence
  Artificially Synthesized Primer Sequence
tagacgggaacagcaaatcc

SEQ ID NO: 10840 - DNA, 20 bp, Artificial Sequence
  Artificially Synthesized Primer Sequence
ctagcaatggtgtggcaatg

SEQ ID NO: 10841 - DNA, 20 bp, Artificial Sequence
  Artificially Synthesized Primer Sequence
ggagttatccttccaagggc

SEQ ID NO: 10842 - DNA, 20 bp, Artificial Sequence
  Artificially Synthesized Primer Sequence
gaaattttctcctgggaggc

SEQ ID NO: 10843 - DNA, 20 bp, Artificial Sequence
  Artificially Synthesized Primer Sequence
gctgcccttcaactcttgac

SEQ ID NO: 10844 - DNA, 20 bp, Artificial Sequence
  Artificially Synthesized Primer Sequence
tgtgaccgaggatgttcaga

SEQ ID NO: 10845 - DNA, 20 bp, Artificial Sequence
  Artificially Synthesized Primer Sequence
ttccaaacaggtggtgcata

SEQ ID NO: 10846 - DNA, 20 bp, Artificial Sequence
  Artificially Synthesized Primer Sequence
agatgcaggagccactagga

SEQ ID NO: 10847 - DNA, 20 bp, Artificial Sequence
  Artificially Synthesized Primer Sequence
agcaatggattccaaacagg

SEQ ID NO: 10848 - DNA, 20 bp, Artificial Sequence
  Artificially Synthesized Primer Sequence
aagaaagtggttgcaggtgg

SEQ ID NO: 10849 - DNA, 20 bp, Artificial Sequence
  Artificially Synthesized Primer Sequence
cggtgaatgcgtatcacaac

SEQ ID NO: 10850 - DNA, 20 bp, Artificial Sequence
  Artificially Synthesized Primer Sequence
accaacggcacactagaacc

SEQ ID NO: 10851 - DNA, 20 bp, Artificial Sequence
  Artificially Synthesized Primer Sequence
acaagaccgcattgtcatca

SEQ ID NO: 10852 - DNA, 20 bp, Artificial Sequence
  Artificially Synthesized Primer Sequence
ttctgtcgcatttagtcccc

SEQ ID NO: 10853 - DNA, 20 bp, Artificial Sequence
  Artificially Synthesized Primer Sequence
ctaccaaacgcagttcagca

SEQ ID NO: 10854 - DNA, 20 bp, Artificial Sequence
  Artificially Synthesized Primer Sequence
agtggtgtccaaatccttcg

SEQ ID NO: 10855 - DNA, 20 bp, Artificial Sequence
  Artificially Synthesized Primer Sequence
attcccttctcgaccaggtt

SEQ ID NO: 10856 - DNA, 20 bp, Artificial Sequence
  Artificially Synthesized Primer Sequence
tccactactaccctccgtgc

SEQ ID NO: 10857 - DNA, 20 bp, Artificial Sequence
  Artificially Synthesized Primer Sequence
tctaccaatccaagggcatc

SEQ ID NO: 10858 - DNA, 20 bp, Artificial Sequence
  Artificially Synthesized Primer Sequence
cataggtcacttgcacacgg

SEQ ID NO: 10859 - DNA, 20 bp, Artificial Sequence
  Artificially Synthesized Primer Sequence
gcacacacgagtggttgact

SEQ ID NO: 10860 - DNA, 20 bp, Artificial Sequence
  Artificially Synthesized Primer Sequence
gcgtacaaccagggattgat

SEQ ID NO: 10861 - DNA, 20 bp, Artificial Sequence
  Artificially Synthesized Primer Sequence
caggtagcagctatgccaca

SEQ ID NO: 10862 - DNA, 20 bp, Artificial Sequence
  Artificially Synthesized Primer Sequence
ggagggggaaagatgaaaaa

SEQ ID NO: 10863 - DNA, 20 bp, Artificial Sequence
  Artificially Synthesized Primer Sequence
ctgacttgtggcatagctgc

SEQ ID NO: 10864 - DNA, 20 bp, Artificial Sequence
  Artificially Synthesized Primer Sequence
tagcaagtttgagctcggtg

SEQ ID NO: 10865 - DNA, 20 bp, Artificial Sequence
  Artificially Synthesized Primer Sequence
tgggttggacgacttctttc

SEQ ID NO: 10866 - DNA, 20 bp, Artificial Sequence
  Artificially Synthesized Primer Sequence
tctcagtcaacgacccacac

SEQ ID NO: 10867 - DNA, 20 bp, Artificial Sequence
  Artificially Synthesized Primer Sequence
tacaagctaccactgcacgc

SEQ ID NO: 10868 - DNA, 20 bp, Artificial Sequence
  Artificially Synthesized Primer Sequence
cttgacttctggatggtggg

SEQ ID NO: 10869 - DNA, 20 bp, Artificial Sequence
  Artificially Synthesized Primer Sequence
ggaacacaaccaagatggct

SEQ ID NO: 10870 - DNA, 20 bp, Artificial Sequence
  Artificially Synthesized Primer Sequence
tccatgacaatgaagccaaa

SEQ ID NO: 10871 - DNA, 20 bp, Artificial Sequence
  Artificially Synthesized Primer Sequence
tatggtgacacgcagacaca

SEQ ID NO: 10872 - DNA, 20 bp, Artificial Sequence
  Artificially Synthesized Primer Sequence
gaggcatccacaagctcatc

SEQ ID NO: 10873 - DNA, 20 bp, Artificial Sequence
  Artificially Synthesized Primer Sequence
accagggtgaggatgacaag

SEQ ID NO: 10874 - DNA, 20 bp, Artificial Sequence
  Artificially Synthesized Primer Sequence
atagggccaacggctattct

SEQ ID NO: 10875 - DNA, 20 bp, Artificial Sequence
  Artificially Synthesized Primer Sequence
aaggtggcgatgaagaagaa

SEQ ID NO: 10876 - DNA, 20 bp, Artificial Sequence
  Artificially Synthesized Primer Sequence
catgtgcatcaatttttggc

SEQ ID NO: 10877 - DNA, 20 bp, Artificial Sequence
  Artificially Synthesized Primer Sequence
agtggaccgataccagcaac

SEQ ID NO: 10878 - DNA, 20 bp, Artificial Sequence
  Artificially Synthesized Primer Sequence
ctgctgctcagcgtgtagtc

SEQ ID NO: 10879 - DNA, 20 bp, Artificial Sequence
  Artificially Synthesized Primer Sequence
ctcccagcagtttcagaagg

SEQ ID NO: 10880 - DNA, 20 bp, Artificial Sequence
  Artificially Synthesized Primer Sequence
ctacaacaaccgtctcaccg

SEQ ID NO: 10881 - DNA, 20 bp, Artificial Sequence
  Artificially Synthesized Primer Sequence
caaccgcatttcattgtttg

SEQ ID NO: 10882 - DNA, 20 bp, Artificial Sequence
  Artificially Synthesized Primer Sequence
gcatgttttcctctgggtgt

SEQ ID NO: 10883 - DNA, 20 bp, Artificial Sequence
  Artificially Synthesized Primer Sequence
gatctgaaaccaggagacgc

SEQ ID NO: 10884 - DNA, 20 bp, Artificial Sequence
  Artificially Synthesized Primer Sequence
ggctcgatatgggtgacagt

SEQ ID NO: 10885 - DNA, 20 bp, Artificial Sequence
  Artificially Synthesized Primer Sequence
tcgtcgacacgttctactcg

SEQ ID NO: 10886 - DNA, 20 bp, Artificial Sequence
  Artificially Synthesized Primer Sequence
cgcattctacagcataggca

SEQ ID NO: 10887 - DNA, 20 bp, Artificial Sequence
  Artificially Synthesized Primer Sequence
cgcattctacagcataggca

SEQ ID NO: 10888 - DNA, 20 bp, Artificial Sequence
  Artificially Synthesized Primer Sequence
tcgtcgacacgttctactcg

SEQ ID NO: 10889 - DNA, 20 bp, Artificial Sequence
  Artificially Synthesized Primer Sequence
gacaaaagcgtcgaggaaag

SEQ ID NO: 10890 - DNA, 20 bp, Artificial Sequence
  Artificially Synthesized Primer Sequence
tggtttgaactgcttgcttg

SEQ ID NO: 10891 - DNA, 20 bp, Artificial Sequence
  Artificially Synthesized Primer Sequence
agatttgcccgtggatactg

SEQ ID NO: 10892 - DNA, 20 bp, Artificial Sequence
  Artificially Synthesized Primer Sequence
gtcgggcttgttctgtcaat

SEQ ID NO: 10893 - DNA, 20 bp, Artificial Sequence
  Artificially Synthesized Primer Sequence
gacctcgagcaggctatcac

SEQ ID NO: 10894 - DNA, 20 bp, Artificial Sequence
  Artificially Synthesized Primer Sequence
cacttcttgagccggttctc

SEQ ID NO: 10895 - DNA, 20 bp, Artificial Sequence
  Artificially Synthesized Primer Sequence
ttgtgtgtgtttgtgtccga

SEQ ID NO: 10896 - DNA, 20 bp, Artificial Sequence
  Artificially Synthesized Primer Sequence
ccgaatgggtagagcaagac

SEQ ID NO: 10897 - DNA, 20 bp, Artificial Sequence
  Artificially Synthesized Primer Sequence
gtcacgttcaggtcaagggt

SEQ ID NO: 10898 - DNA, 20 bp, Artificial Sequence
  Artificially Synthesized Primer Sequence
acctcatccactggagcatc

SEQ ID NO: 10899 - DNA, 20 bp, Artificial Sequence
  Artificially Synthesized Primer Sequence
aaaccaaccaaaagccacag

SEQ ID NO: 10900 - DNA, 20 bp, Artificial Sequence
  Artificially Synthesized Primer Sequence
gaggtgccagaggaacaaac

SEQ ID NO: 10901 - DNA, 20 bp, Artificial Sequence
  Artificially Synthesized Primer Sequence
tctctgtggcgtgtgttctc

SEQ ID NO: 10902 - DNA, 20 bp, Artificial Sequence
  Artificially Synthesized Primer Sequence
acaacccaaaaaccgaacaa

SEQ ID NO: 10903 - DNA, 20 bp, Artificial Sequence
  Artificially Synthesized Primer Sequence
caacttctggcgacacttca

SEQ ID NO: 10904 - DNA, 20 bp, Artificial Sequence
  Artificially Synthesized Primer Sequence
tgcatggctttactgatgga

SEQ ID NO: 10905 - DNA, 20 bp, Artificial Sequence
  Artificially Synthesized Primer Sequence
ggcgatgaggatgaccttta

SEQ ID NO: 10906 - DNA, 20 bp, Artificial Sequence
  Artificially Synthesized Primer Sequence
acagaggcagatggatcacc

SEQ ID NO: 10907 - DNA, 20 bp, Artificial Sequence
  Artificially Synthesized Primer Sequence
cgatgaccgacctaacgagt

SEQ ID NO: 10908 - DNA, 20 bp, Artificial Sequence
  Artificially Synthesized Primer Sequence
agaggcatcagcatcaggtt

SEQ ID NO: 10909 - DNA, 20 bp, Artificial Sequence
  Artificially Synthesized Primer Sequence
ggtccacccaagttgaaaaa

SEQ ID NO: 10910 - DNA, 20 bp, Artificial Sequence
  Artificially Synthesized Primer Sequence
tagcaacctcatagccaggg

SEQ ID NO: 10911 - DNA, 20 bp, Artificial Sequence
  Artificially Synthesized Primer Sequence
cagtggaaaacaatgatgcg

SEQ ID NO: 10912 - DNA, 20 bp, Artificial Sequence
  Artificially Synthesized Primer Sequence
cgcaatgttaaacagcgaga

SEQ ID NO: 10913 - DNA, 20 bp, Artificial Sequence
  Artificially Synthesized Primer Sequence
gttccacttccccaactcaa

SEQ ID NO: 10914 - DNA, 20 bp, Artificial Sequence
  Artificially Synthesized Primer Sequence
taatagacctgccgggtacg

SEQ ID NO: 10915 - DNA, 20 bp, Artificial Sequence
  Artificially Synthesized Primer Sequence
acagaaatacgctggtcgct

SEQ ID NO: 10916 - DNA, 20 bp, Artificial Sequence
  Artificially Synthesized Primer Sequence
gcgtacaagagcatgcagac

SEQ ID NO: 10917 - DNA, 20 bp, Artificial Sequence
  Artificially Synthesized Primer Sequence
atgggtcaaaaaggtgcaag

SEQ ID NO: 10918 - DNA, 20 bp, Artificial Sequence
  Artificially Synthesized Primer Sequence
ctggaaaatggatggcaact

SEQ ID NO: 10919 - DNA, 20 bp, Artificial Sequence
  Artificially Synthesized Primer Sequence
ctgtttggatgactgcgaga

SEQ ID NO: 10920 - DNA, 20 bp, Artificial Sequence
  Artificially Synthesized Primer Sequence
attacgcaacctgatggagc

SEQ ID NO: 10921 - DNA, 20 bp, Artificial Sequence
  Artificially Synthesized Primer Sequence
cacccccatatcactccact

SEQ ID NO: 10922 - DNA, 20 bp, Artificial Sequence
  Artificially Synthesized Primer Sequence
gatggagggagaaggaaagg

SEQ ID NO: 10923 - DNA, 20 bp, Artificial Sequence
  Artificially Synthesized Primer Sequence
acatccaaaagccaaaccaa

SEQ ID NO: 10924 - DNA, 20 bp, Artificial Sequence
  Artificially Synthesized Primer Sequence
cagaggtaggggagggagat

SEQ ID NO: 10925 - DNA, 20 bp, Artificial Sequence
  Artificially Synthesized Primer Sequence
cctcaagaacgtcttcgacc

SEQ ID NO: 10926 - DNA, 20 bp, Artificial Sequence
  Artificially Synthesized Primer Sequence
gtgatgaattggcgacattg

SEQ ID NO: 10927 - DNA, 20 bp, Artificial Sequence
  Artificially Synthesized Primer Sequence
tttggatgatccgggtgtat

SEQ ID NO: 10928 - DNA, 20 bp, Artificial Sequence
  Artificially Synthesized Primer Sequence
gaagacaccgatctgcacct

SEQ ID NO: 10929 - DNA, 20 bp, Artificial Sequence
  Artificially Synthesized Primer Sequence
cgagaacctctccgtagtcg

SEQ ID NO: 10930 - DNA, 20 bp, Artificial Sequence
  Artificially Synthesized Primer Sequence
gagcctgtgccttcttatcg

SEQ ID NO: 10931 - DNA, 20 bp, Artificial Sequence
  Artificially Synthesized Primer Sequence
aaatggcttcaacaaatgcc

SEQ ID NO: 10932 - DNA, 20 bp, Artificial Sequence
  Artificially Synthesized Primer Sequence
cgataagaaggcacaggctc

SEQ ID NO: 10933 - DNA, 20 bp, Artificial Sequence
  Artificially Synthesized Primer Sequence
ggaaagaaaggaacaagggg

SEQ ID NO: 10934 - DNA, 20 bp, Artificial Sequence
  Artificially Synthesized Primer Sequence
cctggtcaagcttgctcttc

SEQ ID NO: 10935 - DNA, 20 bp, Artificial Sequence
  Artificially Synthesized Primer Sequence
agcggagaagtgctgagttc

SEQ ID NO: 10936 - DNA, 20 bp, Artificial Sequence
  Artificially Synthesized Primer Sequence
gctccttcttcacaccttgc

SEQ ID NO: 10937 - DNA, 20 bp, Artificial Sequence
  Artificially Synthesized Primer Sequence
gcacgaggaaaaggtttgag

SEQ ID NO: 10938 - DNA, 20 bp, Artificial Sequence
  Artificially Synthesized Primer Sequence
agacggtgctctgaacgact

SEQ ID NO: 10939 - DNA, 20 bp, Artificial Sequence
  Artificially Synthesized Primer Sequence
catccacatgcctgaaactg

SEQ ID NO: 10940 - DNA, 20 bp, Artificial Sequence
  Artificially Synthesized Primer Sequence
tgacatgacggttctcctca

SEQ ID NO: 10941 - DNA, 20 bp, Artificial Sequence
  Artificially Synthesized Primer Sequence
tgcgagggaggataatgttc

SEQ ID NO: 10942 - DNA, 20 bp, Artificial Sequence
  Artificially Synthesized Primer Sequence
aaatgggggccgataaatag

SEQ ID NO: 10943 - DNA, 20 bp, Artificial Sequence
  Artificially Synthesized Primer Sequence
atgtcacagcgtcaccacat

SEQ ID NO: 10944 - DNA, 20 bp, Artificial Sequence
  Artificially Synthesized Primer Sequence
tcctcaagaagaagcccgta

SEQ ID NO: 10945 - DNA, 20 bp, Artificial Sequence
  Artificially Synthesized Primer Sequence
agaaaaaggatgagcagcca

SEQ ID NO: 10946 - DNA, 20 bp, Artificial Sequence
  Artificially Synthesized Primer Sequence
gtggttgtgaaggcaaaggt

SEQ ID NO: 10947 - DNA, 20 bp, Artificial Sequence
  Artificially Synthesized Primer Sequence
accagacagcgtctttgctt

SEQ ID NO: 10948 - DNA, 20 bp, Artificial Sequence
  Artificially Synthesized Primer Sequence
ccgcattggcttctacattt

SEQ ID NO: 10949 - DNA, 20 bp, Artificial Sequence
  Artificially Synthesized Primer Sequence
atgctggtgtcactgctgtc

SEQ ID NO: 10950 - DNA, 20 bp, Artificial Sequence
  Artificially Synthesized Primer Sequence
ggtttgtctgcagcctcttc

SEQ ID NO: 10951 - DNA, 20 bp, Artificial Sequence
  Artificially Synthesized Primer Sequence
acgaatgtcgattagcaggc

SEQ ID NO: 10952 - DNA, 20 bp, Artificial Sequence
  Artificially Synthesized Primer Sequence
gaagaggctgcagacaaacc

SEQ ID NO: 10953 - DNA, 20 bp, Artificial Sequence
  Artificially Synthesized Primer Sequence
tcgaccaccccaacttctac

SEQ ID NO: 10954 - DNA, 20 bp, Artificial Sequence
  Artificially Synthesized Primer Sequence
cggttgtcctctccctcata

SEQ ID NO: 10955 - DNA, 21 bp, Artificial Sequence
  Artificially Synthesized Primer Sequence
gggagctttatttggttctgg

SEQ ID NO: 10956 - DNA, 20 bp, Artificial Sequence
  Artificially Synthesized Primer Sequence
tatgagggagaggacaaccg

SEQ ID NO: 10957 - DNA, 20 bp, Artificial Sequence
  Artificially Synthesized Primer Sequence
gcgccgacttgcttactatc

SEQ ID NO: 10958 - DNA, 20 bp, Artificial Sequence
  Artificially Synthesized Primer Sequence
ggaacgcagtcagggtgtat

SEQ ID NO: 10959 - DNA, 20 bp, Artificial Sequence
  Artificially Synthesized Primer Sequence
tacatgaatgaagggagggg

SEQ ID NO: 10960 - DNA, 20 bp, Artificial Sequence
  Artificially Synthesized Primer Sequence
tatcggttatggagggatgc

SEQ ID NO: 10961 - DNA, 20 bp, Artificial Sequence
  Artificially Synthesized Primer Sequence
gctttcgacggttggtgtat

SEQ ID NO: 10962 - DNA, 20 bp, Artificial Sequence
  Artificially Synthesized Primer Sequence
acctcttcgcttaggcatca

SEQ ID NO: 10963 - DNA, 20 bp, Artificial Sequence
  Artificially Synthesized Primer Sequence
cctccatttcaggaaacagc

SEQ ID NO: 10964 - DNA, 20 bp, Artificial Sequence
  Artificially Synthesized Primer Sequence
agctgctcaagttcgtggac

SEQ ID NO: 10965 - DNA, 20 bp, Artificial Sequence
  Artificially Synthesized Primer Sequence
ctcccaccaggtttgaatgt

SEQ ID NO: 10966 - DNA, 20 bp, Artificial Sequence
  Artificially Synthesized Primer Sequence
acagaatcctcacaggtgcc

SEQ ID NO: 10967 - DNA, 20 bp, Artificial Sequence
  Artificially Synthesized Primer Sequence
gcagatccacgagatcaagg

SEQ ID NO: 10968 - DNA, 20 bp, Artificial Sequence
  Artificially Synthesized Primer Sequence
gacgctgcttaacccaacat

SEQ ID NO: 10969 - DNA, 20 bp, Artificial Sequence
  Artificially Synthesized Primer Sequence
ccatccttccaactctccaa

SEQ ID NO: 10970 - DNA, 20 bp, Artificial Sequence
  Artificially Synthesized Primer Sequence
attgcaccatgcacaacact

SEQ ID NO: 10971 - DNA, 20 bp, Artificial Sequence
  Artificially Synthesized Primer Sequence
accccggaagctaagatgat

SEQ ID NO: 10972 - DNA, 20 bp, Artificial Sequence
  Artificially Synthesized Primer Sequence
agtcggaacatgcggtacac

SEQ ID NO: 10973 - DNA, 20 bp, Artificial Sequence
  Artificially Synthesized Primer Sequence
ttgtcggtagtccgttgttg

SEQ ID NO: 10974 - DNA, 20 bp, Artificial Sequence
  Artificially Synthesized Primer Sequence
tgtggtggtcgcgagtatag

SEQ ID NO: 10975 - DNA, 20 bp, Artificial Sequence
  Artificially Synthesized Primer Sequence
aacaaatccagatgcttgcc

SEQ ID NO: 10976 - DNA, 20 bp, Artificial Sequence
  Artificially Synthesized Primer Sequence
cgaaaagcaagcatgacaaa

SEQ ID NO: 10977 - DNA, 20 bp, Artificial Sequence
  Artificially Synthesized Primer Sequence
tggcctatgaaatcgaggac

SEQ ID NO: 10978 - DNA, 20 bp, Artificial Sequence
  Artificially Synthesized Primer Sequence
cacacccttcaccgttttct

SEQ ID NO: 10979 - DNA, 21 bp, Artificial Sequence
  Artificially Synthesized Primer Sequence
caaaacgaattagtcccacga

SEQ ID NO: 10980 - DNA, 20 bp, Artificial Sequence
  Artificially Synthesized Primer Sequence
ctgctgaactgtgcaatggt

SEQ ID NO: 10981 - DNA, 20 bp, Artificial Sequence
  Artificially Synthesized Primer Sequence
tggtgacttcagacgcaaag

SEQ ID NO: 10982 - DNA, 20 bp, Artificial Sequence
  Artificially Synthesized Primer Sequence
gtctcagctcaacctccgtc

SEQ ID NO: 10983 - DNA, 20 bp, Artificial Sequence
  Artificially Synthesized Primer Sequence
aaaagattgtccgagcacca

SEQ ID NO: 10984 - DNA, 20 bp, Artificial Sequence
  Artificially Synthesized Primer Sequence
aaactcgacgatttcatccg

SEQ ID NO: 10985 - DNA, 20 bp, Artificial Sequence
  Artificially Synthesized Primer Sequence
cttcagggagcctttcctct

SEQ ID NO: 10986 - DNA, 20 bp, Artificial Sequence
  Artificially Synthesized Primer Sequence
tggatggctctgtgactctg

SEQ ID NO: 10987 - DNA, 20 bp, Artificial Sequence
  Artificially Synthesized Primer Sequence
agctaaggtggttagtgcgg

SEQ ID NO: 10988 - DNA, 20 bp, Artificial Sequence
  Artificially Synthesized Primer Sequence
cagagtcacagagccatcca

SEQ ID NO: 10989 - DNA, 20 bp, Artificial Sequence
  Artificially Synthesized Primer Sequence
aggtgctctgcctgcactat

SEQ ID NO: 10990 - DNA, 20 bp, Artificial Sequence
  Artificially Synthesized Primer Sequence
ttccgatacctctacccgtg

SEQ ID NO: 10991 - DNA, 20 bp, Artificial Sequence
  Artificially Synthesized Primer Sequence
ctacctggacattccccaga

SEQ ID NO: 10992 - DNA, 20 bp, Artificial Sequence
  Artificially Synthesized Primer Sequence
cacgggtagaggtatcggaa

SEQ ID NO: 10993 - DNA, 20 bp, Artificial Sequence
  Artificially Synthesized Primer Sequence
ctgaaaagcaggaaattggc

SEQ ID NO: 10994 - DNA, 20 bp, Artificial Sequence
  Artificially Synthesized Primer Sequence
gtagaactccggtggcatgt

SEQ ID NO: 10995 - DNA, 20 bp, Artificial Sequence
  Artificially Synthesized Primer Sequence
tcagcatcaaccaacgtgat

SEQ ID NO: 10996 - DNA, 20 bp, Artificial Sequence
  Artificially Synthesized Primer Sequence
ctgcaacccctcaaaacatt

SEQ ID NO: 10997 - DNA, 20 bp, Artificial Sequence
  Artificially Synthesized Primer Sequence
ttgtgcgtcgtgattctagc

SEQ ID NO: 10998 - DNA, 20 bp, Artificial Sequence
  Artificially Synthesized Primer Sequence
catagggtaagggggacgat

SEQ ID NO: 10999 - DNA, 20 bp, Artificial Sequence
  Artificially Synthesized Primer Sequence
ttaaccacaaggaggcatgg

SEQ ID NO: 11000 - DNA, 19 bp, Artificial Sequence
  Artificially Synthesized Primer Sequence
gcaaggcttctgatcctcc

SEQ ID NO: 11001 - DNA, 20 bp, Artificial Sequence
  Artificially Synthesized Primer Sequence
cttcaactgcgtgatcgaga

SEQ ID NO: 11002 - DNA, 20 bp, Artificial Sequence
  Artificially Synthesized Primer Sequence
tcgcaaatgtaggtggcata

SEQ ID NO: 11003 - DNA, 20 bp, Artificial Sequence
  Artificially Synthesized Primer Sequence
atgccctgtttatctggctg

SEQ ID NO: 11004 - DNA, 20 bp, Artificial Sequence
  Artificially Synthesized Primer Sequence
agtaccgccacttcaacgac

SEQ ID NO: 11005 - DNA, 20 bp, Artificial Sequence
  Artificially Synthesized Primer Sequence
tctcaaccacatcccattca

SEQ ID NO: 11006 - DNA, 20 bp, Artificial Sequence
  Artificially Synthesized Primer Sequence
cacgggatcgatgtctcttt

SEQ ID NO: 11007 - DNA, 20 bp, Artificial Sequence
  Artificially Synthesized Primer Sequence
cacgggatcgatgtctcttt

SEQ ID NO: 11008 - DNA, 21 bp, Artificial Sequence
  Artificially Synthesized Primer Sequence
ggctggagaagagcaggtact

SEQ ID NO: 11009 - DNA, 20 bp, Artificial Sequence
  Artificially Synthesized Primer Sequence
caacatgggtcgaaggagat

SEQ ID NO: 11010 - DNA, 20 bp, Artificial Sequence
  Artificially Synthesized Primer Sequence
atcctgccatgtcaacacaa

SEQ ID NO: 11011 - DNA, 20 bp, Artificial Sequence
  Artificially Synthesized Primer Sequence
ccatcccgtcaacatcttct

SEQ ID NO: 11012 - DNA, 20 bp, Artificial Sequence
  Artificially Synthesized Primer Sequence
ccagtcaggctactcgaagg

SEQ ID NO: 11013 - DNA, 20 bp, Artificial Sequence
  Artificially Synthesized Primer Sequence
tcagcaacatcagagatccg

SEQ ID NO: 11014 - DNA, 20 bp, Artificial Sequence
  Artificially Synthesized Primer Sequence
tccaatccctcaccttgttc

SEQ ID NO: 11015 - DNA, 20 bp, Artificial Sequence
  Artificially Synthesized Primer Sequence
cgacaacaatgacgacaacc

SEQ ID NO: 11016 - DNA, 20 bp, Artificial Sequence
  Artificially Synthesized Primer Sequence
gcacaaacagcaacaggttc

SEQ ID NO: 11017 - DNA, 20 bp, Artificial Sequence
  Artificially Synthesized Primer Sequence
tcctccttctcctcctcctc

SEQ ID NO: 11018 - DNA, 20 bp, Artificial Sequence
  Artificially Synthesized Primer Sequence
ccgacttggtgtagatccgt

SEQ ID NO: 11019 - DNA, 20 bp, Artificial Sequence
  Artificially Synthesized Primer Sequence
catgacaggacagtgacgct

SEQ ID NO: 11020 - DNA, 20 bp, Artificial Sequence
  Artificially Synthesized Primer Sequence
cgaccgatgactttgaggat

SEQ ID NO: 11021 - DNA, 20 bp, Artificial Sequence
  Artificially Synthesized Primer Sequence
ctttttaatggggccgaaat

SEQ ID NO: 11022 - DNA, 20 bp, Artificial Sequence
  Artificially Synthesized Primer Sequence
ccctctctttggggactttc

SEQ ID NO: 11023 - DNA, 20 bp, Artificial Sequence
  Artificially Synthesized Primer Sequence
ggccagaagttggtccataa

SEQ ID NO: 11024 - DNA, 20 bp, Artificial Sequence
  Artificially Synthesized Primer Sequence
atgtaccccgaggtagaggc

SEQ ID NO: 11025 - DNA, 20 bp, Artificial Sequence
  Artificially Synthesized Primer Sequence
aaccttaagggccacgagtt

SEQ ID NO: 11026 - DNA, 20 bp, Artificial Sequence
  Artificially Synthesized Primer Sequence
agttcttcagcgtgtgcctt

SEQ ID NO: 11027 - DNA, 20 bp, Artificial Sequence
  Artificially Synthesized Primer Sequence
aattcagggcctgtgtgaac

SEQ ID NO: 11028 - DNA, 20 bp, Artificial Sequence
  Artificially Synthesized Primer Sequence
aaggcacacgctgaagaact

SEQ ID NO: 11029 - DNA, 20 bp, Artificial Sequence
  Artificially Synthesized Primer Sequence
aggagcaaaccatgtccaag

SEQ ID NO: 11030 - DNA, 20 bp, Artificial Sequence
  Artificially Synthesized Primer Sequence
gggatatctagggcacctcc

SEQ ID NO: 11031 - DNA, 20 bp, Artificial Sequence
  Artificially Synthesized Primer Sequence
ctttcatgctggacagagca

SEQ ID NO: 11032 - DNA, 19 bp, Artificial Sequence
  Artificially Synthesized Primer Sequence
caagcaaggagccacagag

SEQ ID NO: 11033 - DNA, 20 bp, Artificial Sequence
  Artificially Synthesized Primer Sequence
cctgccgcttagtagacgac

SEQ ID NO: 11034 - DNA, 20 bp, Artificial Sequence
  Artificially Synthesized Primer Sequence
agcataaaaacgtgaacccg

SEQ ID NO: 11035 - DNA, 20 bp, Artificial Sequence
  Artificially Synthesized Primer Sequence
tgccagtttaggtttctccg

SEQ ID NO: 11036 - DNA, 20 bp, Artificial Sequence
  Artificially Synthesized Primer Sequence
tcaggaggcatttccatgat

SEQ ID NO: 11037 - DNA, 20 bp, Artificial Sequence
  Artificially Synthesized Primer Sequence
tggagatgatgggtcacaga

SEQ ID NO: 11038 - DNA, 20 bp, Artificial Sequence
  Artificially Synthesized Primer Sequence
acatcgagccaaatggaaac

SEQ ID NO: 11039 - DNA, 20 bp, Artificial Sequence
  Artificially Synthesized Primer Sequence
gctggcacaacgaaggtaat

SEQ ID NO: 11040 - DNA, 20 bp, Artificial Sequence
  Artificially Synthesized Primer Sequence
tgaatcacaatgtggctcgt

SEQ ID NO: 11041 - DNA, 20 bp, Artificial Sequence
  Artificially Synthesized Primer Sequence
cctacttcaggaggggctct

SEQ ID NO: 11042 - DNA, 20 bp, Artificial Sequence
  Artificially Synthesized Primer Sequence
ggtttttgggatgactccct

SEQ ID NO: 11043 - DNA, 20 bp, Artificial Sequence
  Artificially Synthesized Primer Sequence
atggacccaacaagtggaag

SEQ ID NO: 11044 - DNA, 20 bp, Artificial Sequence
  Artificially Synthesized Primer Sequence
aggaagactttggaggccat

SEQ ID NO: 11045 - DNA, 20 bp, Artificial Sequence
  Artificially Synthesized Primer Sequence
tcacgtacgttcagggacaa

SEQ ID NO: 11046 - DNA, 20 bp, Artificial Sequence
  Artificially Synthesized Primer Sequence
acccatgatgaagggattga

SEQ ID NO: 11047 - DNA, 20 bp, Artificial Sequence
  Artificially Synthesized Primer Sequence
aagcgggctagttctgatga

SEQ ID NO: 11048 - DNA, 20 bp, Artificial Sequence
  Artificially Synthesized Primer Sequence
tgactaccccaaggtgaagg

SEQ ID NO: 11049 - DNA, 20 bp, Artificial Sequence
  Artificially Synthesized Primer Sequence
ggcctcaggagtgtttggta

SEQ ID NO: 11050 - DNA, 20 bp, Artificial Sequence
  Artificially Synthesized Primer Sequence
aaaacaaccaatcgcaggac

SEQ ID NO: 11051 - DNA, 20 bp, Artificial Sequence
  Artificially Synthesized Primer Sequence
gcgttcatggtagagccttc

SEQ ID NO: 11052 - DNA, 20 bp, Artificial Sequence
  Artificially Synthesized Primer Sequence
actggtgccactttgagctt

SEQ ID NO: 11053 - DNA, 20 bp, Artificial Sequence
  Artificially Synthesized Primer Sequence
catcaccatctcttgccctt

SEQ ID NO: 11054 - DNA, 20 bp, Artificial Sequence
  Artificially Synthesized Primer Sequence
caagagggacctccttttcc

SEQ ID NO: 11055 - DNA, 20 bp, Artificial Sequence
  Artificially Synthesized Primer Sequence
tcaaaaatgccccttcactc

SEQ ID NO: 11056 - DNA, 20 bp, Artificial Sequence
  Artificially Synthesized Primer Sequence
attgcataacctgagcccac

SEQ ID NO: 11057 - DNA, 20 bp, Artificial Sequence
  Artificially Synthesized Primer Sequence
atgccatgctcgattcctac

SEQ ID NO: 11058 - DNA, 20 bp, Artificial Sequence
  Artificially Synthesized Primer Sequence
acgaggccgatatgaaattg

SEQ ID NO: 11059 - DNA, 20 bp, Artificial Sequence
  Artificially Synthesized Primer Sequence
tgcacgtaagcatcttcagc

SEQ ID NO: 11060 - DNA, 20 bp, Artificial Sequence
  Artificially Synthesized Primer Sequence
acctccagctcctcctcttc

SEQ ID NO: 11061 - DNA, 20 bp, Artificial Sequence
  Artificially Synthesized Primer Sequence
cgtgtcgttctatccctggt

SEQ ID NO: 11062 - DNA, 20 bp, Artificial Sequence
  Artificially Synthesized Primer Sequence
acacaaaccgacagaccaca

SEQ ID NO: 11063 - DNA, 20 bp, Artificial Sequence
  Artificially Synthesized Primer Sequence
gtcaggttgaggggaacaga

SEQ ID NO: 11064 - DNA, 20 bp, Artificial Sequence
  Artificially Synthesized Primer Sequence
aagtgaaggcaccaccaatc

SEQ ID NO: 11065 - DNA, 20 bp, Artificial Sequence
  Artificially Synthesized Primer Sequence
atatgctatgccttcacgcc

SEQ ID NO: 11066 - DNA, 20 bp, Artificial Sequence
  Artificially Synthesized Primer Sequence
agaacaaagagaccgagcca

SEQ ID NO: 11067 - DNA, 20 bp, Artificial Sequence
  Artificially Synthesized Primer Sequence
tgggggtcacccaactacta

SEQ ID NO: 11068 - DNA, 20 bp, Artificial Sequence
  Artificially Synthesized Primer Sequence
ctggccgaagacaatgaact

SEQ ID NO: 11069 - DNA, 20 bp, Artificial Sequence
  Artificially Synthesized Primer Sequence
tggtgcggaaagtcctatct

SEQ ID NO: 11070 - DNA, 20 bp, Artificial Sequence
  Artificially Synthesized Primer Sequence
tcgctcacacttttgtttcg

SEQ ID NO: 11071 - DNA, 22 bp, Artificial Sequence
  Artificially Synthesized Primer Sequence
tcccgacatttacttttgaacc

SEQ ID NO: 11072 - DNA, 20 bp, Artificial Sequence
  Artificially Synthesized Primer Sequence
tggtgcggaaagtcctatct

SEQ ID NO: 11073 - DNA, 20 bp, Artificial Sequence
  Artificially Synthesized Primer Sequence
gatatggaccgtttcccctt

SEQ ID NO: 11074 - DNA, 20 bp, Artificial Sequence
  Artificially Synthesized Primer Sequence
ggtttttgttggtgggtttg

SEQ ID NO: 11075 - DNA, 20 bp, Artificial Sequence
  Artificially Synthesized Primer Sequence
acctcaatccaatccatcca

SEQ ID NO: 11076 - DNA, 20 bp, Artificial Sequence
  Artificially Synthesized Primer Sequence
ctccgttcgaggagactgac

SEQ ID NO: 11077 - DNA, 20 bp, Artificial Sequence
  Artificially Synthesized Primer Sequence
cctttattttgggcccattt

SEQ ID NO: 11078 - DNA, 20 bp, Artificial Sequence
  Artificially Synthesized Primer Sequence
aacgattacacacgccaaca

SEQ ID NO: 11079 - DNA, 20 bp, Artificial Sequence
  Artificially Synthesized Primer Sequence
ccagctgtagctccgaaaac

SEQ ID NO: 11080 - DNA, 20 bp, Artificial Sequence
  Artificially Synthesized Primer Sequence
ccaccaccaaggaagacatc

SEQ ID NO: 11081 - DNA, 20 bp, Artificial Sequence
  Artificially Synthesized Primer Sequence
gtggagcaagggaaaacaaa

SEQ ID NO: 11082 - DNA, 20 bp, Artificial Sequence
  Artificially Synthesized Primer Sequence
tttcattgcgctgacaaaac

SEQ ID NO: 11083 - DNA, 20 bp, Artificial Sequence
  Artificially Synthesized Primer Sequence
gcctccctggacatagtgaa

SEQ ID NO: 11084 - DNA, 20 bp, Artificial Sequence
  Artificially Synthesized Primer Sequence
gatcaatggctctctggctc

SEQ ID NO: 11085 - DNA, 20 bp, Artificial Sequence
  Artificially Synthesized Primer Sequence
gagacagagcttccccctct

SEQ ID NO: 11086 - DNA, 20 bp, Artificial Sequence
  Artificially Synthesized Primer Sequence
agagagcagagcatggtggt

SEQ ID NO: 11087 - DNA, 20 bp, Artificial Sequence
  Artificially Synthesized Primer Sequence
atcatcgtcatcgtcagcaa

SEQ ID NO: 11088 - DNA, 20 bp, Artificial Sequence
  Artificially Synthesized Primer Sequence
ggttgtgcaagtgaggttca

SEQ ID NO: 11089 - DNA, 20 bp, Artificial Sequence
  Artificially Synthesized Primer Sequence
tgcaggcactaaaacacgag

SEQ ID NO: 11090 - DNA, 20 bp, Artificial Sequence
  Artificially Synthesized Primer Sequence
agatcctccggcacatacac

SEQ ID NO: 11091 - DNA, 20 bp, Artificial Sequence
  Artificially Synthesized Primer Sequence
ctacacctcgatcagcacca

SEQ ID NO: 11092 - DNA, 20 bp, Artificial Sequence
  Artificially Synthesized Primer Sequence
gtgtatgtgccggaggatct

SEQ ID NO: 11093 - DNA, 20 bp, Artificial Sequence
  Artificially Synthesized Primer Sequence
tctcgctgtttcaactgtgg

SEQ ID NO: 11094 - DNA, 20 bp, Artificial Sequence
  Artificially Synthesized Primer Sequence
actccaccgtcatcctcttg

SEQ ID NO: 11095 - DNA, 20 bp, Artificial Sequence
  Artificially Synthesized Primer Sequence
cacctcctgttgctgctgta

SEQ ID NO: 11096 - DNA, 20 bp, Artificial Sequence
  Artificially Synthesized Primer Sequence
caagaggatgacggtggagt

SEQ ID NO: 11097 - DNA, 20 bp, Artificial Sequence
  Artificially Synthesized Primer Sequence
tgtctggatccctgaaaagg

SEQ ID NO: 11098 - DNA, 20 bp, Artificial Sequence
  Artificially Synthesized Primer Sequence
cgtgaaacgaacggaaaaat

SEQ ID NO: 11099 - DNA, 20 bp, Artificial Sequence
  Artificially Synthesized Primer Sequence
acctgcctctgtatccgttg

SEQ ID NO: 11100 - DNA, 20 bp, Artificial Sequence
  Artificially Synthesized Primer Sequence
ggcatcaagacacaaagtgg

SEQ ID NO: 11101 - DNA, 20 bp, Artificial Sequence
  Artificially Synthesized Primer Sequence
gcgtaaatccggagagactg

SEQ ID NO: 11102 - DNA, 20 bp, Artificial Sequence
  Artificially Synthesized Primer Sequence
aactgggacagcagcgagta

SEQ ID NO: 11103 - DNA, 20 bp, Artificial Sequence
  Artificially Synthesized Primer Sequence
actggtcagtcagtcagccc

SEQ ID NO: 11104 - DNA, 20 bp, Artificial Sequence
  Artificially Synthesized Primer Sequence
gtacctggcaaaactcccct

SEQ ID NO: 11105 - DNA, 20 bp, Artificial Sequence
  Artificially Synthesized Primer Sequence
ttcctcgacaccaacatcaa

SEQ ID NO: 11106 - DNA, 20 bp, Artificial Sequence
  Artificially Synthesized Primer Sequence
gtctccatgcctatcgtcgt

SEQ ID NO: 11107 - DNA, 20 bp, Artificial Sequence
  Artificially Synthesized Primer Sequence
atcagatcggtctccaatgc

SEQ ID NO: 11108 - DNA, 20 bp, Artificial Sequence
  Artificially Synthesized Primer Sequence
accgtcgccgtaagatacat

SEQ ID NO: 11109 - DNA, 20 bp, Artificial Sequence
  Artificially Synthesized Primer Sequence
tcacaggcaagacactcacc

SEQ ID NO: 11110 - DNA, 20 bp, Artificial Sequence
  Artificially Synthesized Primer Sequence
gcaaagagacgacaaggagg

SEQ ID NO: 11111 - DNA, 20 bp, Artificial Sequence
  Artificially Synthesized Primer Sequence
tccatgcaacctcacgaata

SEQ ID NO: 11112 - DNA, 20 bp, Artificial Sequence
  Artificially Synthesized Primer Sequence
cctccttgtcgtctctttgc

SEQ ID NO: 11113 - DNA, 20 bp, Artificial Sequence
  Artificially Synthesized Primer Sequence
ggttaggacaacagccgaaa

SEQ ID NO: 11114 - DNA, 20 bp, Artificial Sequence
  Artificially Synthesized Primer Sequence
ccatgtcttcgagtgcttca

SEQ ID NO: 11115 - DNA, 20 bp, Artificial Sequence
  Artificially Synthesized Primer Sequence
gagtcgcaattgagcaaaca

SEQ ID NO: 11116 - DNA, 20 bp, Artificial Sequence
  Artificially Synthesized Primer Sequence
cctgccagttacccacagat

SEQ ID NO: 11117 - DNA, 20 bp, Artificial Sequence
  Artificially Synthesized Primer Sequence
tccgagtgttggacctatcc

SEQ ID NO: 11118 - DNA, 20 bp, Artificial Sequence
  Artificially Synthesized Primer Sequence
gcaatgaggtgggcaatact

SEQ ID NO: 11119 - DNA, 20 bp, Artificial Sequence
  Artificially Synthesized Primer Sequence
gcagaaggttgttccagctc

SEQ ID NO: 11120 - DNA, 20 bp, Artificial Sequence
  Artificially Synthesized Primer Sequence
tctctcagggcagataccgt

SEQ ID NO: 11121 - DNA, 20 bp, Artificial Sequence
  Artificially Synthesized Primer Sequence
tcatggggcttaaccttctg

SEQ ID NO: 11122 - DNA, 20 bp, Artificial Sequence
  Artificially Synthesized Primer Sequence
gcacccagctatctcgtctc

SEQ ID NO: 11123 - DNA, 20 bp, Artificial Sequence
  Artificially Synthesized Primer Sequence
gcactttggaaacagtgggt

SEQ ID NO: 11124 - DNA, 20 bp, Artificial Sequence
  Artificially Synthesized Primer Sequence
gagacgagatagctgggtgc

SEQ ID NO: 11125 - DNA, 20 bp, Artificial Sequence
  Artificially Synthesized Primer Sequence
atacccacgaatctccctcc

SEQ ID NO: 11126 - DNA, 20 bp, Artificial Sequence
  Artificially Synthesized Primer Sequence
attctatctgttggcggtgg

SEQ ID NO: 11127 - DNA, 20 bp, Artificial Sequence
  Artificially Synthesized Primer Sequence
gacaccacatccacaaacga

SEQ ID NO: 11128 - DNA, 20 bp, Artificial Sequence
  Artificially Synthesized Primer Sequence
gcgaccacaaggagaagaag

SEQ ID NO: 11129 - DNA, 20 bp, Artificial Sequence
  Artificially Synthesized Primer Sequence
gctcttgggttgggtacaaa

SEQ ID NO: 11130 - DNA, 20 bp, Artificial Sequence
  Artificially Synthesized Primer Sequence
ctagtcaggtgcgccacata

SEQ ID NO: 11131 - DNA, 20 bp, Artificial Sequence
  Artificially Synthesized Primer Sequence
agaaagcaacttcacagccc

SEQ ID NO: 11132 - DNA, 20 bp, Artificial Sequence
  Artificially Synthesized Primer Sequence
agaacaaagcagcacgaagc

SEQ ID NO: 11133 - DNA, 20 bp, Artificial Sequence
  Artificially Synthesized Primer Sequence
cctgagcaaagagaacgacc

SEQ ID NO: 11134 - DNA, 20 bp, Artificial Sequence
  Artificially Synthesized Primer Sequence
gatctcgaatcactcacgca

SEQ ID NO: 11135 - DNA, 20 bp, Artificial Sequence
  Artificially Synthesized Primer Sequence
tcacacgacaaaccgctatc

SEQ ID NO: 11136 - DNA, 20 bp, Artificial Sequence
  Artificially Synthesized Primer Sequence
agcctggatatccctgtggt

SEQ ID NO: 11137 - DNA, 20 bp, Artificial Sequence
  Artificially Synthesized Primer Sequence
aatggtgcacacaacaggaa

SEQ ID NO: 11138 - DNA, 20 bp, Artificial Sequence
  Artificially Synthesized Primer Sequence
tcacaatgcacacctccaat

SEQ ID NO: 11139 - DNA, 20 bp, Artificial Sequence
  Artificially Synthesized Primer Sequence
atctgatgaacccgaaccac

SEQ ID NO: 11140 - DNA, 20 bp, Artificial Sequence
  Artificially Synthesized Primer Sequence
atcaacaagcatccagggag

SEQ ID NO: 11141 - DNA, 20 bp, Artificial Sequence
  Artificially Synthesized Primer Sequence
ctgtttgagaacgggaccat

SEQ ID NO: 11142 - DNA, 20 bp, Artificial Sequence
  Artificially Synthesized Primer Sequence
catcatcgaacgtaacaccg

SEQ ID NO: 11143 - DNA, 20 bp, Artificial Sequence
  Artificially Synthesized Primer Sequence
tgatgagcaattatcgtcgg

SEQ ID NO: 11144 - DNA, 20 bp, Artificial Sequence
  Artificially Synthesized Primer Sequence
agcccataggtcttcggttt

SEQ ID NO: 11145 - DNA, 20 bp, Artificial Sequence
  Artificially Synthesized Primer Sequence
ttcggcgtttccatatcttc

SEQ ID NO: 11146 - DNA, 20 bp, Artificial Sequence
  Artificially Synthesized Primer Sequence
gaacgggtgaaacggtagaa

SEQ ID NO: 11147 - DNA, 20 bp, Artificial Sequence
  Artificially Synthesized Primer Sequence
actcggggttttgaggaaac

SEQ ID NO: 11148 - DNA, 20 bp, Artificial Sequence
  Artificially Synthesized Primer Sequence
gggatcacgtcgtcaagact

SEQ ID NO: 11149 - DNA, 20 bp, Artificial Sequence
  Artificially Synthesized Primer Sequence
tgaccaaacgtgtgtcctgt

SEQ ID NO: 11150 - DNA, 20 bp, Artificial Sequence
  Artificially Synthesized Primer Sequence
tatcatttctgtcgggctcc

SEQ ID NO: 11151 - DNA, 20 bp, Artificial Sequence
  Artificially Synthesized Primer Sequence
ctcacttgaccaggcacaga

SEQ ID NO: 11152 - DNA, 20 bp, Artificial Sequence
  Artificially Synthesized Primer Sequence
ggtggtgcttaacttgggaa

SEQ ID NO: 11153 - DNA, 20 bp, Artificial Sequence
  Artificially Synthesized Primer Sequence
gtgaccaaacgtgtgtcctg

SEQ ID NO: 11154 - DNA, 20 bp, Artificial Sequence
  Artificially Synthesized Primer Sequence
gcgtgtcccacacattacag

SEQ ID NO: 11155 - DNA, 19 bp, Artificial Sequence
  Artificially Synthesized Primer Sequence
ggttcgaacaattcggctt

SEQ ID NO: 11156 - DNA, 20 bp, Artificial Sequence
  Artificially Synthesized Primer Sequence
tgaagatctgggctttcagc

SEQ ID NO: 11157 - DNA, 20 bp, Artificial Sequence
  Artificially Synthesized Primer Sequence
aattcctcgagcactgttgg

SEQ ID NO: 11158 - DNA, 20 bp, Artificial Sequence
  Artificially Synthesized Primer Sequence
aaacccctcccctcagtaga

SEQ ID NO: 11159 - DNA, 20 bp, Artificial Sequence
  Artificially Synthesized Primer Sequence
attgcgaacaaacttttgcc

SEQ ID NO: 11160 - DNA, 20 bp, Artificial Sequence
  Artificially Synthesized Primer Sequence
actggagggagtgaatggtg

SEQ ID NO: 11161 - DNA, 20 bp, Artificial Sequence
  Artificially Synthesized Primer Sequence
ccgatgtatcagctggaggt

SEQ ID NO: 11162 - DNA, 20 bp, Artificial Sequence
  Artificially Synthesized Primer Sequence
ttagtggcacagtggctgtc

SEQ ID NO: 11163 - DNA, 20 bp, Artificial Sequence
  Artificially Synthesized Primer Sequence
acagtccatccatctctgcc

SEQ ID NO: 11164 - DNA, 20 bp, Artificial Sequence
  Artificially Synthesized Primer Sequence
ggcttgcactgtcatcatca

SEQ ID NO: 11165 - DNA, 20 bp, Artificial Sequence
  Artificially Synthesized Primer Sequence
ttttgcactttggtaatgcg

SEQ ID NO: 11166 - DNA, 20 bp, Artificial Sequence
  Artificially Synthesized Primer Sequence
tgcaattctccagatcatgc

SEQ ID NO: 11167 - DNA, 20 bp, Artificial Sequence
  Artificially Synthesized Primer Sequence
tgcaattctccagatcatgc

SEQ ID NO: 11168 - DNA, 20 bp, Artificial Sequence
  Artificially Synthesized Primer Sequence
gcgaatatgggatttgagga

SEQ ID NO: 11169 - DNA, 20 bp, Artificial Sequence
  Artificially Synthesized Primer Sequence
tgataaggtcagcttgtgcg

SEQ ID NO: 11170 - DNA, 20 bp, Artificial Sequence
  Artificially Synthesized Primer Sequence
caagcttggacggtctcttc

SEQ ID NO: 11171 - DNA, 20 bp, Artificial Sequence
  Artificially Synthesized Primer Sequence
ccattgccctcacttcctaa

SEQ ID NO: 11172 - DNA, 20 bp, Artificial Sequence
  Artificially Synthesized Primer Sequence
cgccactgtgatgaagaaga

SEQ ID NO: 11173 - DNA, 20 bp, Artificial Sequence
  Artificially Synthesized Primer Sequence
tgcaagttttgattcaagcg

SEQ ID NO: 11174 - DNA, 20 bp, Artificial Sequence
  Artificially Synthesized Primer Sequence
acgacgaaataaagaggggg

SEQ ID NO: 11175 - DNA, 20 bp, Artificial Sequence
  Artificially Synthesized Primer Sequence
aggccggttcgtcaacttat

SEQ ID NO: 11176 - DNA, 20 bp, Artificial Sequence
  Artificially Synthesized Primer Sequence
tataacatgttcgtcgccca

SEQ ID NO: 11177 - DNA, 20 bp, Artificial Sequence
  Artificially Synthesized Primer Sequence
cgctaacagcagcaccaata

SEQ ID NO: 11178 - DNA, 20 bp, Artificial Sequence
  Artificially Synthesized Primer Sequence
gccgatgattcaggatgatt

SEQ ID NO: 11179 - DNA, 20 bp, Artificial Sequence
  Artificially Synthesized Primer Sequence
atcccatcttcaccagcaac

SEQ ID NO: 11180 - DNA, 20 bp, Artificial Sequence
  Artificially Synthesized Primer Sequence
ggcttcatgaacctgctgtt

SEQ ID NO: 11181 - DNA, 20 bp, Artificial Sequence
  Artificially Synthesized Primer Sequence
gctactgctgcttagcgtcc

SEQ ID NO: 11182 - DNA, 20 bp, Artificial Sequence
  Artificially Synthesized Primer Sequence
catgttgcgtcagagaagga

SEQ ID NO: 11183 - DNA, 20 bp, Artificial Sequence
  Artificially Synthesized Primer Sequence
aaattacaccgggcattgtg

SEQ ID NO: 11184 - DNA, 20 bp, Artificial Sequence
  Artificially Synthesized Primer Sequence
atgggctgagaaagtccctt

SEQ ID NO: 11185 - DNA, 20 bp, Artificial Sequence
  Artificially Synthesized Primer Sequence
aattcctcgagcactgttgg

SEQ ID NO: 11186 - DNA, 20 bp, Artificial Sequence
  Artificially Synthesized Primer Sequence
tcgtagatggggatccagag

SEQ ID NO: 11187 - DNA, 20 bp, Artificial Sequence
  Artificially Synthesized Primer Sequence
aaccagccattgttgcctac

SEQ ID NO: 11188 - DNA, 20 bp, Artificial Sequence
  Artificially Synthesized Primer Sequence
gtacaggttcaagggcacca

SEQ ID NO: 11189 - DNA, 20 bp, Artificial Sequence
  Artificially Synthesized Primer Sequence
aattgctatgcatgagcgtg

SEQ ID NO: 11190 - DNA, 20 bp, Artificial Sequence
  Artificially Synthesized Primer Sequence
tccagcgtacaatttctccc

SEQ ID NO: 11191 - DNA, 20 bp, Artificial Sequence
  Artificially Synthesized Primer Sequence
aaggggataacattcccagc

SEQ ID NO: 11192 - DNA, 20 bp, Artificial Sequence
  Artificially Synthesized Primer Sequence
gagttgcttcttcaggtcgg

SEQ ID NO: 11193 - DNA, 20 bp, Artificial Sequence
  Artificially Synthesized Primer Sequence
gctttgtcttcgcattagcc

SEQ ID NO: 11194 - DNA, 20 bp, Artificial Sequence
  Artificially Synthesized Primer Sequence
aataacggcttcaatccacg

SEQ ID NO: 11195 - DNA, 20 bp, Artificial Sequence
  Artificially Synthesized Primer Sequence
agctcttgcttcttcttgcg

SEQ ID NO: 11196 - DNA, 20 bp, Artificial Sequence
  Artificially Synthesized Primer Sequence
tgtagccattggagagaccc

SEQ ID NO: 11197 - DNA, 20 bp, Artificial Sequence
  Artificially Synthesized Primer Sequence
attgcttctcttcttgggca

SEQ ID NO: 11198 - DNA, 20 bp, Artificial Sequence
  Artificially Synthesized Primer Sequence
ggattaaaaagcgctgcaag

SEQ ID NO: 11199 - DNA, 20 bp, Artificial Sequence
  Artificially Synthesized Primer Sequence
gcatcgaccttgaagaatcc

SEQ ID NO: 11200 - DNA, 20 bp, Artificial Sequence
  Artificially Synthesized Primer Sequence
cagaggacatgtctttggca

SEQ ID NO: 11201 - DNA, 20 bp, Artificial Sequence
  Artificially Synthesized Primer Sequence
tgttccagatgaagctcgtg

SEQ ID NO: 11202 - DNA, 20 bp, Artificial Sequence
  Artificially Synthesized Primer Sequence
ttactgttcatgtacgccgc

SEQ ID NO: 11203 - DNA, 20 bp, Artificial Sequence
  Artificially Synthesized Primer Sequence
cgacggaaacaagaggaaag

SEQ ID NO: 11204 - DNA, 18 bp, Artificial Sequence
  Artificially Synthesized Primer Sequence
aaatcccggcggaataac

SEQ ID NO: 11205 - DNA, 20 bp, Artificial Sequence
  Artificially Synthesized Primer Sequence
tttccaacttctctccccct

SEQ ID NO: 11206 - DNA, 20 bp, Artificial Sequence
  Artificially Synthesized Primer Sequence
aagaacgaacggctgagaaa

SEQ ID NO: 11207 - DNA, 20 bp, Artificial Sequence
  Artificially Synthesized Primer Sequence
ctggaagatggcctcacagt

SEQ ID NO: 11208 - DNA, 19 bp, Artificial Sequence
  Artificially Synthesized Primer Sequence
gttcgatcaccgcatgtgt

SEQ ID NO: 11209 - DNA, 20 bp, Artificial Sequence
  Artificially Synthesized Primer Sequence
ctcgttttccttccaccctt

SEQ ID NO: 11210 - DNA, 20 bp, Artificial Sequence
  Artificially Synthesized Primer Sequence
gaaggcgatgtccttcatgt

SEQ ID NO: 11211 - DNA, 20 bp, Artificial Sequence
  Artificially Synthesized Primer Sequence
tgtattcgcgggacctttag

SEQ ID NO: 11212 - DNA, 20 bp, Artificial Sequence
  Artificially Synthesized Primer Sequence
ggccttatggaagcaatgaa

SEQ ID NO: 11213 - DNA, 20 bp, Artificial Sequence
  Artificially Synthesized Primer Sequence
ccttttctcgtcaaagctgg

SEQ ID NO: 11214 - DNA, 20 bp, Artificial Sequence
  Artificially Synthesized Primer Sequence
ggggatgaggaaggtctctc

SEQ ID NO: 11215 - DNA, 20 bp, Artificial Sequence
  Artificially Synthesized Primer Sequence
catgcgagattaaccggaag

SEQ ID NO: 11216 - DNA, 20 bp, Artificial Sequence
  Artificially Synthesized Primer Sequence
gatgaaaggtgagctcctcg

SEQ ID NO: 11217 - DNA, 20 bp, Artificial Sequence
  Artificially Synthesized Primer Sequence
caacagcctcctttgctagg

SEQ ID NO: 11218 - DNA, 20 bp, Artificial Sequence
  Artificially Synthesized Primer Sequence
gtttgctcttcgcattcaca

SEQ ID NO: 11219 - DNA, 20 bp, Artificial Sequence
  Artificially Synthesized Primer Sequence
tagccttcgttcgggttatg

SEQ ID NO: 11220 - DNA, 20 bp, Artificial Sequence
  Artificially Synthesized Primer Sequence
agacaggtgcccagaatgac

SEQ ID NO: 11221 - DNA, 20 bp, Artificial Sequence
  Artificially Synthesized Primer Sequence
ggatgaacaaaaagcaggga

SEQ ID NO: 11222 - DNA, 20 bp, Artificial Sequence
  Artificially Synthesized Primer Sequence
ccctatcccacgtaccaatg

SEQ ID NO: 11223 - DNA, 21 bp, Artificial Sequence
  Artificially Synthesized Primer Sequence
cagaaggggaaatagtcaccg

SEQ ID NO: 11224 - DNA, 20 bp, Artificial Sequence
  Artificially Synthesized Primer Sequence
gtgctctacctcggcatcat

SEQ ID NO: 11225 - DNA, 20 bp, Artificial Sequence
  Artificially Synthesized Primer Sequence
ttagctcgacgagatgctga

SEQ ID NO: 11226 - DNA, 20 bp, Artificial Sequence
  Artificially Synthesized Primer Sequence
gcctcttttcatcgccaata

SEQ ID NO: 11227 - DNA, 20 bp, Artificial Sequence
  Artificially Synthesized Primer Sequence
ctgatataaccggggtcacg

SEQ ID NO: 11228 - DNA, 20 bp, Artificial Sequence
  Artificially Synthesized Primer Sequence
cgacaacacagacgcatacc

SEQ ID NO: 11229 - DNA, 20 bp, Artificial Sequence
  Artificially Synthesized Primer Sequence
ttgggaatccatttcagagc

SEQ ID NO: 11230 - DNA, 20 bp, Artificial Sequence
  Artificially Synthesized Primer Sequence
atgttcacccctagctgcac

SEQ ID NO: 11231 - DNA, 20 bp, Artificial Sequence
  Artificially Synthesized Primer Sequence
cttggacgcgttgtactcct

SEQ ID NO: 11232 - DNA, 20 bp, Artificial Sequence
  Artificially Synthesized Primer Sequence
agactgccacgtcacatcag

SEQ ID NO: 11233 - DNA, 20 bp, Artificial Sequence
  Artificially Synthesized Primer Sequence
agaacgtgctggacctcaac

SEQ ID NO: 11234 - DNA, 20 bp, Artificial Sequence
  Artificially Synthesized Primer Sequence
gagaaaccggctgatcgtag

SEQ ID NO: 11235 - DNA, 21 bp, Artificial Sequence
  Artificially Synthesized Primer Sequence
ggcttaaagagcaactgctga

SEQ ID NO: 11236 - DNA, 20 bp, Artificial Sequence
  Artificially Synthesized Primer Sequence
agatcgagagcaaggtggtg

SEQ ID NO: 11237 - DNA, 20 bp, Artificial Sequence
  Artificially Synthesized Primer Sequence
gcacccaaccaagagacaat

SEQ ID NO: 11238 - DNA, 20 bp, Artificial Sequence
  Artificially Synthesized Primer Sequence
ggtgctcctgtaatgccagt

SEQ ID NO: 11239 - DNA, 20 bp, Artificial Sequence
  Artificially Synthesized Primer Sequence
tggcaaaagacaaactgctg

SEQ ID NO: 11240 - DNA, 20 bp, Artificial Sequence
  Artificially Synthesized Primer Sequence
ggctagttgatcgcgtcttc

SEQ ID NO: 11241 - DNA, 20 bp, Artificial Sequence
  Artificially Synthesized Primer Sequence
ctgatgagctcaaggaaggg

SEQ ID NO: 11242 - DNA, 20 bp, Artificial Sequence
  Artificially Synthesized Primer Sequence
ttgccctctctgttcgttct

SEQ ID NO: 11243 - DNA, 20 bp, Artificial Sequence
  Artificially Synthesized Primer Sequence
actcacacacatcactccgc

SEQ ID NO: 11244 - DNA, 20 bp, Artificial Sequence
  Artificially Synthesized Primer Sequence
caaagcttaccttttccccc

SEQ ID NO: 11245 - DNA, 20 bp, Artificial Sequence
  Artificially Synthesized Primer Sequence
cgacgggctcaccatatact

SEQ ID NO: 11246 - DNA, 20 bp, Artificial Sequence
  Artificially Synthesized Primer Sequence
ggtaagctaatggggcaaca

SEQ ID NO: 11247 - DNA, 20 bp, Artificial Sequence
  Artificially Synthesized Primer Sequence
ccctgaactgaaaggctcag

SEQ ID NO: 11248 - DNA, 20 bp, Artificial Sequence
  Artificially Synthesized Primer Sequence
aagcagcagaagtagggcaa

SEQ ID NO: 11249 - DNA, 20 bp, Artificial Sequence
  Artificially Synthesized Primer Sequence
ctgtgctgtgccgtacctta

SEQ ID NO: 11250 - DNA, 20 bp, Artificial Sequence
  Artificially Synthesized Primer Sequence
gagagatcatgcttgtgcca

SEQ ID NO: 11251 - DNA, 20 bp, Artificial Sequence
  Artificially Synthesized Primer Sequence
tttggatcccaatccaattc

SEQ ID NO: 11252 - DNA, 20 bp, Artificial Sequence
  Artificially Synthesized Primer Sequence
accgtgtaccgaaccttttg

SEQ ID NO: 11253 - DNA, 20 bp, Artificial Sequence
  Artificially Synthesized Primer Sequence
ctacaagacctacctcgccg

SEQ ID NO: 11254 - DNA, 20 bp, Artificial Sequence
  Artificially Synthesized Primer Sequence
aaggagagcacgaagatgga

SEQ ID NO: 11255 - DNA, 20 bp, Artificial Sequence
  Artificially Synthesized Primer Sequence
aaaacgaatatgctgctggc

SEQ ID NO: 11256 - DNA, 20 bp, Artificial Sequence
  Artificially Synthesized Primer Sequence
ctcgacaacttcgagtggct

SEQ ID NO: 11257 - DNA, 20 bp, Artificial Sequence
  Artificially Synthesized Primer Sequence
cctggaatccgatgacaagt

SEQ ID NO: 11258 - DNA, 20 bp, Artificial Sequence
  Artificially Synthesized Primer Sequence
aaccgctctcaccaccatac

SEQ ID NO: 11259 - DNA, 20 bp, Artificial Sequence
  Artificially Synthesized Primer Sequence
ttcagacaacggcagacaag

SEQ ID NO: 11260 - DNA, 20 bp, Artificial Sequence
  Artificially Synthesized Primer Sequence
tctgtagagggtttggtggc

SEQ ID NO: 11261 - DNA, 20 bp, Artificial Sequence
  Artificially Synthesized Primer Sequence
ccagatggtgacggaaaagt

SEQ ID NO: 11262 - DNA, 20 bp, Artificial Sequence
  Artificially Synthesized Primer Sequence
ttcgaccctacgtcgtaacc

SEQ ID NO: 11263 - DNA, 20 bp, Artificial Sequence
  Artificially Synthesized Primer Sequence
gacagcatcaggttggttga

SEQ ID NO: 11264 - DNA, 20 bp, Artificial Sequence
  Artificially Synthesized Primer Sequence
tcagccagaagtacgggaac

SEQ ID NO: 11265 - DNA, 20 bp, Artificial Sequence
  Artificially Synthesized Primer Sequence
agtatttgccgaccatccag

SEQ ID NO: 11266 - DNA, 20 bp, Artificial Sequence
  Artificially Synthesized Primer Sequence
cacattcttcgcccttgaat

SEQ ID NO: 11267 - DNA, 20 bp, Artificial Sequence
  Artificially Synthesized Primer Sequence
cacattcttcgcccttgaat

SEQ ID NO: 11268 - DNA, 20 bp, Artificial Sequence
  Artificially Synthesized Primer Sequence
agcaagaatggtttggatgg

SEQ ID NO: 11269 - DNA, 20 bp, Artificial Sequence
  Artificially Synthesized Primer Sequence
gaagaaagctttggcactgg

SEQ ID NO: 11270 - DNA, 20 bp, Artificial Sequence
  Artificially Synthesized Primer Sequence
ttccagaaagacggaacacc

SEQ ID NO: 11271 - DNA, 20 bp, Artificial Sequence
  Artificially Synthesized Primer Sequence
gccaggaaccgaacttcata

SEQ ID NO: 11272 - DNA, 20 bp, Artificial Sequence
  Artificially Synthesized Primer Sequence
agaagctgccaaggaactca

SEQ ID NO: 11273 - DNA, 20 bp, Artificial Sequence
  Artificially Synthesized Primer Sequence
tgtttttgtggcacggaata

SEQ ID NO: 11274 - DNA, 20 bp, Artificial Sequence
  Artificially Synthesized Primer Sequence
tggcaagttaaaataccggc

SEQ ID NO: 11275 - DNA, 20 bp, Artificial Sequence
  Artificially Synthesized Primer Sequence
ccgctcatctcgtctgtgta

SEQ ID NO: 11276 - DNA, 20 bp, Artificial Sequence
  Artificially Synthesized Primer Sequence
acgccatggctctatgctac

SEQ ID NO: 11277 - DNA, 20 bp, Artificial Sequence
  Artificially Synthesized Primer Sequence
gattcaactgcgtccagagg

SEQ ID NO: 11278 - DNA, 20 bp, Artificial Sequence
  Artificially Synthesized Primer Sequence
tagatcgcctccctgatgac

SEQ ID NO: 11279 - DNA, 20 bp, Artificial Sequence
  Artificially Synthesized Primer Sequence
acatcatcaccacgcctaca

SEQ ID NO: 11280 - DNA, 20 bp, Artificial Sequence
  Artificially Synthesized Primer Sequence
tctggatgagcttccaggtc

SEQ ID NO: 11281 - DNA, 20 bp, Artificial Sequence
  Artificially Synthesized Primer Sequence
ctcctccattgagcagaagg

SEQ ID NO: 11282 - DNA, 20 bp, Artificial Sequence
  Artificially Synthesized Primer Sequence
gagaagttgagtgcaagccc

SEQ ID NO: 11283 - DNA, 20 bp, Artificial Sequence
  Artificially Synthesized Primer Sequence
ttcacatagtgcaaccgacc

SEQ ID NO: 11284 - DNA, 20 bp, Artificial Sequence
  Artificially Synthesized Primer Sequence
gggcttgcactcaacttctc

SEQ ID NO: 11285 - DNA, 20 bp, Artificial Sequence
  Artificially Synthesized Primer Sequence
tcttttcaacggggttatgc

SEQ ID NO: 11286 - DNA, 20 bp, Artificial Sequence
  Artificially Synthesized Primer Sequence
gaatcaacggggatagcaga

SEQ ID NO: 11287 - DNA, 20 bp, Artificial Sequence
  Artificially Synthesized Primer Sequence
cacaatgttcccatttgcag

SEQ ID NO: 11288 - DNA, 20 bp, Artificial Sequence
  Artificially Synthesized Primer Sequence
gaaagttgaatcgcacagca

SEQ ID NO: 11289 - DNA, 20 bp, Artificial Sequence
  Artificially Synthesized Primer Sequence
ttgttttaaacgacgagggc

SEQ ID NO: 11290 - DNA, 20 bp, Artificial Sequence
  Artificially Synthesized Primer Sequence
tatggttgggaagacacggt

SEQ ID NO: 11291 - DNA, 21 bp, Artificial Sequence
  Artificially Synthesized Primer Sequence
tccgtcgtcgaagaagataga

SEQ ID NO: 11292 - DNA, 20 bp, Artificial Sequence
  Artificially Synthesized Primer Sequence
gctttggtgttctcctgctc

SEQ ID NO: 11293 - DNA, 20 bp, Artificial Sequence
  Artificially Synthesized Primer Sequence
ctccacttccattctccagc

SEQ ID NO: 11294 - DNA, 20 bp, Artificial Sequence
  Artificially Synthesized Primer Sequence
aatgggtcgaccatcttcag

SEQ ID NO: 11295 - DNA, 20 bp, Artificial Sequence
  Artificially Synthesized Primer Sequence
agcggtggacactagcattt

SEQ ID NO: 11296 - DNA, 20 bp, Artificial Sequence
  Artificially Synthesized Primer Sequence
ctccacttccattctccagc

SEQ ID NO: 11297 - DNA, 20 bp, Artificial Sequence
  Artificially Synthesized Primer Sequence
gccagttctactgcctccac

SEQ ID NO: 11298 - DNA, 20 bp, Artificial Sequence
  Artificially Synthesized Primer Sequence
gcacataatctgctgccaaa

SEQ ID NO: 11299 - DNA, 20 bp, Artificial Sequence
  Artificially Synthesized Primer Sequence
aggcaggcagatacagcaat

SEQ ID NO: 11300 - DNA, 20 bp, Artificial Sequence
  Artificially Synthesized Primer Sequence
gtctcaactgcaagacggtg

SEQ ID NO: 11301 - DNA, 20 bp, Artificial Sequence
  Artificially Synthesized Primer Sequence
gacgggtacaaggtggaaga

SEQ ID NO: 11302 - DNA, 20 bp, Artificial Sequence
  Artificially Synthesized Primer Sequence
atggtgaactgggaacgaag

SEQ ID NO: 11303 - DNA, 20 bp, Artificial Sequence
  Artificially Synthesized Primer Sequence
atggtgaactgggaacgaag

SEQ ID NO: 11304 - DNA, 20 bp, Artificial Sequence
  Artificially Synthesized Primer Sequence
gacgggtacaaggtggaaga

SEQ ID NO: 11305 - DNA, 20 bp, Artificial Sequence
  Artificially Synthesized Primer Sequence
ggacaaggaactgttggcat

SEQ ID NO: 11306 - DNA, 20 bp, Artificial Sequence
  Artificially Synthesized Primer Sequence
caaacccaaggttttgcagt

SEQ ID NO: 11307 - DNA, 20 bp, Artificial Sequence
  Artificially Synthesized Primer Sequence
caacatgagagagcaagcca

SEQ ID NO: 11308 - DNA, 20 bp, Artificial Sequence
  Artificially Synthesized Primer Sequence
ctcgcaaaggaccacctaag

SEQ ID NO: 11309 - DNA, 20 bp, Artificial Sequence
  Artificially Synthesized Primer Sequence
tatcctccgtcttgacctgg

SEQ ID NO: 11310 - DNA, 20 bp, Artificial Sequence
  Artificially Synthesized Primer Sequence
gatcccctgctcctcctatc

SEQ ID NO: 11311 - DNA, 21 bp, Artificial Sequence
  Artificially Synthesized Primer Sequence
agggacaagcacaagtagcaa

SEQ ID NO: 11312 - DNA, 20 bp, Artificial Sequence
  Artificially Synthesized Primer Sequence
gatcactgccttggctccta

SEQ ID NO: 11313 - DNA, 20 bp, Artificial Sequence
  Artificially Synthesized Primer Sequence
gccggtgaagaaacagaaag

SEQ ID NO: 11314 - DNA, 20 bp, Artificial Sequence
  Artificially Synthesized Primer Sequence
aaagcatgcctgagagagga

SEQ ID NO: 11315 - DNA, 20 bp, Artificial Sequence
  Artificially Synthesized Primer Sequence
cggacgagaagaacacaaca

SEQ ID NO: 11316 - DNA, 20 bp, Artificial Sequence
  Artificially Synthesized Primer Sequence
gcttgggcctcctagtttct

SEQ ID NO: 11317 - DNA, 20 bp, Artificial Sequence
  Artificially Synthesized Primer Sequence
gagctcttacatccaagccg

SEQ ID NO: 11318 - DNA, 20 bp, Artificial Sequence
  Artificially Synthesized Primer Sequence
ctgcatcagaaagtttgcca

SEQ ID NO: 11319 - DNA, 20 bp, Artificial Sequence
  Artificially Synthesized Primer Sequence
gcgaaaacccgaaatacaac

SEQ ID NO: 11320 - DNA, 20 bp, Artificial Sequence
  Artificially Synthesized Primer Sequence
ggtaaagcagcaagtgagcc

SEQ ID NO: 11321 - DNA, 20 bp, Artificial Sequence
  Artificially Synthesized Primer Sequence
acaacaagaagcccaccatc

SEQ ID NO: 11322 - DNA, 20 bp, Artificial Sequence
  Artificially Synthesized Primer Sequence
gcaacatgatccacgaactg

SEQ ID NO: 11323 - DNA, 20 bp, Artificial Sequence
  Artificially Synthesized Primer Sequence
cacgcacaaaagaaaatgga

SEQ ID NO: 11324 - DNA, 20 bp, Artificial Sequence
  Artificially Synthesized Primer Sequence
aacaagaagcccaccatcac

SEQ ID NO: 11325 - DNA, 20 bp, Artificial Sequence
  Artificially Synthesized Primer Sequence
gatagggcagttcctctccc

SEQ ID NO: 11326 - DNA, 20 bp, Artificial Sequence
  Artificially Synthesized Primer Sequence
cggcacttcaatcaaaggtt

SEQ ID NO: 11327 - DNA, 20 bp, Artificial Sequence
  Artificially Synthesized Primer Sequence
atcatgctaatggcactccc

SEQ ID NO: 11328 - DNA, 20 bp, Artificial Sequence
  Artificially Synthesized Primer Sequence
aagcacacagaggcgctatt

SEQ ID NO: 11329 - DNA, 20 bp, Artificial Sequence
  Artificially Synthesized Primer Sequence
gtgatggcctgacaaggatt

SEQ ID NO: 11330 - DNA, 20 bp, Artificial Sequence
  Artificially Synthesized Primer Sequence
acaaaacacgcctatcaggg

SEQ ID NO: 11331 - DNA, 20 bp, Artificial Sequence
  Artificially Synthesized Primer Sequence
cgtctcctggtgttccaaat

SEQ ID NO: 11332 - DNA, 20 bp, Artificial Sequence
  Artificially Synthesized Primer Sequence
gcctcaacttccaggacatc

SEQ ID NO: 11333 - DNA, 20 bp, Artificial Sequence
  Artificially Synthesized Primer Sequence
cgggcttggtatcaacctta

SEQ ID NO: 11334 - DNA, 20 bp, Artificial Sequence
  Artificially Synthesized Primer Sequence
gtcgctgatgtctgtctgga

SEQ ID NO: 11335 - DNA, 20 bp, Artificial Sequence
  Artificially Synthesized Primer Sequence
tactagggtggttgccttgg

SEQ ID NO: 11336 - DNA, 20 bp, Artificial Sequence
  Artificially Synthesized Primer Sequence
tccagacagacatcagcgac

SEQ ID NO: 11337 - DNA, 20 bp, Artificial Sequence
  Artificially Synthesized Primer Sequence
ttcagtgagactggtgctgg

SEQ ID NO: 11338 - DNA, 20 bp, Artificial Sequence
  Artificially Synthesized Primer Sequence
gaaagaggtgggtggacaga

SEQ ID NO: 11339 - DNA, 20 bp, Artificial Sequence
  Artificially Synthesized Primer Sequence
acggttgtaaaccaaccacc

SEQ ID NO: 11340 - DNA, 20 bp, Artificial Sequence
  Artificially Synthesized Primer Sequence
cctcaacaggctcgtttctc

SEQ ID NO: 11341 - DNA, 20 bp, Artificial Sequence
  Artificially Synthesized Primer Sequence
cgcgatcaagtacgtcaaga

SEQ ID NO: 11342 - DNA, 20 bp, Artificial Sequence
  Artificially Synthesized Primer Sequence
attttcaccggggaatttct

SEQ ID NO: 11343 - DNA, 20 bp, Artificial Sequence
  Artificially Synthesized Primer Sequence
atgcaagcaaacaagagggt

SEQ ID NO: 11344 - DNA, 20 bp, Artificial Sequence
  Artificially Synthesized Primer Sequence
accatgctgtttcccaaaag

SEQ ID NO: 11345 - DNA, 20 bp, Artificial Sequence
  Artificially Synthesized Primer Sequence
tgaaatgcaaagcgaaactg

SEQ ID NO: 11346 - DNA, 20 bp, Artificial Sequence
  Artificially Synthesized Primer Sequence
aggctgatcttctcgctcag

SEQ ID NO: 11347 - DNA, 20 bp, Artificial Sequence
  Artificially Synthesized Primer Sequence
cgaggggcaaagtaacttca

SEQ ID NO: 11348 - DNA, 20 bp, Artificial Sequence
  Artificially Synthesized Primer Sequence
ggtgtgtggcatttgttgat

SEQ ID NO: 11349 - DNA, 20 bp, Artificial Sequence
  Artificially Synthesized Primer Sequence
gcagttctgcaaaggtgtga

SEQ ID NO: 11350 - DNA, 20 bp, Artificial Sequence
  Artificially Synthesized Primer Sequence
tctgaatcagccaatgcaag

SEQ ID NO: 11351 - DNA, 20 bp, Artificial Sequence
  Artificially Synthesized Primer Sequence
gccctttggcatatgtttct

SEQ ID NO: 11352 - DNA, 20 bp, Artificial Sequence
  Artificially Synthesized Primer Sequence
tgcacaaagaatggaatgga

SEQ ID NO: 11353 - DNA, 20 bp, Artificial Sequence
  Artificially Synthesized Primer Sequence
tgattcctgctatcccaagg

SEQ ID NO: 11354 - DNA, 20 bp, Artificial Sequence
  Artificially Synthesized Primer Sequence
ggttcatcaatggggtcatc

SEQ ID NO: 11355 - DNA, 20 bp, Artificial Sequence
  Artificially Synthesized Primer Sequence
gcaggtccctacgtaccaaa

SEQ ID NO: 11356 - DNA, 20 bp, Artificial Sequence
  Artificially Synthesized Primer Sequence
tgaaaggtcagcatgagcag

SEQ ID NO: 11357 - DNA, 20 bp, Artificial Sequence
  Artificially Synthesized Primer Sequence
tcctattggctggattctgg

SEQ ID NO: 11358 - DNA, 20 bp, Artificial Sequence
  Artificially Synthesized Primer Sequence
cgcatgaatgatgctaccac

SEQ ID NO: 11359 - DNA, 20 bp, Artificial Sequence
  Artificially Synthesized Primer Sequence
cacgtttgcacggtaagcta

SEQ ID NO: 11360 - DNA, 20 bp, Artificial Sequence
  Artificially Synthesized Primer Sequence
gggtaaaccaaccaagcaga

SEQ ID NO: 11361 - DNA, 20 bp, Artificial Sequence
  Artificially Synthesized Primer Sequence
aaaaaccaaaagctcgggat

SEQ ID NO: 11362 - DNA, 20 bp, Artificial Sequence
  Artificially Synthesized Primer Sequence
tacgagccccagacagactt

SEQ ID NO: 11363 - DNA, 20 bp, Artificial Sequence
  Artificially Synthesized Primer Sequence
tggctgtggtccattaaaca

SEQ ID NO: 11364 - DNA, 20 bp, Artificial Sequence
  Artificially Synthesized Primer Sequence
tttttgcccatagcaccatt

SEQ ID NO: 11365 - DNA, 20 bp, Artificial Sequence
  Artificially Synthesized Primer Sequence
caagttctgctccggatagc

SEQ ID NO: 11366 - DNA, 20 bp, Artificial Sequence
  Artificially Synthesized Primer Sequence
cacttattacgcgcctgtga

SEQ ID NO: 11367 - DNA, 20 bp, Artificial Sequence
  Artificially Synthesized Primer Sequence
gctatccggagcagaacttg

SEQ ID NO: 11368 - DNA, 20 bp, Artificial Sequence
  Artificially Synthesized Primer Sequence
atgtcttgggcctgtaccac

SEQ ID NO: 11369 - DNA, 20 bp, Artificial Sequence
  Artificially Synthesized Primer Sequence
gctccttggagaacgtcaac

SEQ ID NO: 11370 - DNA, 20 bp, Artificial Sequence
  Artificially Synthesized Primer Sequence
cttgtttggttgtatggggg

SEQ ID NO: 11371 - DNA, 20 bp, Artificial Sequence
  Artificially Synthesized Primer Sequence
taccaccaaatccatccaca

SEQ ID NO: 11372 - DNA, 20 bp, Artificial Sequence
  Artificially Synthesized Primer Sequence
agttctgaccatgggagctg

SEQ ID NO: 11373 - DNA, 20 bp, Artificial Sequence
  Artificially Synthesized Primer Sequence
ctatcaccaacacgcccttt

SEQ ID NO: 11374 - DNA, 20 bp, Artificial Sequence
  Artificially Synthesized Primer Sequence
cttaggctaggcgaccacag

SEQ ID NO: 11375 - DNA, 20 bp, Artificial Sequence
  Artificially Synthesized Primer Sequence
gcctcttgactgaacgtgaa

SEQ ID NO: 11376 - DNA, 20 bp, Artificial Sequence
  Artificially Synthesized Primer Sequence
ccgcaaggttaaggaactga

SEQ ID NO: 11377 - DNA, 20 bp, Artificial Sequence
  Artificially Synthesized Primer Sequence
agcgaaccaaaaacaacacc

SEQ ID NO: 11378 - DNA, 20 bp, Artificial Sequence
  Artificially Synthesized Primer Sequence
accggaatagcaatacgcac

SEQ ID NO: 11379 - DNA, 20 bp, Artificial Sequence
  Artificially Synthesized Primer Sequence
ctcggacagtgtggtgaatg

SEQ ID NO: 11380 - DNA, 20 bp, Artificial Sequence
  Artificially Synthesized Primer Sequence
cggcctggtagtgatggtat

SEQ ID NO: 11381 - DNA, 20 bp, Artificial Sequence
  Artificially Synthesized Primer Sequence
ggacaagcagaaggcagttc

SEQ ID NO: 11382 - DNA, 20 bp, Artificial Sequence
  Artificially Synthesized Primer Sequence
tatgtggtccaccttgcaga

SEQ ID NO: 11383 - DNA, 20 bp, Artificial Sequence
  Artificially Synthesized Primer Sequence
gcttcctgcaagaaaaagga

SEQ ID NO: 11384 - DNA, 20 bp, Artificial Sequence
  Artificially Synthesized Primer Sequence
aacaattcccaacaatcgga

SEQ ID NO: 11385 - DNA, 20 bp, Artificial Sequence
  Artificially Synthesized Primer Sequence
ggttcttctcagcaggttgc

SEQ ID NO: 11386 - DNA, 20 bp, Artificial Sequence
  Artificially Synthesized Primer Sequence
gattgatgcccctctgtgat

SEQ ID NO: 11387 - DNA, 20 bp, Artificial Sequence
  Artificially Synthesized Primer Sequence
tccagtccatggttgacaga

SEQ ID NO: 11388 - DNA, 20 bp, Artificial Sequence
  Artificially Synthesized Primer Sequence
gacaagcatgatggcttcaa

SEQ ID NO: 11389 - DNA, 20 bp, Artificial Sequence
  Artificially Synthesized Primer Sequence
tccattcttctctcccctca

SEQ ID NO: 11390 - DNA, 20 bp, Artificial Sequence
  Artificially Synthesized Primer Sequence
gcgggtgtaacagacgaaat

SEQ ID NO: 11391 - DNA, 20 bp, Artificial Sequence
  Artificially Synthesized Primer Sequence
tttttccacggcacaaaagt

SEQ ID NO: 11392 - DNA, 20 bp, Artificial Sequence
  Artificially Synthesized Primer Sequence
tagattgtcaactgtgccgc

SEQ ID NO: 11393 - DNA, 20 bp, Artificial Sequence
  Artificially Synthesized Primer Sequence
ggcttgctgtgggtttatgt

SEQ ID NO: 11394 - DNA, 20 bp, Artificial Sequence
  Artificially Synthesized Primer Sequence
cactgatttgcaagaagcca

SEQ ID NO: 11395 - DNA, 20 bp, Artificial Sequence
  Artificially Synthesized Primer Sequence
ctaccggcgatgttcttcat

SEQ ID NO: 11396 - DNA, 20 bp, Artificial Sequence
  Artificially Synthesized Primer Sequence
gaaccaagtttggcaggaaa

SEQ ID NO: 11397 - DNA, 20 bp, Artificial Sequence
  Artificially Synthesized Primer Sequence
atttgaagaatttgcccgtg

SEQ ID NO: 11398 - DNA, 20 bp, Artificial Sequence
  Artificially Synthesized Primer Sequence
aaagcttggaaatgtggtgg

SEQ ID NO: 11399 - DNA, 20 bp, Artificial Sequence
  Artificially Synthesized Primer Sequence
tagcagcccaccctaagcta

SEQ ID NO: 11400 - DNA, 20 bp, Artificial Sequence
  Artificially Synthesized Primer Sequence
gactttcgaggaggcagaca

SEQ ID NO: 11401 - DNA, 20 bp, Artificial Sequence
  Artificially Synthesized Primer Sequence
gaatggctgaacctgcaaat

SEQ ID NO: 11402 - DNA, 20 bp, Artificial Sequence
  Artificially Synthesized Primer Sequence
tagaagctggcttggaagga

SEQ ID NO: 11403 - DNA, 20 bp, Artificial Sequence
  Artificially Synthesized Primer Sequence
aactccaacagtcccgtcac

SEQ ID NO: 11404 - DNA, 20 bp, Artificial Sequence
  Artificially Synthesized Primer Sequence
aattcagacaagtcgggtgg

SEQ ID NO: 11405 - DNA, 20 bp, Artificial Sequence
  Artificially Synthesized Primer Sequence
acgaggaagaaacctgctga

SEQ ID NO: 11406 - DNA, 20 bp, Artificial Sequence
  Artificially Synthesized Primer Sequence
ctaccacctcctctcttgcg

SEQ ID NO: 11407 - DNA, 20 bp, Artificial Sequence
  Artificially Synthesized Primer Sequence
tttgctctatgccgtgactg

SEQ ID NO: 11408 - DNA, 20 bp, Artificial Sequence
  Artificially Synthesized Primer Sequence
atcaccatccaaaggttcca

SEQ ID NO: 11409 - DNA, 20 bp, Artificial Sequence
  Artificially Synthesized Primer Sequence
aaagtggatgctttgatgcc

SEQ ID NO: 11410 - DNA, 20 bp, Artificial Sequence
  Artificially Synthesized Primer Sequence
cttaggaggagggtcgcttt

SEQ ID NO: 11411 - DNA, 20 bp, Artificial Sequence
  Artificially Synthesized Primer Sequence
ttcccatgaaaaattgctcc

SEQ ID NO: 11412 - DNA, 20 bp, Artificial Sequence
  Artificially Synthesized Primer Sequence
tagcctgggacagagttgct

SEQ ID NO: 11413 - DNA, 20 bp, Artificial Sequence
  Artificially Synthesized Primer Sequence
taacttaacaccccaagcgg

SEQ ID NO: 11414 - DNA, 20 bp, Artificial Sequence
  Artificially Synthesized Primer Sequence
ttccgagagttcagcaacct

SEQ ID NO: 11415 - DNA, 20 bp, Artificial Sequence
  Artificially Synthesized Primer Sequence
atgcctgtccagtatccacc

SEQ ID NO: 11416 - DNA, 20 bp, Artificial Sequence
  Artificially Synthesized Primer Sequence
atcggttagagctggcacac

SEQ ID NO: 11417 - DNA, 20 bp, Artificial Sequence
  Artificially Synthesized Primer Sequence
atgcaagtatgccatcgtga

SEQ ID NO: 11418 - DNA, 20 bp, Artificial Sequence
  Artificially Synthesized Primer Sequence
tatgtgcacgtaatcgggaa

SEQ ID NO: 11419 - DNA, 20 bp, Artificial Sequence
  Artificially Synthesized Primer Sequence
tcggaagtacagggaccaac

SEQ ID NO: 11420 - DNA, 20 bp, Artificial Sequence
  Artificially Synthesized Primer Sequence
gtacgaggagcctgaacagc

SEQ ID NO: 11421 - DNA, 20 bp, Artificial Sequence
  Artificially Synthesized Primer Sequence
agctcgagaagctcaagcac

SEQ ID NO: 11422 - DNA, 20 bp, Artificial Sequence
  Artificially Synthesized Primer Sequence
ttccatgagttggttctccc

SEQ ID NO: 11423 - DNA, 20 bp, Artificial Sequence
  Artificially Synthesized Primer Sequence
aaagatgggttcactttgcc

SEQ ID NO: 11424 - DNA, 19 bp, Artificial Sequence
  Artificially Synthesized Primer Sequence
gaacgacatcgacctgctg

SEQ ID NO: 11425 - DNA, 20 bp, Artificial Sequence
  Artificially Synthesized Primer Sequence
taccaccaccaaaacagcaa

SEQ ID NO: 11426 - DNA, 20 bp, Artificial Sequence
  Artificially Synthesized Primer Sequence
tacacacagcacgtgcaaaa

SEQ ID NO: 11427 - DNA, 20 bp, Artificial Sequence
  Artificially Synthesized Primer Sequence
tacacacagcacgtgcaaaa

SEQ ID NO: 11428 - DNA, 20 bp, Artificial Sequence
  Artificially Synthesized Primer Sequence
taccaccaccaaaacagcaa

SEQ ID NO: 11429 - DNA, 20 bp, Artificial Sequence
  Artificially Synthesized Primer Sequence
cgctactggttggatttggt

SEQ ID NO: 11430 - DNA, 20 bp, Artificial Sequence
  Artificially Synthesized Primer Sequence
aactccgatgattttccgtg

SEQ ID NO: 11431 - DNA, 20 bp, Artificial Sequence
  Artificially Synthesized Primer Sequence
aactccgatgattttccgtg

SEQ ID NO: 11432 - DNA, 20 bp, Artificial Sequence
  Artificially Synthesized Primer Sequence
cgctactggttggatttggt

SEQ ID NO: 11433 - DNA, 20 bp, Artificial Sequence
  Artificially Synthesized Primer Sequence
ggatgcttagcgagaaggtg

SEQ ID NO: 11434 - DNA, 20 bp, Artificial Sequence
  Artificially Synthesized Primer Sequence
atggttggcatatgcactga

SEQ ID NO: 11435 - DNA, 20 bp, Artificial Sequence
  Artificially Synthesized Primer Sequence
atgatggctcttcttcccct

SEQ ID NO: 11436 - DNA, 20 bp, Artificial Sequence
  Artificially Synthesized Primer Sequence
acgctcactgcggttctagt

SEQ ID NO: 11437 - DNA, 20 bp, Artificial Sequence
  Artificially Synthesized Primer Sequence
aggaaggcatggttgatgag

SEQ ID NO: 11438 - DNA, 20 bp, Artificial Sequence
  Artificially Synthesized Primer Sequence
acatgtttccgcaatgaaca

SEQ ID NO: 11439 - DNA, 20 bp, Artificial Sequence
  Artificially Synthesized Primer Sequence
acatgtttccgcaatgaaca

SEQ ID NO: 11440 - DNA, 20 bp, Artificial Sequence
  Artificially Synthesized Primer Sequence
aggaaggcatggttgatgag

SEQ ID NO: 11441 - DNA, 20 bp, Artificial Sequence
  Artificially Synthesized Primer Sequence
gacgtcagccatcctgattt

SEQ ID NO: 11442 - DNA, 20 bp, Artificial Sequence
  Artificially Synthesized Primer Sequence
ttggattcccagaccaagag

SEQ ID NO: 11443 - DNA, 20 bp, Artificial Sequence
  Artificially Synthesized Primer Sequence
tatgctccaaacaatgggtg

SEQ ID NO: 11444 - DNA, 20 bp, Artificial Sequence
  Artificially Synthesized Primer Sequence
atattgccaaagcgctgtct

SEQ ID NO: 11445 - DNA, 20 bp, Artificial Sequence
  Artificially Synthesized Primer Sequence
ggggcactcctgtatagcaa

SEQ ID NO: 11446 - DNA, 20 bp, Artificial Sequence
  Artificially Synthesized Primer Sequence
taagggggataattggggag

SEQ ID NO: 11447 - DNA, 20 bp, Artificial Sequence
  Artificially Synthesized Primer Sequence
gagtgccccaccaaagaata

SEQ ID NO: 11448 - DNA, 20 bp, Artificial Sequence
  Artificially Synthesized Primer Sequence
gagcacggctgttccttatc

SEQ ID NO: 11449 - DNA, 20 bp, Artificial Sequence
  Artificially Synthesized Primer Sequence
ccctccttttcctttccaag

SEQ ID NO: 11450 - DNA, 20 bp, Artificial Sequence
  Artificially Synthesized Primer Sequence
tgtctcattccgaggcttct

SEQ ID NO: 11451 - DNA, 20 bp, Artificial Sequence
  Artificially Synthesized Primer Sequence
acacatggagcaacacggta

SEQ ID NO: 11452 - DNA, 20 bp, Artificial Sequence
  Artificially Synthesized Primer Sequence
tgagtatcaaccccctccag

SEQ ID NO: 11453 - DNA, 20 bp, Artificial Sequence
  Artificially Synthesized Primer Sequence
caggagtttctcgcaaggac

SEQ ID NO: 11454 - DNA, 20 bp, Artificial Sequence
  Artificially Synthesized Primer Sequence
caggcggttgaccatagttt

SEQ ID NO: 11455 - DNA, 20 bp, Artificial Sequence
  Artificially Synthesized Primer Sequence
atcggaagccccttgtaagt

SEQ ID NO: 11456 - DNA, 20 bp, Artificial Sequence
  Artificially Synthesized Primer Sequence
gagtttctcgcaaggacagg

SEQ ID NO: 11457 - DNA, 20 bp, Artificial Sequence
  Artificially Synthesized Primer Sequence
tctgtcaacacgagctgtcc

SEQ ID NO: 11458 - DNA, 20 bp, Artificial Sequence
  Artificially Synthesized Primer Sequence
gaatgagggcgtgtaaagga

SEQ ID NO: 11459 - DNA, 20 bp, Artificial Sequence
  Artificially Synthesized Primer Sequence
aaatactgggctgaaggggt

SEQ ID NO: 11460 - DNA, 20 bp, Artificial Sequence
  Artificially Synthesized Primer Sequence
catcagctgttggtcgctta

SEQ ID NO: 11461 - DNA, 20 bp, Artificial Sequence
  Artificially Synthesized Primer Sequence
aagtctgcggagagcaacat

SEQ ID NO: 11462 - DNA, 20 bp, Artificial Sequence
  Artificially Synthesized Primer Sequence
cgttcaggtcaacaccaatg

SEQ ID NO: 11463 - DNA, 20 bp, Artificial Sequence
  Artificially Synthesized Primer Sequence
gtcccagaagattcagccaa

SEQ ID NO: 11464 - DNA, 20 bp, Artificial Sequence
  Artificially Synthesized Primer Sequence
ctaggcgtcctcctcaagtg

SEQ ID NO: 11465 - DNA, 20 bp, Artificial Sequence
  Artificially Synthesized Primer Sequence
ccctctttttgcttcaaacg

SEQ ID NO: 11466 - DNA, 20 bp, Artificial Sequence
  Artificially Synthesized Primer Sequence
ccttaatgaattcccggtca

SEQ ID NO: 11467 - DNA, 20 bp, Artificial Sequence
  Artificially Synthesized Primer Sequence
ccttaatgaattcccggtca

SEQ ID NO: 11468 - DNA, 20 bp, Artificial Sequence
  Artificially Synthesized Primer Sequence
ccctctttttgcttcaaacg

SEQ ID NO: 11469 - DNA, 20 bp, Artificial Sequence
  Artificially Synthesized Primer Sequence
cgggcatgctgtaaaggtat

SEQ ID NO: 11470 - DNA, 20 bp, Artificial Sequence
  Artificially Synthesized Primer Sequence
gaagggcgttgatgactgat

SEQ ID NO: 11471 - DNA, 20 bp, Artificial Sequence
  Artificially Synthesized Primer Sequence
tggatgtccgtttggaactt

SEQ ID NO: 11472 - DNA, 19 bp, Artificial Sequence
  Artificially Synthesized Primer Sequence
cccaaggggtgcatgtagt

SEQ ID NO: 11473 - DNA, 20 bp, Artificial Sequence
  Artificially Synthesized Primer Sequence
gtcgaccaggcaccacttat

SEQ ID NO: 11474 - DNA, 20 bp, Artificial Sequence
  Artificially Synthesized Primer Sequence
cgaagtacagggtcgggtaa

SEQ ID NO: 11475 - DNA, 20 bp, Artificial Sequence
  Artificially Synthesized Primer Sequence
aaatctggcgttggaatctg

SEQ ID NO: 11476 - DNA, 20 bp, Artificial Sequence
  Artificially Synthesized Primer Sequence
gcaagaagctagcacccatc

SEQ ID NO: 11477 - DNA, 20 bp, Artificial Sequence
  Artificially Synthesized Primer Sequence
acccgtccgagtcacactac

SEQ ID NO: 11478 - DNA, 20 bp, Artificial Sequence
  Artificially Synthesized Primer Sequence
gctgagctccatgttcttcc

SEQ ID NO: 11479 - DNA, 20 bp, Artificial Sequence
  Artificially Synthesized Primer Sequence
tcctagcctgtatttcgcgt

SEQ ID NO: 11480 - DNA, 20 bp, Artificial Sequence
  Artificially Synthesized Primer Sequence
caaggtgcttagcaaggagg

SEQ ID NO: 11481 - DNA, 20 bp, Artificial Sequence
  Artificially Synthesized Primer Sequence
ggggattataacccttggga

SEQ ID NO: 11482 - DNA, 20 bp, Artificial Sequence
  Artificially Synthesized Primer Sequence
cccccaatttttccgagtat

SEQ ID NO: 11483 - DNA, 20 bp, Artificial Sequence
  Artificially Synthesized Primer Sequence
ttggtacctaactggcagca

SEQ ID NO: 11484 - DNA, 20 bp, Artificial Sequence
  Artificially Synthesized Primer Sequence
gcacagtttcaggcaggatt

SEQ ID NO: 11485 - DNA, 20 bp, Artificial Sequence
  Artificially Synthesized Primer Sequence
agagctccacacgaaggaaa

SEQ ID NO: 11486 - DNA, 20 bp, Artificial Sequence
  Artificially Synthesized Primer Sequence
aagaggaagtagggcttggc

SEQ ID NO: 11487 - DNA, 20 bp, Artificial Sequence
  Artificially Synthesized Primer Sequence
taccccaaaatcctctgcac

SEQ ID NO: 11488 - DNA, 20 bp, Artificial Sequence
  Artificially Synthesized Primer Sequence
aatctacggcctcatcatcg

SEQ ID NO: 11489 - DNA, 20 bp, Artificial Sequence
  Artificially Synthesized Primer Sequence
caaggtgcttagcaaggagg

SEQ ID NO: 11490 - DNA, 20 bp, Artificial Sequence
  Artificially Synthesized Primer Sequence
tcctagcctgtatttcgcgt

SEQ ID NO: 11491 - DNA, 20 bp, Artificial Sequence
  Artificially Synthesized Primer Sequence
tgcgattgttgtgttcacct

SEQ ID NO: 11492 - DNA, 20 bp, Artificial Sequence
  Artificially Synthesized Primer Sequence
cctcgtcagtactccccatc

SEQ ID NO: 11493 - DNA, 20 bp, Artificial Sequence
  Artificially Synthesized Primer Sequence
gtgaagaaggaagagcggtg

SEQ ID NO: 11494 - DNA, 20 bp, Artificial Sequence
  Artificially Synthesized Primer Sequence
caatgtgggtgttgttagcg

SEQ ID NO: 11495 - DNA, 20 bp, Artificial Sequence
  Artificially Synthesized Primer Sequence
aggcgtcctatggacacaac

SEQ ID NO: 11496 - DNA, 20 bp, Artificial Sequence
  Artificially Synthesized Primer Sequence
ccctcgacacgaccatctat

SEQ ID NO: 11497 - DNA, 20 bp, Artificial Sequence
  Artificially Synthesized Primer Sequence
aattcgcaagcagcaagaat

SEQ ID NO: 11498 - DNA, 20 bp, Artificial Sequence
  Artificially Synthesized Primer Sequence
gagttttggtaaccagcgga

SEQ ID NO: 11499 - DNA, 21 bp, Artificial Sequence
  Artificially Synthesized Primer Sequence
cctcacatgacaaaattgcct

SEQ ID NO: 11500 - DNA, 20 bp, Artificial Sequence
  Artificially Synthesized Primer Sequence
gtgacaggagatggggaaga

SEQ ID NO: 11501 - DNA, 20 bp, Artificial Sequence
  Artificially Synthesized Primer Sequence
taggctcgcctgcacttaat

SEQ ID NO: 11502 - DNA, 20 bp, Artificial Sequence
  Artificially Synthesized Primer Sequence
agcgcagtataccggagaga

SEQ ID NO: 11503 - DNA, 20 bp, Artificial Sequence
  Artificially Synthesized Primer Sequence
caaatcgtctttccttccca

SEQ ID NO: 11504 - DNA, 20 bp, Artificial Sequence
  Artificially Synthesized Primer Sequence
tgctcgacaaggatgtcaac

SEQ ID NO: 11505 - DNA, 20 bp, Artificial Sequence
  Artificially Synthesized Primer Sequence
acgaggcttctttctgacca

SEQ ID NO: 11506 - DNA, 20 bp, Artificial Sequence
  Artificially Synthesized Primer Sequence
tggtcccttacttgggacag

SEQ ID NO: 11507 - DNA, 20 bp, Artificial Sequence
  Artificially Synthesized Primer Sequence
catgcgggaatcgataatct

SEQ ID NO: 11508 - DNA, 20 bp, Artificial Sequence
  Artificially Synthesized Primer Sequence
ttcccttattccaaatcccc

SEQ ID NO: 11509 - DNA, 20 bp, Artificial Sequence
  Artificially Synthesized Primer Sequence
acaaaacgacaccctggaag

SEQ ID NO: 11510 - DNA, 20 bp, Artificial Sequence
  Artificially Synthesized Primer Sequence
gggtcgtccatgagaacagt

SEQ ID NO: 11511 - DNA, 20 bp, Artificial Sequence
  Artificially Synthesized Primer Sequence
gtgccacttccaatctgctc

SEQ ID NO: 11512 - DNA, 20 bp, Artificial Sequence
  Artificially Synthesized Primer Sequence
gttgtcgccctaggcttgta

SEQ ID NO: 11513 - DNA, 20 bp, Artificial Sequence
  Artificially Synthesized Primer Sequence
gcactggcactagcaatgaa

SEQ ID NO: 11514 - DNA, 20 bp, Artificial Sequence
  Artificially Synthesized Primer Sequence
ctcctgcacagaacacgaaa

SEQ ID NO: 11515 - DNA, 20 bp, Artificial Sequence
  Artificially Synthesized Primer Sequence
tgtacgcaccatgccatatt

SEQ ID NO: 11516 - DNA, 20 bp, Artificial Sequence
  Artificially Synthesized Primer Sequence
ttattttgggacggatggag

SEQ ID NO: 11517 - DNA, 20 bp, Artificial Sequence
  Artificially Synthesized Primer Sequence
cgtcacaattcctccgatct

SEQ ID NO: 11518 - DNA, 20 bp, Artificial Sequence
  Artificially Synthesized Primer Sequence
gtccactgcagctttgatga

SEQ ID NO: 11519 - DNA, 20 bp, Artificial Sequence
  Artificially Synthesized Primer Sequence
cgtcacaattcctccgatct

SEQ ID NO: 11520 - DNA, 20 bp, Artificial Sequence
  Artificially Synthesized Primer Sequence
tcttgacgaccttgatggtg

SEQ ID NO: 11521 - DNA, 20 bp, Artificial Sequence
  Artificially Synthesized Primer Sequence
atgccgttgatcctaacagg

SEQ ID NO: 11522 - DNA, 20 bp, Artificial Sequence
  Artificially Synthesized Primer Sequence
gttcaagttggccttgtggt

SEQ ID NO: 11523 - DNA, 20 bp, Artificial Sequence
  Artificially Synthesized Primer Sequence
acagcgtgggtacaaacaca

SEQ ID NO: 11524 - DNA, 20 bp, Artificial Sequence
  Artificially Synthesized Primer Sequence
ggcctgatgtttccacagtt

SEQ ID NO: 11525 - DNA, 20 bp, Artificial Sequence
  Artificially Synthesized Primer Sequence
accctcgaagacagagcaaa

SEQ ID NO: 11526 - DNA, 20 bp, Artificial Sequence
  Artificially Synthesized Primer Sequence
atgcttcttccctgtccctt

SEQ ID NO: 11527 - DNA, 20 bp, Artificial Sequence
  Artificially Synthesized Primer Sequence
tcgtgtgaaggacgaaaaca

SEQ ID NO: 11528 - DNA, 20 bp, Artificial Sequence
  Artificially Synthesized Primer Sequence
aagggacagggaagaagcat

SEQ ID NO: 11529 - DNA, 20 bp, Artificial Sequence
  Artificially Synthesized Primer Sequence
accttcttctgctccgacaa

SEQ ID NO: 11530 - DNA, 20 bp, Artificial Sequence
  Artificially Synthesized Primer Sequence
ggcaacaggttcaccaactt

SEQ ID NO: 11531 - DNA, 20 bp, Artificial Sequence
  Artificially Synthesized Primer Sequence
cacaaagtgcaagctccaaa

SEQ ID NO: 11532 - DNA, 20 bp, Artificial Sequence
  Artificially Synthesized Primer Sequence
gaaaccagttcctcccacaa

SEQ ID NO: 11533 - DNA, 20 bp, Artificial Sequence
  Artificially Synthesized Primer Sequence
cgtagcgaagagcatcatca

SEQ ID NO: 11534 - DNA, 20 bp, Artificial Sequence
  Artificially Synthesized Primer Sequence
tccctataaggggaattggg

SEQ ID NO: 11535 - DNA, 20 bp, Artificial Sequence
  Artificially Synthesized Primer Sequence
acgtgtaaatcgcagcatca

SEQ ID NO: 11536 - DNA, 20 bp, Artificial Sequence
  Artificially Synthesized Primer Sequence
ctactgccacgtcgaggtct

SEQ ID NO: 11537 - DNA, 20 bp, Artificial Sequence
  Artificially Synthesized Primer Sequence
ctcgcctctaccttccactg

SEQ ID NO: 11538 - DNA, 20 bp, Artificial Sequence
  Artificially Synthesized Primer Sequence
ggcaaaccaactggacttgt

SEQ ID NO: 11539 - DNA, 20 bp, Artificial Sequence
  Artificially Synthesized Primer Sequence
tggcaaatttggttgacaga

SEQ ID NO: 11540 - DNA, 20 bp, Artificial Sequence
  Artificially Synthesized Primer Sequence
aagcagaagacctcgtggaa

SEQ ID NO: 11541 - DNA, 20 bp, Artificial Sequence
  Artificially Synthesized Primer Sequence
ggtgtcgttgggaagtttgt

SEQ ID NO: 11542 - DNA, 20 bp, Artificial Sequence
  Artificially Synthesized Primer Sequence
gctttatctttgctggcgtc

SEQ ID NO: 11543 - DNA, 20 bp, Artificial Sequence
  Artificially Synthesized Primer Sequence
gacgagacgactccacacac

SEQ ID NO: 11544 - DNA, 20 bp, Artificial Sequence
  Artificially Synthesized Primer Sequence
tcttctccaccacgaacctc

SEQ ID NO: 11545 - DNA, 20 bp, Artificial Sequence
  Artificially Synthesized Primer Sequence
ggggctgggaagaattaaga

SEQ ID NO: 11546 - DNA, 20 bp, Artificial Sequence
  Artificially Synthesized Primer Sequence
tcgcaccctttaagcatttt

SEQ ID NO: 11547 - DNA, 20 bp, Artificial Sequence
  Artificially Synthesized Primer Sequence
ggctaaccggtttctccttc

SEQ ID NO: 11548 - DNA, 20 bp, Artificial Sequence
  Artificially Synthesized Primer Sequence
cccccaacaaacacactacc

SEQ ID NO: 11549 - DNA, 20 bp, Artificial Sequence
  Artificially Synthesized Primer Sequence
ccaacagctcttccttctcg

SEQ ID NO: 11550 - DNA, 20 bp, Artificial Sequence
  Artificially Synthesized Primer Sequence
gcgtactctgggagtcttcg

SEQ ID NO: 11551 - DNA, 20 bp, Artificial Sequence
  Artificially Synthesized Primer Sequence
tggaagacgatggaacacag

SEQ ID NO: 11552 - DNA, 20 bp, Artificial Sequence
  Artificially Synthesized Primer Sequence
atgtgtcggtgctagtgcaa

SEQ ID NO: 11553 - DNA, 20 bp, Artificial Sequence
  Artificially Synthesized Primer Sequence
ttcgataaggaccagaacgg

SEQ ID NO: 11554 - DNA, 20 bp, Artificial Sequence
  Artificially Synthesized Primer Sequence
tttcaatgacacacgggaga

SEQ ID NO: 11555 - DNA, 20 bp, Artificial Sequence
  Artificially Synthesized Primer Sequence
tttcaatgacacacgggaga

SEQ ID NO: 11556 - DNA, 20 bp, Artificial Sequence
  Artificially Synthesized Primer Sequence
ttcgataaggaccagaacgg

SEQ ID NO: 11557 - DNA, 20 bp, Artificial Sequence
  Artificially Synthesized Primer Sequence
aacatcatccacgcaacaaa

SEQ ID NO: 11558 - DNA, 20 bp, Artificial Sequence
  Artificially Synthesized Primer Sequence
acatggagttctcctgtgcc

SEQ ID NO: 11559 - DNA, 20 bp, Artificial Sequence
  Artificially Synthesized Primer Sequence
aggaaaaatgtcagcccgta

SEQ ID NO: 11560 - DNA, 20 bp, Artificial Sequence
  Artificially Synthesized Primer Sequence
acaatgtggtctcctttggc

SEQ ID NO: 11561 - DNA, 20 bp, Artificial Sequence
  Artificially Synthesized Primer Sequence
cttctgctttctcgtccacc

SEQ ID NO: 11562 - DNA, 20 bp, Artificial Sequence
  Artificially Synthesized Primer Sequence
aaccttgatgttggggagtg

SEQ ID NO: 11563 - DNA, 20 bp, Artificial Sequence
  Artificially Synthesized Primer Sequence
cggcgatgaatcaaaaagtt

SEQ ID NO: 11564 - DNA, 20 bp, Artificial Sequence
  Artificially Synthesized Primer Sequence
ggcagtccatcgacttcttc

SEQ ID NO: 11565 - DNA, 20 bp, Artificial Sequence
  Artificially Synthesized Primer Sequence
aaggacaccgcaggtttatg

SEQ ID NO: 11566 - DNA, 20 bp, Artificial Sequence
  Artificially Synthesized Primer Sequence
ccagccctctataccgatca

SEQ ID NO: 11567 - DNA, 20 bp, Artificial Sequence
  Artificially Synthesized Primer Sequence
tttatcaagcctctgggtgg

SEQ ID NO: 11568 - DNA, 20 bp, Artificial Sequence
  Artificially Synthesized Primer Sequence
tgggcctgctagaaagagaa

SEQ ID NO: 11569 - DNA, 20 bp, Artificial Sequence
  Artificially Synthesized Primer Sequence
gtgacctctgctaccttggc

SEQ ID NO: 11570 - DNA, 20 bp, Artificial Sequence
  Artificially Synthesized Primer Sequence
agtcccatgcaaatctggac

SEQ ID NO: 11571 - DNA, 20 bp, Artificial Sequence
  Artificially Synthesized Primer Sequence
cccacccgttgttcactact

SEQ ID NO: 11572 - DNA, 20 bp, Artificial Sequence
  Artificially Synthesized Primer Sequence
agtccagatttgcatgggac

SEQ ID NO: 11573 - DNA, 20 bp, Artificial Sequence
  Artificially Synthesized Primer Sequence
actgacaggaaatggcgaac

SEQ ID NO: 11574 - DNA, 20 bp, Artificial Sequence
  Artificially Synthesized Primer Sequence
cttttctgcaccttccaagc

SEQ ID NO: 11575 - DNA, 20 bp, Artificial Sequence
  Artificially Synthesized Primer Sequence
gtgcatagtgctggtcctca

SEQ ID NO: 11576 - DNA, 20 bp, Artificial Sequence
  Artificially Synthesized Primer Sequence
ctgactgcaccacatgcttt

SEQ ID NO: 11577 - DNA, 20 bp, Artificial Sequence
  Artificially Synthesized Primer Sequence
agagtctcgaagggcaatga

SEQ ID NO: 11578 - DNA, 20 bp, Artificial Sequence
  Artificially Synthesized Primer Sequence
acgtcgtgatgtcgagagtg

SEQ ID NO: 11579 - DNA, 20 bp, Artificial Sequence
  Artificially Synthesized Primer Sequence
tatcttgtgcaataggcccc

SEQ ID NO: 11580 - DNA, 20 bp, Artificial Sequence
  Artificially Synthesized Primer Sequence
tcatgagccaattccatgtg

SEQ ID NO: 11581 - DNA, 20 bp, Artificial Sequence
  Artificially Synthesized Primer Sequence
ggttttcaccgtgtgctttt

SEQ ID NO: 11582 - DNA, 20 bp, Artificial Sequence
  Artificially Synthesized Primer Sequence
aggtttgcatgttgccctac

SEQ ID NO: 11583 - DNA, 20 bp, Artificial Sequence
  Artificially Synthesized Primer Sequence
tcgggttttcattggaagag

SEQ ID NO: 11584 - DNA, 20 bp, Artificial Sequence
  Artificially Synthesized Primer Sequence
tgagtccaggaaattcaccc

SEQ ID NO: 11585 - DNA, 20 bp, Artificial Sequence
  Artificially Synthesized Primer Sequence
gggaatattcgtgtggatgg

SEQ ID NO: 11586 - DNA, 20 bp, Artificial Sequence
  Artificially Synthesized Primer Sequence
gcgagtcagttcgtcaacaa

SEQ ID NO: 11587 - DNA, 20 bp, Artificial Sequence
  Artificially Synthesized Primer Sequence
ccaagtggctcatcatcaaa

SEQ ID NO: 11588 - DNA, 20 bp, Artificial Sequence
  Artificially Synthesized Primer Sequence
atacaggcaaaattcggtgc

SEQ ID NO: 11589 - DNA, 20 bp, Artificial Sequence
  Artificially Synthesized Primer Sequence
aaagaaacccaatctcgcct

SEQ ID NO: 11590 - DNA, 20 bp, Artificial Sequence
  Artificially Synthesized Primer Sequence
atgagtatcaccctcagcgg

SEQ ID NO: 11591 - DNA, 20 bp, Artificial Sequence
  Artificially Synthesized Primer Sequence
ccaaacatacatcaaccccc

SEQ ID NO: 11592 - DNA, 20 bp, Artificial Sequence
  Artificially Synthesized Primer Sequence
ccgctgagggtgatactcat

SEQ ID NO: 11593 - DNA, 20 bp, Artificial Sequence
  Artificially Synthesized Primer Sequence
ttgtggcgagtgtaatccaa

SEQ ID NO: 11594 - DNA, 20 bp, Artificial Sequence
  Artificially Synthesized Primer Sequence
gccacaaaaaggaaaacgaa

SEQ ID NO: 11595 - DNA, 20 bp, Artificial Sequence
  Artificially Synthesized Primer Sequence
ccttatttttgcacgaaggc

SEQ ID NO: 11596 - DNA, 20 bp, Artificial Sequence
  Artificially Synthesized Primer Sequence
aacgggatcacaagcaagat

SEQ ID NO: 11597 - DNA, 20 bp, Artificial Sequence
  Artificially Synthesized Primer Sequence
cgaggggtgtaacatcgact

SEQ ID NO: 11598 - DNA, 20 bp, Artificial Sequence
  Artificially Synthesized Primer Sequence
tcacctattctttggggacg

SEQ ID NO: 11599 - DNA, 20 bp, Artificial Sequence
  Artificially Synthesized Primer Sequence
tcctcccagaaccacaaaac

SEQ ID NO: 11600 - DNA, 19 bp, Artificial Sequence
  Artificially Synthesized Primer Sequence
atgagctgctgatggggat

SEQ ID NO: 11601 - DNA, 20 bp, Artificial Sequence
  Artificially Synthesized Primer Sequence
atggctatgagaatgcaggg

SEQ ID NO: 11602 - DNA, 20 bp, Artificial Sequence
  Artificially Synthesized Primer Sequence
catgagaaaaaccgggaaga

SEQ ID NO: 11603 - DNA, 20 bp, Artificial Sequence
  Artificially Synthesized Primer Sequence
aatggtgccaacaagacaca

SEQ ID NO: 11604 - DNA, 20 bp, Artificial Sequence
  Artificially Synthesized Primer Sequence
gatgagggtctgacgaaagc

SEQ ID NO: 11605 - DNA, 20 bp, Artificial Sequence
  Artificially Synthesized Primer Sequence
tgtacaacaaagcaggctgg

SEQ ID NO: 11606 - DNA, 20 bp, Artificial Sequence
  Artificially Synthesized Primer Sequence
taccgacatcttgcggtgta

SEQ ID NO: 11607 - DNA, 21 bp, Artificial Sequence
  Artificially Synthesized Primer Sequence
tcaggtttgaagacagcaaca

SEQ ID NO: 11608 - DNA, 20 bp, Artificial Sequence
  Artificially Synthesized Primer Sequence
ggcgccctgtattaaagtga

SEQ ID NO: 11609 - DNA, 20 bp, Artificial Sequence
  Artificially Synthesized Primer Sequence
cgaagtcgggcaagatctac

SEQ ID NO: 11610 - DNA, 20 bp, Artificial Sequence
  Artificially Synthesized Primer Sequence
ggcatgatgtcgagtaccct

SEQ ID NO: 11611 - DNA, 20 bp, Artificial Sequence
  Artificially Synthesized Primer Sequence
cttcgaagaaacagcgtgtg

SEQ ID NO: 11612 - DNA, 20 bp, Artificial Sequence
  Artificially Synthesized Primer Sequence
gggacgacaagctcaagaag

SEQ ID NO: 11613 - DNA, 20 bp, Artificial Sequence
  Artificially Synthesized Primer Sequence
tgcttcgtcttgatgacctg

SEQ ID NO: 11614 - DNA, 20 bp, Artificial Sequence
  Artificially Synthesized Primer Sequence
agacatttcatagcacgggg

SEQ ID NO: 11615 - DNA, 20 bp, Artificial Sequence
  Artificially Synthesized Primer Sequence
acctttctgccaacctagca

SEQ ID NO: 11616 - DNA, 20 bp, Artificial Sequence
  Artificially Synthesized Primer Sequence
aacctcaaggcaaaaagggt

SEQ ID NO: 11617 - DNA, 20 bp, Artificial Sequence
  Artificially Synthesized Primer Sequence
gccgaatttgtcaagtccat

SEQ ID NO: 11618 - DNA, 20 bp, Artificial Sequence
  Artificially Synthesized Primer Sequence
gcaagcaagcttatcccttg

SEQ ID NO: 11619 - DNA, 20 bp, Artificial Sequence
  Artificially Synthesized Primer Sequence
aaatcaagagccccaaggat

SEQ ID NO: 11620 - DNA, 20 bp, Artificial Sequence
  Artificially Synthesized Primer Sequence
gacagcactgaagcaagcag

SEQ ID NO: 11621 - DNA, 20 bp, Artificial Sequence
  Artificially Synthesized Primer Sequence
tgatccaacctcctactccg

SEQ ID NO: 11622 - DNA, 20 bp, Artificial Sequence
  Artificially Synthesized Primer Sequence
caagcaaacagcccttcttc

SEQ ID NO: 11623 - DNA, 20 bp, Artificial Sequence
  Artificially Synthesized Primer Sequence
caagcaaacagcccttcttc

SEQ ID NO: 11624 - DNA, 20 bp, Artificial Sequence
  Artificially Synthesized Primer Sequence
tgatccaacctcctactccg

SEQ ID NO: 11625 - DNA, 20 bp, Artificial Sequence
  Artificially Synthesized Primer Sequence
agaaatggtccggacatcag

SEQ ID NO: 11626 - DNA, 20 bp, Artificial Sequence
  Artificially Synthesized Primer Sequence
ccagaatgcagttttgctca

SEQ ID NO: 11627 - DNA, 20 bp, Artificial Sequence
  Artificially Synthesized Primer Sequence
caagagcattgctgtccaga

SEQ ID NO: 11628 - DNA, 20 bp, Artificial Sequence
  Artificially Synthesized Primer Sequence
tcatgagtgaggatgtcgga

SEQ ID NO: 11629 - DNA, 20 bp, Artificial Sequence
  Artificially Synthesized Primer Sequence
gtgtgccaacatactggtgc

SEQ ID NO: 11630 - DNA, 20 bp, Artificial Sequence
  Artificially Synthesized Primer Sequence
gcgtgtgtatgtcctcatgg

SEQ ID NO: 11631 - DNA, 20 bp, Artificial Sequence
  Artificially Synthesized Primer Sequence
ggtcatgcatcagctttgaa

SEQ ID NO: 11632 - DNA, 20 bp, Artificial Sequence
  Artificially Synthesized Primer Sequence
cctcactaatcatgcggagc

SEQ ID NO: 11633 - DNA, 20 bp, Artificial Sequence
  Artificially Synthesized Primer Sequence
tttgttcgttatggccttcc

SEQ ID NO: 11634 - DNA, 20 bp, Artificial Sequence
  Artificially Synthesized Primer Sequence
cagcatcccaaggaactcat

SEQ ID NO: 11635 - DNA, 20 bp, Artificial Sequence
  Artificially Synthesized Primer Sequence
tatgattcgaaacggaggga

SEQ ID NO: 11636 - DNA, 20 bp, Artificial Sequence
  Artificially Synthesized Primer Sequence
atgagttccttgggatgctg

SEQ ID NO: 11637 - DNA, 20 bp, Artificial Sequence
  Artificially Synthesized Primer Sequence
gcgccgtagagaatcagaac

SEQ ID NO: 11638 - DNA, 20 bp, Artificial Sequence
  Artificially Synthesized Primer Sequence
gcatggcgacctcagttaat

SEQ ID NO: 11639 - DNA, 20 bp, Artificial Sequence
  Artificially Synthesized Primer Sequence
acgcttcgtccatgaactct

SEQ ID NO: 11640 - DNA, 20 bp, Artificial Sequence
  Artificially Synthesized Primer Sequence
attaactgaggtcgccatgc

SEQ ID NO: 11641 - DNA, 20 bp, Artificial Sequence
  Artificially Synthesized Primer Sequence
ccgagcgtgagagaggtatc

SEQ ID NO: 11642 - DNA, 20 bp, Artificial Sequence
  Artificially Synthesized Primer Sequence
gtcaccctcaaacccagaga

SEQ ID NO: 11643 - DNA, 20 bp, Artificial Sequence
  Artificially Synthesized Primer Sequence
aagacagacaccaccaaggg

SEQ ID NO: 11644 - DNA, 20 bp, Artificial Sequence
  Artificially Synthesized Primer Sequence
tgtcaagtttgctgagctgg

SEQ ID NO: 11645 - DNA, 20 bp, Artificial Sequence
  Artificially Synthesized Primer Sequence
tccttccccctcatttcttt

SEQ ID NO: 11646 - DNA, 20 bp, Artificial Sequence
  Artificially Synthesized Primer Sequence
ttatattcacgacgccgaca

SEQ ID NO: 11647 - DNA, 20 bp, Artificial Sequence
  Artificially Synthesized Primer Sequence
ggccgacgaatgctctacta

SEQ ID NO: 11648 - DNA, 20 bp, Artificial Sequence
  Artificially Synthesized Primer Sequence
gtgatcctcgccatcattct

SEQ ID NO: 11649 - DNA, 20 bp, Artificial Sequence
  Artificially Synthesized Primer Sequence
tagcaattcaagcgttgtgc

SEQ ID NO: 11650 - DNA, 20 bp, Artificial Sequence
  Artificially Synthesized Primer Sequence
tcggcctagtatgtctcgct

SEQ ID NO: 11651 - DNA, 20 bp, Artificial Sequence
  Artificially Synthesized Primer Sequence
gattggttcttgtagggcga

SEQ ID NO: 11652 - DNA, 20 bp, Artificial Sequence
  Artificially Synthesized Primer Sequence
tggcaaaggctatgctttct

SEQ ID NO: 11653 - DNA, 20 bp, Artificial Sequence
  Artificially Synthesized Primer Sequence
ccactgatgcaatgatcctg

SEQ ID NO: 11654 - DNA, 20 bp, Artificial Sequence
  Artificially Synthesized Primer Sequence
gactgtccgagataggctgc

SEQ ID NO: 11655 - DNA, 20 bp, Artificial Sequence
  Artificially Synthesized Primer Sequence
tcttcagctagccaacagca

SEQ ID NO: 11656 - DNA, 20 bp, Artificial Sequence
  Artificially Synthesized Primer Sequence
ggctgctggagatcaaagtc

SEQ ID NO: 11657 - DNA, 20 bp, Artificial Sequence
  Artificially Synthesized Primer Sequence
cccagaatggaccctctgta

SEQ ID NO: 11658 - DNA, 20 bp, Artificial Sequence
  Artificially Synthesized Primer Sequence
cagacccaatggaatccaac

SEQ ID NO: 11659 - DNA, 20 bp, Artificial Sequence
  Artificially Synthesized Primer Sequence
taatcctccaaagcaccacc

SEQ ID NO: 11660 - DNA, 20 bp, Artificial Sequence
  Artificially Synthesized Primer Sequence
agcaccgccacatctaacat

SEQ ID NO: 11661 - DNA, 20 bp, Artificial Sequence
  Artificially Synthesized Primer Sequence
gccaaatgttgactggtgtg

SEQ ID NO: 11662 - DNA, 20 bp, Artificial Sequence
  Artificially Synthesized Primer Sequence
catggctttggttttggagt

SEQ ID NO: 11663 - DNA, 20 bp, Artificial Sequence
  Artificially Synthesized Primer Sequence
aaaccttcctgtttggctca

SEQ ID NO: 11664 - DNA, 20 bp, Artificial Sequence
  Artificially Synthesized Primer Sequence
tcaggatgcccatatcatca

SEQ ID NO: 11665 - DNA, 20 bp, Artificial Sequence
  Artificially Synthesized Primer Sequence
gcccaccatatccctacaaa

SEQ ID NO: 11666 - DNA, 21 bp, Artificial Sequence
  Artificially Synthesized Primer Sequence
tgtttggtatgccatggtttc

SEQ ID NO: 11667 - DNA, 20 bp, Artificial Sequence
  Artificially Synthesized Primer Sequence
agggaattgaacgaatgcaa

SEQ ID NO: 11668 - DNA, 20 bp, Artificial Sequence
  Artificially Synthesized Primer Sequence
gcagggtcacttctcgtacc

SEQ ID NO: 11669 - DNA, 20 bp, Artificial Sequence
  Artificially Synthesized Primer Sequence
gaagaaagaggatcaggggg

SEQ ID NO: 11670 - DNA, 20 bp, Artificial Sequence
  Artificially Synthesized Primer Sequence
tcttcttcgtatgcagggct

SEQ ID NO: 11671 - DNA, 20 bp, Artificial Sequence
  Artificially Synthesized Primer Sequence
taagcaggtgatttcatgcg

SEQ ID NO: 11672 - DNA, 20 bp, Artificial Sequence
  Artificially Synthesized Primer Sequence
agggccctctaaaccctgta

SEQ ID NO: 11673 - DNA, 20 bp, Artificial Sequence
  Artificially Synthesized Primer Sequence
acagctttgtccatggaagg

SEQ ID NO: 11674 - DNA, 20 bp, Artificial Sequence
  Artificially Synthesized Primer Sequence
acgctgtcgtcgaagaaaat

SEQ ID NO: 11675 - DNA, 20 bp, Artificial Sequence
  Artificially Synthesized Primer Sequence
atgccgcattaattcctgac

SEQ ID NO: 11676 - DNA, 20 bp, Artificial Sequence
  Artificially Synthesized Primer Sequence
attttcttcgacgacagcgt

SEQ ID NO: 11677 - DNA, 20 bp, Artificial Sequence
  Artificially Synthesized Primer Sequence
cgtcgagagaggtgttgtga

SEQ ID NO: 11678 - DNA, 20 bp, Artificial Sequence
  Artificially Synthesized Primer Sequence
taagatgtcatccgcagcag

SEQ ID NO: 11679 - DNA, 20 bp, Artificial Sequence
  Artificially Synthesized Primer Sequence
caggacagttaagcatggca

SEQ ID NO: 11680 - DNA, 20 bp, Artificial Sequence
  Artificially Synthesized Primer Sequence
gtgaaaggcaaacggacaat

SEQ ID NO: 11681 - DNA, 20 bp, Artificial Sequence
  Artificially Synthesized Primer Sequence
atggaccatacagggctgag

SEQ ID NO: 11682 - DNA, 20 bp, Artificial Sequence
  Artificially Synthesized Primer Sequence
acggactccctgaggttctt

SEQ ID NO: 11683 - DNA, 20 bp, Artificial Sequence
  Artificially Synthesized Primer Sequence
agctagccatacaagctcgc

SEQ ID NO: 11684 - DNA, 20 bp, Artificial Sequence
  Artificially Synthesized Primer Sequence
tccatggcttctggagtacc

SEQ ID NO: 11685 - DNA, 20 bp, Artificial Sequence
  Artificially Synthesized Primer Sequence
ctctcatggaatttgcggat

SEQ ID NO: 11686 - DNA, 20 bp, Artificial Sequence
  Artificially Synthesized Primer Sequence
ccactccaccaggttatgct

SEQ ID NO: 11687 - DNA, 20 bp, Artificial Sequence
  Artificially Synthesized Primer Sequence
ccggcatctcttcactgttt

SEQ ID NO: 11688 - DNA, 20 bp, Artificial Sequence
  Artificially Synthesized Primer Sequence
tgctctagacaagaaccgcc

SEQ ID NO: 11689 - DNA, 20 bp, Artificial Sequence
  Artificially Synthesized Primer Sequence
gtcgattcattccaccaacc

SEQ ID NO: 11690 - DNA, 20 bp, Artificial Sequence
  Artificially Synthesized Primer Sequence
caggtgtccgtcttctcctc

SEQ ID NO: 11691 - DNA, 20 bp, Artificial Sequence
  Artificially Synthesized Primer Sequence
tgacgaacaaactggactgg

SEQ ID NO: 11692 - DNA, 20 bp, Artificial Sequence
  Artificially Synthesized Primer Sequence
caggaggagaagacggacac

SEQ ID NO: 11693 - DNA, 20 bp, Artificial Sequence
  Artificially Synthesized Primer Sequence
taaggcgacctgatttttgg

SEQ ID NO: 11694 - DNA, 20 bp, Artificial Sequence
  Artificially Synthesized Primer Sequence
ttttgatgaacgaaacagcg

SEQ ID NO: 11695 - DNA, 20 bp, Artificial Sequence
  Artificially Synthesized Primer Sequence
tgccggtattctgtctgatg

SEQ ID NO: 11696 - DNA, 20 bp, Artificial Sequence
  Artificially Synthesized Primer Sequence
ggctggcagtgaaagaagtt

SEQ ID NO: 11697 - DNA, 20 bp, Artificial Sequence
  Artificially Synthesized Primer Sequence
tccactggctgtgtggtaag

SEQ ID NO: 11698 - DNA, 20 bp, Artificial Sequence
  Artificially Synthesized Primer Sequence
gatggccaaagaaccaaaaa

SEQ ID NO: 11699 - DNA, 20 bp, Artificial Sequence
  Artificially Synthesized Primer Sequence
cctagcaacagcagcacatc

SEQ ID NO: 11700 - DNA, 20 bp, Artificial Sequence
  Artificially Synthesized Primer Sequence
catggtcgaaatgatagggg

SEQ ID NO: 11701 - DNA, 20 bp, Artificial Sequence
  Artificially Synthesized Primer Sequence
cttggcaagaacatgctgaa

SEQ ID NO: 11702 - DNA, 20 bp, Artificial Sequence
  Artificially Synthesized Primer Sequence
ctcgagccgaactttaccag

SEQ ID NO: 11703 - DNA, 20 bp, Artificial Sequence
  Artificially Synthesized Primer Sequence
gtttgatgggaaggaggtga

SEQ ID NO: 11704 - DNA, 20 bp, Artificial Sequence
  Artificially Synthesized Primer Sequence
gcactcaggcaaacaattca

SEQ ID NO: 11705 - DNA, 20 bp, Artificial Sequence
  Artificially Synthesized Primer Sequence
agcaggatttggggaaaaat

SEQ ID NO: 11706 - DNA, 20 bp, Artificial Sequence
  Artificially Synthesized Primer Sequence
cccaccaaaagtgcaaagtt

SEQ ID NO: 11707 - DNA, 20 bp, Artificial Sequence
  Artificially Synthesized Primer Sequence
ctccatggttcaacaacgtg

SEQ ID NO: 11708 - DNA, 20 bp, Artificial Sequence
  Artificially Synthesized Primer Sequence
aagctgctggcatgttttct

SEQ ID NO: 11709 - DNA, 20 bp, Artificial Sequence
  Artificially Synthesized Primer Sequence
ctccggatctctgcaaatgt

SEQ ID NO: 11710 - DNA, 20 bp, Artificial Sequence
  Artificially Synthesized Primer Sequence
tacctggtttgaggaggtgc

SEQ ID NO: 11711 - DNA, 20 bp, Artificial Sequence
  Artificially Synthesized Primer Sequence
ctcctcgatcaagctgctct

SEQ ID NO: 11712 - DNA, 20 bp, Artificial Sequence
  Artificially Synthesized Primer Sequence
acagtgccaatctgacaacg

SEQ ID NO: 11713 - DNA, 20 bp, Artificial Sequence
  Artificially Synthesized Primer Sequence
gctattgcaattccccttca

SEQ ID NO: 11714 - DNA, 20 bp, Artificial Sequence
  Artificially Synthesized Primer Sequence
tagccatcccacaatgttca

SEQ ID NO: 11715 - DNA, 20 bp, Artificial Sequence
  Artificially Synthesized Primer Sequence
aatgtgcctccacagggtag

SEQ ID NO: 11716 - DNA, 20 bp, Artificial Sequence
  Artificially Synthesized Primer Sequence
gatactgagtggaaagcggc

SEQ ID NO: 11717 - DNA, 20 bp, Artificial Sequence
  Artificially Synthesized Primer Sequence
catgctggagacagagtgga

SEQ ID NO: 11718 - DNA, 20 bp, Artificial Sequence
  Artificially Synthesized Primer Sequence
ggagggagaacaccgtacaa

SEQ ID NO: 11719 - DNA, 20 bp, Artificial Sequence
  Artificially Synthesized Primer Sequence
tttacatcacgcgctgaatc

SEQ ID NO: 11720 - DNA, 20 bp, Artificial Sequence
  Artificially Synthesized Primer Sequence
caagatcagctacgttgcca

SEQ ID NO: 11721 - DNA, 20 bp, Artificial Sequence
  Artificially Synthesized Primer Sequence
ccatcaggcccagtcatagt

SEQ ID NO: 11722 - DNA, 20 bp, Artificial Sequence
  Artificially Synthesized Primer Sequence
taactgcacaggctacacgc

SEQ ID NO: 11723 - DNA, 20 bp, Artificial Sequence
  Artificially Synthesized Primer Sequence
ccgtcagtttccaacaaacc

SEQ ID NO: 11724 - DNA, 20 bp, Artificial Sequence
  Artificially Synthesized Primer Sequence
aagcggagttcaagaagctg

SEQ ID NO: 11725 - DNA, 20 bp, Artificial Sequence
  Artificially Synthesized Primer Sequence
gccacttgaaatgtggtgtg

SEQ ID NO: 11726 - DNA, 20 bp, Artificial Sequence
  Artificially Synthesized Primer Sequence
tgctccgacagatccctaac

SEQ ID NO: 11727 - DNA, 21 bp, Artificial Sequence
  Artificially Synthesized Primer Sequence
cccttcctcgatgtaggagtc

SEQ ID NO: 11728 - DNA, 19 bp, Artificial Sequence
  Artificially Synthesized Primer Sequence
cgaggctggtcagaactca

SEQ ID NO: 11729 - DNA, 20 bp, Artificial Sequence
  Artificially Synthesized Primer Sequence
gagcgttgatgtgacgaaga

SEQ ID NO: 11730 - DNA, 20 bp, Artificial Sequence
  Artificially Synthesized Primer Sequence
cgacaatttcctggaatgct

SEQ ID NO: 11731 - DNA, 20 bp, Artificial Sequence
  Artificially Synthesized Primer Sequence
agttttgttgccaaacgtcc

SEQ ID NO: 11732 - DNA, 20 bp, Artificial Sequence
  Artificially Synthesized Primer Sequence
gcttcataccttcgcctctg

SEQ ID NO: 11733 - DNA, 20 bp, Artificial Sequence
  Artificially Synthesized Primer Sequence
agccggcctataattcccta

SEQ ID NO: 11734 - DNA, 20 bp, Artificial Sequence
  Artificially Synthesized Primer Sequence
acgccgtttcaccaaaatag

SEQ ID NO: 11735 - DNA, 20 bp, Artificial Sequence
  Artificially Synthesized Primer Sequence
acggagagtaaggtagcgca

SEQ ID NO: 11736 - DNA, 20 bp, Artificial Sequence
  Artificially Synthesized Primer Sequence
caacacacaaggttcatccg

SEQ ID NO: 11737 - DNA, 20 bp, Artificial Sequence
  Artificially Synthesized Primer Sequence
cagaacaaggcccatttgat

SEQ ID NO: 11738 - DNA, 20 bp, Artificial Sequence
  Artificially Synthesized Primer Sequence
ggattcccaccatgattcac

SEQ ID NO: 11739 - DNA, 20 bp, Artificial Sequence
  Artificially Synthesized Primer Sequence
agatcgacacaaggccattc

SEQ ID NO: 11740 - DNA, 20 bp, Artificial Sequence
  Artificially Synthesized Primer Sequence
gagcttggagctaatgaccg

SEQ ID NO: 11741 - DNA, 20 bp, Artificial Sequence
  Artificially Synthesized Primer Sequence
aatccattcgaactgcaagg

SEQ ID NO: 11742 - DNA, 20 bp, Artificial Sequence
  Artificially Synthesized Primer Sequence
gcagcgcagctataagctct

SEQ ID NO: 11743 - DNA, 20 bp, Artificial Sequence
  Artificially Synthesized Primer Sequence
aaccgtagcaagcgtctgat

SEQ ID NO: 11744 - DNA, 20 bp, Artificial Sequence
  Artificially Synthesized Primer Sequence
cggtcctgagtggtgaatct

SEQ ID NO: 11745 - DNA, 20 bp, Artificial Sequence
  Artificially Synthesized Primer Sequence
atgggcatactcgttgaagg

SEQ ID NO: 11746 - DNA, 20 bp, Artificial Sequence
  Artificially Synthesized Primer Sequence
tcatcaaaacaagggaagcc

SEQ ID NO: 11747 - DNA, 20 bp, Artificial Sequence
  Artificially Synthesized Primer Sequence
accgtgttcgtccgaaaata

SEQ ID NO: 11748 - DNA, 20 bp, Artificial Sequence
  Artificially Synthesized Primer Sequence
tcggctggtcataaggttct

SEQ ID NO: 11749 - DNA, 20 bp, Artificial Sequence
  Artificially Synthesized Primer Sequence
ttcaggctacggaagctgtt

SEQ ID NO: 11750 - DNA, 20 bp, Artificial Sequence
  Artificially Synthesized Primer Sequence
gcctcacattgagcttcctc

SEQ ID NO: 11751 - DNA, 20 bp, Artificial Sequence
  Artificially Synthesized Primer Sequence
accgcttaccacggatactg

SEQ ID NO: 11752 - DNA, 20 bp, Artificial Sequence
  Artificially Synthesized Primer Sequence
acccacagatcaatcaaggg

SEQ ID NO: 11753 - DNA, 20 bp, Artificial Sequence
  Artificially Synthesized Primer Sequence
ttgagcgagcatgtaactcg

SEQ ID NO: 11754 - DNA, 20 bp, Artificial Sequence
  Artificially Synthesized Primer Sequence
ggaagccatggtacttccaa

SEQ ID NO: 11755 - DNA, 21 bp, Artificial Sequence
  Artificially Synthesized Primer Sequence
gttgattatttggcagctgga

SEQ ID NO: 11756 - DNA, 23 bp, Artificial Sequence
  Artificially Synthesized Primer Sequence
aaaccaactgatgagattggaag

SEQ ID NO: 11757 - DNA, 20 bp, Artificial Sequence
  Artificially Synthesized Primer Sequence
gcctccaagcagacaaactc

SEQ ID NO: 11758 - DNA, 20 bp, Artificial Sequence
  Artificially Synthesized Primer Sequence
gctggtcactgaacaagcaa

SEQ ID NO: 11759 - DNA, 20 bp, Artificial Sequence
  Artificially Synthesized Primer Sequence
gggagaaaattcaactgcca

SEQ ID NO: 11760 - DNA, 20 bp, Artificial Sequence
  Artificially Synthesized Primer Sequence
tctcaacaggggaatatcgg

SEQ ID NO: 11761 - DNA, 20 bp, Artificial Sequence
  Artificially Synthesized Primer Sequence
ggtgatagcgggaatcttca

SEQ ID NO: 11762 - DNA, 20 bp, Artificial Sequence
  Artificially Synthesized Primer Sequence
atccatgaagtgttggaggc

SEQ ID NO: 11763 - DNA, 20 bp, Artificial Sequence
  Artificially Synthesized Primer Sequence
atccatgaagtgttggaggc

SEQ ID NO: 11764 - DNA, 20 bp, Artificial Sequence
  Artificially Synthesized Primer Sequence
ggtgatagcgggaatcttca

SEQ ID NO: 11765 - DNA, 20 bp, Artificial Sequence
  Artificially Synthesized Primer Sequence
gactaatgagaatggggcga

SEQ ID NO: 11766 - DNA, 20 bp, Artificial Sequence
  Artificially Synthesized Primer Sequence
aggaagttgaatggaccacg

SEQ ID NO: 11767 - DNA, 20 bp, Artificial Sequence
  Artificially Synthesized Primer Sequence
tgcgagagcgtaatgaaatg

SEQ ID NO: 11768 - DNA, 20 bp, Artificial Sequence
  Artificially Synthesized Primer Sequence
acctctcatccttgctgtgc

SEQ ID NO: 11769 - DNA, 20 bp, Artificial Sequence
  Artificially Synthesized Primer Sequence
tgcttattgtgcttcaaccg

SEQ ID NO: 11770 - DNA, 20 bp, Artificial Sequence
  Artificially Synthesized Primer Sequence
cgttaataacccccgcctat

SEQ ID NO: 11771 - DNA, 20 bp, Artificial Sequence
  Artificially Synthesized Primer Sequence
catcctcagcatcagtggaa

SEQ ID NO: 11772 - DNA, 20 bp, Artificial Sequence
  Artificially Synthesized Primer Sequence
caactgccagaagagcaaga

SEQ ID NO: 11773 - DNA, 20 bp, Artificial Sequence
  Artificially Synthesized Primer Sequence
agcaccaaatgggacagttc

SEQ ID NO: 11774 - DNA, 20 bp, Artificial Sequence
  Artificially Synthesized Primer Sequence
taaagattttggaggtggcg

SEQ ID NO: 11775 - DNA, 21 bp, Artificial Sequence
  Artificially Synthesized Primer Sequence
tccttcaaacaccactcatca

SEQ ID NO: 11776 - DNA, 20 bp, Artificial Sequence
  Artificially Synthesized Primer Sequence
gacatgataggtcggggaga

SEQ ID NO: 11777 - DNA, 20 bp, Artificial Sequence
  Artificially Synthesized Primer Sequence
acgaattcccagatgtcgtc

SEQ ID NO: 11778 - DNA, 20 bp, Artificial Sequence
  Artificially Synthesized Primer Sequence
atgcagcaaaaatgcaacac

SEQ ID NO: 11779 - DNA, 20 bp, Artificial Sequence
  Artificially Synthesized Primer Sequence
tgacgatattcacgtcctgc

SEQ ID NO: 11780 - DNA, 20 bp, Artificial Sequence
  Artificially Synthesized Primer Sequence
gttgatgccgccatatttct

SEQ ID NO: 11781 - DNA, 20 bp, Artificial Sequence
  Artificially Synthesized Primer Sequence
ctcctcgctccaatcttgtc

SEQ ID NO: 11782 - DNA, 20 bp, Artificial Sequence
  Artificially Synthesized Primer Sequence
atgtaggtgccggtgaagag

SEQ ID NO: 11783 - DNA, 20 bp, Artificial Sequence
  Artificially Synthesized Primer Sequence
gggcaagattgccaaaagta

SEQ ID NO: 11784 - DNA, 19 bp, Artificial Sequence
  Artificially Synthesized Primer Sequence
caagaacctggtcgtgctc

SEQ ID NO: 11785 - DNA, 20 bp, Artificial Sequence
  Artificially Synthesized Primer Sequence
cgccttcctgtttcttcttg

SEQ ID NO: 11786 - DNA, 20 bp, Artificial Sequence
  Artificially Synthesized Primer Sequence
gagaaaagacggcgcactac

SEQ ID NO: 11787 - DNA, 20 bp, Artificial Sequence
  Artificially Synthesized Primer Sequence
attcaatcgcctcacctctg

SEQ ID NO: 11788 - DNA, 20 bp, Artificial Sequence
  Artificially Synthesized Primer Sequence
atcctgcagatggagcttgt

SEQ ID NO: 11789 - DNA, 20 bp, Artificial Sequence
  Artificially Synthesized Primer Sequence
caagaatttgcctcggaaag

SEQ ID NO: 11790 - DNA, 20 bp, Artificial Sequence
  Artificially Synthesized Primer Sequence
aaacgcctggtgaaacaatc

SEQ ID NO: 11791 - DNA, 20 bp, Artificial Sequence
  Artificially Synthesized Primer Sequence
cgtagcagatttttccctgc

SEQ ID NO: 11792 - DNA, 20 bp, Artificial Sequence
  Artificially Synthesized Primer Sequence
ggcgtacaactcgtatgcaa

SEQ ID NO: 11793 - DNA, 20 bp, Artificial Sequence
  Artificially Synthesized Primer Sequence
tgtacaacaaagcaggctgg

SEQ ID NO: 11794 - DNA, 20 bp, Artificial Sequence
  Artificially Synthesized Primer Sequence
tgagcaagattcgggatttc

SEQ ID NO: 11795 - DNA, 20 bp, Artificial Sequence
  Artificially Synthesized Primer Sequence
ccatggcattcagagagaca

SEQ ID NO: 11796 - DNA, 19 bp, Artificial Sequence
  Artificially Synthesized Primer Sequence
gaagggcattgtcgtgttg

SEQ ID NO: 11797 - DNA, 20 bp, Artificial Sequence
  Artificially Synthesized Primer Sequence
ggacaaggtcatcgtcgagt

SEQ ID NO: 11798 - DNA, 20 bp, Artificial Sequence
  Artificially Synthesized Primer Sequence
tgaagatcttggcagcattg

SEQ ID NO: 11799 - DNA, 20 bp, Artificial Sequence
  Artificially Synthesized Primer Sequence
aaacgggaaatgttttgcag

SEQ ID NO: 11800 - DNA, 20 bp, Artificial Sequence
  Artificially Synthesized Primer Sequence
tcaagaaggccatcgagaag

SEQ ID NO: 11801 - DNA, 20 bp, Artificial Sequence
  Artificially Synthesized Primer Sequence
cgttcgttgccctttgttat

SEQ ID NO: 11802 - DNA, 20 bp, Artificial Sequence
  Artificially Synthesized Primer Sequence
acgctgctggtgtagaaggt

SEQ ID NO: 11803 - DNA, 21 bp, Artificial Sequence
  Artificially Synthesized Primer Sequence
ggcctccttgttcattttctc

SEQ ID NO: 11804 - DNA, 20 bp, Artificial Sequence
  Artificially Synthesized Primer Sequence
tcaacttcctcagctccctc

SEQ ID NO: 11805 - DNA, 20 bp, Artificial Sequence
  Artificially Synthesized Primer Sequence
cagaggagttagcggaccag

SEQ ID NO: 11806 - DNA, 20 bp, Artificial Sequence
  Artificially Synthesized Primer Sequence
aaacagtgtccctgccagac

SEQ ID NO: 11807 - DNA, 20 bp, Artificial Sequence
  Artificially Synthesized Primer Sequence
agataaagaaacgcctcgca

SEQ ID NO: 11808 - DNA, 20 bp, Artificial Sequence
  Artificially Synthesized Primer Sequence
gtctggcagggacactgttt

SEQ ID NO: 11809 - DNA, 20 bp, Artificial Sequence
  Artificially Synthesized Primer Sequence
gaccgtgattccgaagaaaa

SEQ ID NO: 11810 - DNA, 20 bp, Artificial Sequence
  Artificially Synthesized Primer Sequence
gtgtgccattaccacactcg

SEQ ID NO: 11811 - DNA, 20 bp, Artificial Sequence
  Artificially Synthesized Primer Sequence
cttcttgtttggtccaccgt

SEQ ID NO: 11812 - DNA, 20 bp, Artificial Sequence
  Artificially Synthesized Primer Sequence
gcgcacacctatccttgatt

SEQ ID NO: 11813 - DNA, 20 bp, Artificial Sequence
  Artificially Synthesized Primer Sequence
ggagatgaccgacaaggtgt

SEQ ID NO: 11814 - DNA, 20 bp, Artificial Sequence
  Artificially Synthesized Primer Sequence
gcttgcattgtcagagacca

SEQ ID NO: 11815 - DNA, 20 bp, Artificial Sequence
  Artificially Synthesized Primer Sequence
tgcttgcattgtcagagacc

SEQ ID NO: 11816 - DNA, 20 bp, Artificial Sequence
  Artificially Synthesized Primer Sequence
cgccaccgtctaaacagtct

SEQ ID NO: 11817 - DNA, 20 bp, Artificial Sequence
  Artificially Synthesized Primer Sequence
gctcaacaggctggagaatc

SEQ ID NO: 11818 - DNA, 20 bp, Artificial Sequence
  Artificially Synthesized Primer Sequence
tctctctgggctgagtggat

SEQ ID NO: 11819 - DNA, 20 bp, Artificial Sequence
  Artificially Synthesized Primer Sequence
cctgctggttttgttgttca

SEQ ID NO: 11820 - DNA, 20 bp, Artificial Sequence
  Artificially Synthesized Primer Sequence
gacagcccaagagcaagaac

SEQ ID NO: 11821 - DNA, 20 bp, Artificial Sequence
  Artificially Synthesized Primer Sequence
cacaaaagaggaggctgagg

SEQ ID NO: 11822 - DNA, 20 bp, Artificial Sequence
  Artificially Synthesized Primer Sequence
cagagaccgcagaatgacaa

SEQ ID NO: 11823 - DNA, 20 bp, Artificial Sequence
  Artificially Synthesized Primer Sequence
ggtccattatctggagccaa

SEQ ID NO: 11824 - DNA, 20 bp, Artificial Sequence
  Artificially Synthesized Primer Sequence
tgaattgtgttggggctgta

SEQ ID NO: 11825 - DNA, 20 bp, Artificial Sequence
  Artificially Synthesized Primer Sequence
ttaggaagagcgagagctgc

SEQ ID NO: 11826 - DNA, 20 bp, Artificial Sequence
  Artificially Synthesized Primer Sequence
aggcagcaagaaacactgct

SEQ ID NO: 11827 - DNA, 20 bp, Artificial Sequence
  Artificially Synthesized Primer Sequence
aggcagcaagaaacactgct

SEQ ID NO: 11828 - DNA, 19 bp, Artificial Sequence
  Artificially Synthesized Primer Sequence
atctccaaggacaccgagg

SEQ ID NO: 11829 - DNA, 20 bp, Artificial Sequence
  Artificially Synthesized Primer Sequence
attggctgacaactgcactg

SEQ ID NO: 11830 - DNA, 20 bp, Artificial Sequence
  Artificially Synthesized Primer Sequence
gaggcataagttgctcctcg

SEQ ID NO: 11831 - DNA, 20 bp, Artificial Sequence
  Artificially Synthesized Primer Sequence
ccaaattaagcacgaccgat

SEQ ID NO: 11832 - DNA, 20 bp, Artificial Sequence
  Artificially Synthesized Primer Sequence
ccatcaagaccaagaggacc

SEQ ID NO: 11833 - DNA, 20 bp, Artificial Sequence
  Artificially Synthesized Primer Sequence
ttcctgaatcaattggaggc

SEQ ID NO: 11834 - DNA, 20 bp, Artificial Sequence
  Artificially Synthesized Primer Sequence
ccccctgcaaaactaacgta

SEQ ID NO: 11835 - DNA, 20 bp, Artificial Sequence
  Artificially Synthesized Primer Sequence
ccccctgcaaaactaacgta

SEQ ID NO: 11836 - DNA, 20 bp, Artificial Sequence
  Artificially Synthesized Primer Sequence
ttcctgaatcaattggaggc

SEQ ID NO: 11837 - DNA, 20 bp, Artificial Sequence
  Artificially Synthesized Primer Sequence
tgcctgctgctgttatgttc

SEQ ID NO: 11838 - DNA, 20 bp, Artificial Sequence
  Artificially Synthesized Primer Sequence
ttgtcatcttggagctgtcg

SEQ ID NO: 11839 - DNA, 20 bp, Artificial Sequence
  Artificially Synthesized Primer Sequence
taccctacaccaccaccaca

SEQ ID NO: 11840 - DNA, 20 bp, Artificial Sequence
  Artificially Synthesized Primer Sequence
catgcctgttcgggttatct

SEQ ID NO: 11841 - DNA, 20 bp, Artificial Sequence
  Artificially Synthesized Primer Sequence
ggaaaggtggaggtgcaata

SEQ ID NO: 11842 - DNA, 20 bp, Artificial Sequence
  Artificially Synthesized Primer Sequence
tccagtgttgttgagccttg

SEQ ID NO: 11843 - DNA, 20 bp, Artificial Sequence
  Artificially Synthesized Primer Sequence
cgactggataaaatcccagg

SEQ ID NO: 11844 - DNA, 20 bp, Artificial Sequence
  Artificially Synthesized Primer Sequence
ctgacagttggtggcctgta

SEQ ID NO: 11845 - DNA, 20 bp, Artificial Sequence
  Artificially Synthesized Primer Sequence
aatacaggccgcaactatgg

SEQ ID NO: 11846 - DNA, 20 bp, Artificial Sequence
  Artificially Synthesized Primer Sequence
gtctttgcccataaaagcca

SEQ ID NO: 11847 - DNA, 20 bp, Artificial Sequence
  Artificially Synthesized Primer Sequence
ctttcggctctggataggtg

SEQ ID NO: 11848 - DNA, 20 bp, Artificial Sequence
  Artificially Synthesized Primer Sequence
tctggtgcctgtgattgtgt

SEQ ID NO: 11849 - DNA, 20 bp, Artificial Sequence
  Artificially Synthesized Primer Sequence
ctgcagattgggatcacctt

SEQ ID NO: 11850 - DNA, 20 bp, Artificial Sequence
  Artificially Synthesized Primer Sequence
aattccaaccacagaggacg

SEQ ID NO: 11851 - DNA, 20 bp, Artificial Sequence
  Artificially Synthesized Primer Sequence
ggtgcccacagagaacattt

SEQ ID NO: 11852 - DNA, 20 bp, Artificial Sequence
  Artificially Synthesized Primer Sequence
tatgattaccagcaaggggc

SEQ ID NO: 11853 - DNA, 20 bp, Artificial Sequence
  Artificially Synthesized Primer Sequence
aacttgcaaccgttttggac

SEQ ID NO: 11854 - DNA, 20 bp, Artificial Sequence
  Artificially Synthesized Primer Sequence
ttcctccgatatggatcagc

SEQ ID NO: 11855 - DNA, 20 bp, Artificial Sequence
  Artificially Synthesized Primer Sequence
ttcttcaccgtgatgttcca

SEQ ID NO: 11856 - DNA, 20 bp, Artificial Sequence
  Artificially Synthesized Primer Sequence
ttggagcccctatacgacag

SEQ ID NO: 11857 - DNA, 20 bp, Artificial Sequence
  Artificially Synthesized Primer Sequence
cattgcaagctacgcaaaaa

SEQ ID NO: 11858 - DNA, 20 bp, Artificial Sequence
  Artificially Synthesized Primer Sequence
gcggttctaagcctgtatgc

SEQ ID NO: 11859 - DNA, 20 bp, Artificial Sequence
  Artificially Synthesized Primer Sequence
agggaagaaaatggctcgac

SEQ ID NO: 11860 - DNA, 21 bp, Artificial Sequence
  Artificially Synthesized Primer Sequence
cgccatcttgactaacgtttc

SEQ ID NO: 11861 - DNA, 20 bp, Artificial Sequence
  Artificially Synthesized Primer Sequence
ccccaaaaagagaaagcctc

SEQ ID NO: 11862 - DNA, 20 bp, Artificial Sequence
  Artificially Synthesized Primer Sequence
taccagaaccactccttggc

SEQ ID NO: 11863 - DNA, 20 bp, Artificial Sequence
  Artificially Synthesized Primer Sequence
cagcacggctcaagtgaata

SEQ ID NO: 11864 - DNA, 20 bp, Artificial Sequence
  Artificially Synthesized Primer Sequence
cgaggaacgccaatcagtat

SEQ ID NO: 11865 - DNA, 20 bp, Artificial Sequence
  Artificially Synthesized Primer Sequence
gtcctccatggctttcacat

SEQ ID NO: 11866 - DNA, 20 bp, Artificial Sequence
  Artificially Synthesized Primer Sequence
aagtccccacaggaacactg

SEQ ID NO: 11867 - DNA, 20 bp, Artificial Sequence
  Artificially Synthesized Primer Sequence
taccacatccaatcctggct

SEQ ID NO: 11868 - DNA, 20 bp, Artificial Sequence
  Artificially Synthesized Primer Sequence
ggaccccatttcaatcctct

SEQ ID NO: 11869 - DNA, 20 bp, Artificial Sequence
  Artificially Synthesized Primer Sequence
tgaacgtgaacatcgagagg

SEQ ID NO: 11870 - DNA, 20 bp, Artificial Sequence
  Artificially Synthesized Primer Sequence
gcaaataaaggaccatccca

SEQ ID NO: 11871 - DNA, 20 bp, Artificial Sequence
  Artificially Synthesized Primer Sequence
atggaagcatacatgagggg

SEQ ID NO: 11872 - DNA, 20 bp, Artificial Sequence
  Artificially Synthesized Primer Sequence
caggagccaggcttatcaat

SEQ ID NO: 11873 - DNA, 20 bp, Artificial Sequence
  Artificially Synthesized Primer Sequence
aaccccttggcttgaatttt

SEQ ID NO: 11874 - DNA, 20 bp, Artificial Sequence
  Artificially Synthesized Primer Sequence
gggacgaacaaagcaaacat

SEQ ID NO: 11875 - DNA, 20 bp, Artificial Sequence
  Artificially Synthesized Primer Sequence
agcctggattgcaatgtttt

SEQ ID NO: 11876 - DNA, 20 bp, Artificial Sequence
  Artificially Synthesized Primer Sequence
ggggcgaatggaaacttatt

SEQ ID NO: 11877 - DNA, 20 bp, Artificial Sequence
  Artificially Synthesized Primer Sequence
tcaccactgacaagctcagg

SEQ ID NO: 11878 - DNA, 20 bp, Artificial Sequence
  Artificially Synthesized Primer Sequence
tgagctttcccaggtcaaac

SEQ ID NO: 11879 - DNA, 20 bp, Artificial Sequence
  Artificially Synthesized Primer Sequence
agttgaacgctggctaggaa

SEQ ID NO: 11880 - DNA, 20 bp, Artificial Sequence
  Artificially Synthesized Primer Sequence
cctgaggtgattggaaagga

SEQ ID NO: 11881 - DNA, 20 bp, Artificial Sequence
  Artificially Synthesized Primer Sequence
tagggcgctacctcaagaaa

SEQ ID NO: 11882 - DNA, 20 bp, Artificial Sequence
  Artificially Synthesized Primer Sequence
acaaaggacccaaccaacag

SEQ ID NO: 11883 - DNA, 20 bp, Artificial Sequence
  Artificially Synthesized Primer Sequence
acaaaggacccaaccaacag

SEQ ID NO: 11884 - DNA, 20 bp, Artificial Sequence
  Artificially Synthesized Primer Sequence
tagggcgctacctcaagaaa

SEQ ID NO: 11885 - DNA, 20 bp, Artificial Sequence
  Artificially Synthesized Primer Sequence
ctgttgatgatgatgaccgc

SEQ ID NO: 11886 - DNA, 20 bp, Artificial Sequence
  Artificially Synthesized Primer Sequence
tggtcttccgagagaaagga

SEQ ID NO: 11887 - DNA, 20 bp, Artificial Sequence
  Artificially Synthesized Primer Sequence
gggtcgcagtttttcatctt

SEQ ID NO: 11888 - DNA, 20 bp, Artificial Sequence
  Artificially Synthesized Primer Sequence
gctgtaccatgaacccacct

SEQ ID NO: 11889 - DNA, 20 bp, Artificial Sequence
  Artificially Synthesized Primer Sequence
ccctggtttcagattcagga

SEQ ID NO: 11890 - DNA, 20 bp, Artificial Sequence
  Artificially Synthesized Primer Sequence
ccaaaagttacacggggcta

SEQ ID NO: 11891 - DNA, 20 bp, Artificial Sequence
  Artificially Synthesized Primer Sequence
acgccgacagagaaagaaaa

SEQ ID NO: 11892 - DNA, 20 bp, Artificial Sequence
  Artificially Synthesized Primer Sequence
gtgaatcgtctcgccagaat

SEQ ID NO: 11893 - DNA, 20 bp, Artificial Sequence
  Artificially Synthesized Primer Sequence
agacgctcttcatcctggtg

SEQ ID NO: 11894 - DNA, 20 bp, Artificial Sequence
  Artificially Synthesized Primer Sequence
cttctccgtgtcctccagac

SEQ ID NO: 11895 - DNA, 20 bp, Artificial Sequence
  Artificially Synthesized Primer Sequence
tcatcttgccatgtgcttgt

SEQ ID NO: 11896 - DNA, 20 bp, Artificial Sequence
  Artificially Synthesized Primer Sequence
cgtggagaaggaagatgagc

SEQ ID NO: 11897 - DNA, 20 bp, Artificial Sequence
  Artificially Synthesized Primer Sequence
gattgttcttgggcacgttt

SEQ ID NO: 11898 - DNA, 20 bp, Artificial Sequence
  Artificially Synthesized Primer Sequence
cactgtcctcttcgctttcc

SEQ ID NO: 11899 - DNA, 20 bp, Artificial Sequence
  Artificially Synthesized Primer Sequence
ggcacacaaacatcatttcg

SEQ ID NO: 11900 - DNA, 20 bp, Artificial Sequence
  Artificially Synthesized Primer Sequence
tgcttgcaaaattcaagtgg

SEQ ID NO: 11901 - DNA, 20 bp, Artificial Sequence
  Artificially Synthesized Primer Sequence
gtcaaaacggccttatccaa

SEQ ID NO: 11902 - DNA, 20 bp, Artificial Sequence
  Artificially Synthesized Primer Sequence
gcctctgaagcgttgttttc

SEQ ID NO: 11903 - DNA, 20 bp, Artificial Sequence
  Artificially Synthesized Primer Sequence
catggccataagatccgagt

SEQ ID NO: 11904 - DNA, 20 bp, Artificial Sequence
  Artificially Synthesized Primer Sequence
aggcgatgacatacggtttc

SEQ ID NO: 11905 - DNA, 20 bp, Artificial Sequence
  Artificially Synthesized Primer Sequence
ctccagtgcattcgtgagaa

SEQ ID NO: 11906 - DNA, 20 bp, Artificial Sequence
  Artificially Synthesized Primer Sequence
ccttggccaacaaggtttta

SEQ ID NO: 11907 - DNA, 20 bp, Artificial Sequence
  Artificially Synthesized Primer Sequence
accgtgtcttgcataccaca

SEQ ID NO: 11908 - DNA, 20 bp, Artificial Sequence
  Artificially Synthesized Primer Sequence
aagtacgccatcagggagaa

SEQ ID NO: 11909 - DNA, 20 bp, Artificial Sequence
  Artificially Synthesized Primer Sequence
gattggcgatttggaactgt

SEQ ID NO: 11910 - DNA, 20 bp, Artificial Sequence
  Artificially Synthesized Primer Sequence
ttgcatgtctatggtggcat

SEQ ID NO: 11911 - DNA, 20 bp, Artificial Sequence
  Artificially Synthesized Primer Sequence
ttctcagcgctctccttctc

SEQ ID NO: 11912 - DNA, 20 bp, Artificial Sequence
  Artificially Synthesized Primer Sequence
gacactgggaatcctgttgc

SEQ ID NO: 11913 - DNA, 20 bp, Artificial Sequence
  Artificially Synthesized Primer Sequence
ggtcacagaacagcgattca

SEQ ID NO: 11914 - DNA, 20 bp, Artificial Sequence
  Artificially Synthesized Primer Sequence
tcatcacaggccttaccaca

SEQ ID NO: 11915 - DNA, 22 bp, Artificial Sequence
  Artificially Synthesized Primer Sequence
tcagtgtgtcgtgtgttgacat

SEQ ID NO: 11916 - DNA, 20 bp, Artificial Sequence
  Artificially Synthesized Primer Sequence
ttggccgacagatttgtgta

SEQ ID NO: 11917 - DNA, 20 bp, Artificial Sequence
  Artificially Synthesized Primer Sequence
cctttggccaaggatattga

SEQ ID NO: 11918 - DNA, 20 bp, Artificial Sequence
  Artificially Synthesized Primer Sequence
aagtaagggccacaacaacg

SEQ ID NO: 11919 - DNA, 20 bp, Artificial Sequence
  Artificially Synthesized Primer Sequence
ccacaacaacgaggaggatt

SEQ ID NO: 11920 - DNA, 20 bp, Artificial Sequence
  Artificially Synthesized Primer Sequence
ccagatcttcaaagcttgcc

SEQ ID NO: 11921 - DNA, 20 bp, Artificial Sequence
  Artificially Synthesized Primer Sequence
cattgcccagtcatgttgtc

SEQ ID NO: 11922 - DNA, 20 bp, Artificial Sequence
  Artificially Synthesized Primer Sequence
gctcatcctcaccctgtcat

SEQ ID NO: 11923 - DNA, 20 bp, Artificial Sequence
  Artificially Synthesized Primer Sequence
ttcaccagctcgggatagtc

SEQ ID NO: 11924 - DNA, 20 bp, Artificial Sequence
  Artificially Synthesized Primer Sequence
ggaaagtggcggtctaggtt

SEQ ID NO: 11925 - DNA, 20 bp, Artificial Sequence
  Artificially Synthesized Primer Sequence
tgggattatacggcttagcg

SEQ ID NO: 11926 - DNA, 20 bp, Artificial Sequence
  Artificially Synthesized Primer Sequence
aggatacggttagcacacgg

SEQ ID NO: 11927 - DNA, 21 bp, Artificial Sequence
  Artificially Synthesized Primer Sequence
tctccagaggttctgatttgg

SEQ ID NO: 11928 - DNA, 20 bp, Artificial Sequence
  Artificially Synthesized Primer Sequence
cgcagatcaccaagacgata

SEQ ID NO: 11929 - DNA, 20 bp, Artificial Sequence
  Artificially Synthesized Primer Sequence
ggtcacagaacagcgattca

SEQ ID NO: 11930 - DNA, 20 bp, Artificial Sequence
  Artificially Synthesized Primer Sequence
ccagacacggaaaccatctt

SEQ ID NO: 11931 - DNA, 20 bp, Artificial Sequence
  Artificially Synthesized Primer Sequence
cagctaccatggcctagcat

SEQ ID NO: 11932 - DNA, 20 bp, Artificial Sequence
  Artificially Synthesized Primer Sequence
gttgtatcttctgcatggcg

SEQ ID NO: 11933 - DNA, 20 bp, Artificial Sequence
  Artificially Synthesized Primer Sequence
taccaacaggccagacatca

SEQ ID NO: 11934 - DNA, 20 bp, Artificial Sequence
  Artificially Synthesized Primer Sequence
caccttgtccacctcatcct

SEQ ID NO: 11935 - DNA, 20 bp, Artificial Sequence
  Artificially Synthesized Primer Sequence
caaataaccggcaggtaacg

SEQ ID NO: 11936 - DNA, 20 bp, Artificial Sequence
  Artificially Synthesized Primer Sequence
ggagtcgatgaagtatgccc

SEQ ID NO: 11937 - DNA, 20 bp, Artificial Sequence
  Artificially Synthesized Primer Sequence
agtctgtgccttggagcact

SEQ ID NO: 11938 - DNA, 20 bp, Artificial Sequence
  Artificially Synthesized Primer Sequence
cacaaggacaccaacacagg

SEQ ID NO: 11939 - DNA, 20 bp, Artificial Sequence
  Artificially Synthesized Primer Sequence
gtgggtggggtggattattt

SEQ ID NO: 11940 - DNA, 20 bp, Artificial Sequence
  Artificially Synthesized Primer Sequence
agtctgtgccttggagcact

SEQ ID NO: 11941 - DNA, 20 bp, Artificial Sequence
  Artificially Synthesized Primer Sequence
ccacaaatacttccacgcct

SEQ ID NO: 11942 - DNA, 20 bp, Artificial Sequence
  Artificially Synthesized Primer Sequence
catgttttcccaagccagat

SEQ ID NO: 11943 - DNA, 19 bp, Artificial Sequence
  Artificially Synthesized Primer Sequence
acaagcctacccaatcgct

SEQ ID NO: 11944 - DNA, 20 bp, Artificial Sequence
  Artificially Synthesized Primer Sequence
gagatacacgcatcgtctgc

SEQ ID NO: 11945 - DNA, 20 bp, Artificial Sequence
  Artificially Synthesized Primer Sequence
ctgttgctcccaggaagaag

SEQ ID NO: 11946 - DNA, 20 bp, Artificial Sequence
  Artificially Synthesized Primer Sequence
aggaacgcaggacatcaatc

SEQ ID NO: 11947 - DNA, 20 bp, Artificial Sequence
  Artificially Synthesized Primer Sequence
gctcaactgccgtcaacata

SEQ ID NO: 11948 - DNA, 20 bp, Artificial Sequence
  Artificially Synthesized Primer Sequence
ctgttgctcccaggaagaag

SEQ ID NO: 11949 - DNA, 20 bp, Artificial Sequence
  Artificially Synthesized Primer Sequence
ctgcgagcagacaaaccata

SEQ ID NO: 11950 - DNA, 20 bp, Artificial Sequence
  Artificially Synthesized Primer Sequence
tgaagctgctgtgctctcat

SEQ ID NO: 11951 - DNA, 20 bp, Artificial Sequence
  Artificially Synthesized Primer Sequence
gatccattgaagagggctca

SEQ ID NO: 11952 - DNA, 20 bp, Artificial Sequence
  Artificially Synthesized Primer Sequence
gccaccttgtagcttgtggt

SEQ ID NO: 11953 - DNA, 20 bp, Artificial Sequence
  Artificially Synthesized Primer Sequence
gagtacgcgggtgatgaaat

SEQ ID NO: 11954 - DNA, 20 bp, Artificial Sequence
  Artificially Synthesized Primer Sequence
cagtgcatttccatacggtg

SEQ ID NO: 11955 - DNA, 20 bp, Artificial Sequence
  Artificially Synthesized Primer Sequence
caacacgccatgtttgtttt

SEQ ID NO: 11956 - DNA, 20 bp, Artificial Sequence
  Artificially Synthesized Primer Sequence
tcctgtcctgttgtgcagag

SEQ ID NO: 11957 - DNA, 20 bp, Artificial Sequence
  Artificially Synthesized Primer Sequence
agtgtcgaacaattccaggg

SEQ ID NO: 11958 - DNA, 20 bp, Artificial Sequence
  Artificially Synthesized Primer Sequence
aagggtcttgattgtggacg

SEQ ID NO: 11959 - DNA, 20 bp, Artificial Sequence
  Artificially Synthesized Primer Sequence
cgacggcctaacaaaacaat

SEQ ID NO: 11960 - DNA, 20 bp, Artificial Sequence
  Artificially Synthesized Primer Sequence
cgtccacaatcaagaccctt

SEQ ID NO: 11961 - DNA, 20 bp, Artificial Sequence
  Artificially Synthesized Primer Sequence
cctccaacttctgctccaag

SEQ ID NO: 11962 - DNA, 20 bp, Artificial Sequence
  Artificially Synthesized Primer Sequence
gccttgtgctggtcttcttc

SEQ ID NO: 11963 - DNA, 19 bp, Artificial Sequence
  Artificially Synthesized Primer Sequence
ccacaatcgtgggaaaatg

SEQ ID NO: 11964 - DNA, 20 bp, Artificial Sequence
  Artificially Synthesized Primer Sequence
gccgactttgagaagcagtt

SEQ ID NO: 11965 - DNA, 20 bp, Artificial Sequence
  Artificially Synthesized Primer Sequence
actttcttggctgtcggaga

SEQ ID NO: 11966 - DNA, 20 bp, Artificial Sequence
  Artificially Synthesized Primer Sequence
gttggcaatcctgacaaggt

SEQ ID NO: 11967 - DNA, 20 bp, Artificial Sequence
  Artificially Synthesized Primer Sequence
cactacacaaaccgccacat

SEQ ID NO: 11968 - DNA, 20 bp, Artificial Sequence
  Artificially Synthesized Primer Sequence
caaggcctttgataggttgg

SEQ ID NO: 11969 - DNA, 20 bp, Artificial Sequence
  Artificially Synthesized Primer Sequence
caacagcagatccaaaagca

SEQ ID NO: 11970 - DNA, 20 bp, Artificial Sequence
  Artificially Synthesized Primer Sequence
gccaggaccattacgtttgt

SEQ ID NO: 11971 - DNA, 20 bp, Artificial Sequence
  Artificially Synthesized Primer Sequence
tttcagatccacacacccaa

SEQ ID NO: 11972 - DNA, 20 bp, Artificial Sequence
  Artificially Synthesized Primer Sequence
acaaacgtaatggtcctggc

SEQ ID NO: 11973 - DNA, 20 bp, Artificial Sequence
  Artificially Synthesized Primer Sequence
atggagcttgacaggtggag

SEQ ID NO: 11974 - DNA, 20 bp, Artificial Sequence
  Artificially Synthesized Primer Sequence
cacaaagcgcccatctttat

SEQ ID NO: 11975 - DNA, 20 bp, Artificial Sequence
  Artificially Synthesized Primer Sequence
cacaaagcgcccatctttat

SEQ ID NO: 11976 - DNA, 19 bp, Artificial Sequence
  Artificially Synthesized Primer Sequence
cactgcgctccacttcttc

SEQ ID NO: 11977 - DNA, 20 bp, Artificial Sequence
  Artificially Synthesized Primer Sequence
acaacaagaagcccaccatc

SEQ ID NO: 11978 - DNA, 20 bp, Artificial Sequence
  Artificially Synthesized Primer Sequence
agcggcaccattcataattc

SEQ ID NO: 11979 - DNA, 20 bp, Artificial Sequence
  Artificially Synthesized Primer Sequence
ttacagcgaacgaagcattg

SEQ ID NO: 11980 - DNA, 20 bp, Artificial Sequence
  Artificially Synthesized Primer Sequence
ggaagaagggcaagaagagc

SEQ ID NO: 11981 - DNA, 20 bp, Artificial Sequence
  Artificially Synthesized Primer Sequence
aaactacgaggccaagctga

SEQ ID NO: 11982 - DNA, 20 bp, Artificial Sequence
  Artificially Synthesized Primer Sequence
tagaagccatcaacgagcct

SEQ ID NO: 11983 - DNA, 20 bp, Artificial Sequence
  Artificially Synthesized Primer Sequence
cgttgcggaacactgtagaa

SEQ ID NO: 11984 - DNA, 20 bp, Artificial Sequence
  Artificially Synthesized Primer Sequence
aactacgaggccaagctgaa

SEQ ID NO: 11985 - DNA, 20 bp, Artificial Sequence
  Artificially Synthesized Primer Sequence
aaagggcatccttctccatt

SEQ ID NO: 11986 - DNA, 20 bp, Artificial Sequence
  Artificially Synthesized Primer Sequence
tccttaggaggttcctgggt

SEQ ID NO: 11987 - DNA, 20 bp, Artificial Sequence
  Artificially Synthesized Primer Sequence
ctcgtcgctctcctttgaac

SEQ ID NO: 11988 - DNA, 20 bp, Artificial Sequence
  Artificially Synthesized Primer Sequence
cctatggtgctcaagtccgt

SEQ ID NO: 11989 - DNA, 20 bp, Artificial Sequence
  Artificially Synthesized Primer Sequence
aattcctcgagcactgttgg

SEQ ID NO: 11990 - DNA, 20 bp, Artificial Sequence
  Artificially Synthesized Primer Sequence
aagtagtcggagaagcgcag

SEQ ID NO: 11991 - DNA, 20 bp, Artificial Sequence
  Artificially Synthesized Primer Sequence
atccacaaccgactctttgg

SEQ ID NO: 11992 - DNA, 20 bp, Artificial Sequence
  Artificially Synthesized Primer Sequence
accacgcatttggaacaagt

SEQ ID NO: 11993 - DNA, 20 bp, Artificial Sequence
  Artificially Synthesized Primer Sequence
agaagaagaagggcagaggc

SEQ ID NO: 11994 - DNA, 20 bp, Artificial Sequence
  Artificially Synthesized Primer Sequence
gcggtacatcttgtgggtct

SEQ ID NO: 11995 - DNA, 20 bp, Artificial Sequence
  Artificially Synthesized Primer Sequence
caatccccctgacaatcatc

SEQ ID NO: 11996 - DNA, 20 bp, Artificial Sequence
  Artificially Synthesized Primer Sequence
ctggtacgtccacaacctcc

SEQ ID NO: 11997 - DNA, 20 bp, Artificial Sequence
  Artificially Synthesized Primer Sequence
cgtgccttccactccagtat

SEQ ID NO: 11998 - DNA, 20 bp, Artificial Sequence
  Artificially Synthesized Primer Sequence
agaagccaaatcttgagcca

SEQ ID NO: 11999 - DNA, 20 bp, Artificial Sequence
  Artificially Synthesized Primer Sequence
aacaacaagccaagcagaca

SEQ ID NO: 12000 - DNA, 20 bp, Artificial Sequence
  Artificially Synthesized Primer Sequence
gtagtcaaatcccctcccct

SEQ ID NO: 12001 - DNA, 20 bp, Artificial Sequence
  Artificially Synthesized Primer Sequence
agtcccccaactccttcttc

SEQ ID NO: 12002 - DNA, 20 bp, Artificial Sequence
  Artificially Synthesized Primer Sequence
ttcagtggggcttcattttc

SEQ ID NO: 12003 - DNA, 20 bp, Artificial Sequence
  Artificially Synthesized Primer Sequence
acaggcgattcaaggaagtg

SEQ ID NO: 12004 - DNA, 20 bp, Artificial Sequence
  Artificially Synthesized Primer Sequence
agctcgagaagctcaagcac

SEQ ID NO: 12005 - DNA, 20 bp, Artificial Sequence
  Artificially Synthesized Primer Sequence
tgcatcttcactgagccaac

SEQ ID NO: 12006 - DNA, 20 bp, Artificial Sequence
  Artificially Synthesized Primer Sequence
ggttccaagcttcagcactc

SEQ ID NO: 12007 - DNA, 20 bp, Artificial Sequence
  Artificially Synthesized Primer Sequence
gcacaactgtcccattgttg

SEQ ID NO: 12008 - DNA, 20 bp, Artificial Sequence
  Artificially Synthesized Primer Sequence
gccaaaggagggaaaaactc

SEQ ID NO: 12009 - DNA, 20 bp, Artificial Sequence
  Artificially Synthesized Primer Sequence
caacctgaaccgttgaaaca

SEQ ID NO: 12010 - DNA, 20 bp, Artificial Sequence
  Artificially Synthesized Primer Sequence
tgctaggcaaagttatgggg

SEQ ID NO: 12011 - DNA, 20 bp, Artificial Sequence
  Artificially Synthesized Primer Sequence
gacacacagcccatgcatac

SEQ ID NO: 12012 - DNA, 20 bp, Artificial Sequence
  Artificially Synthesized Primer Sequence
gaagtgatccggaggtgaag

SEQ ID NO: 12013 - DNA, 20 bp, Artificial Sequence
  Artificially Synthesized Primer Sequence
aagggacaagtggatgatgc

SEQ ID NO: 12014 - DNA, 20 bp, Artificial Sequence
  Artificially Synthesized Primer Sequence
gagtttccagctgcacatga

SEQ ID NO: 12015 - DNA, 20 bp, Artificial Sequence
  Artificially Synthesized Primer Sequence
aagtgcaatttctgctgcct

SEQ ID NO: 12016 - DNA, 20 bp, Artificial Sequence
  Artificially Synthesized Primer Sequence
tggagccgacttttatctgg

SEQ ID NO: 12017 - DNA, 20 bp, Artificial Sequence
  Artificially Synthesized Primer Sequence
aaaaataattgcccccacaa

SEQ ID NO: 12018 - DNA, 19 bp, Artificial Sequence
  Artificially Synthesized Primer Sequence
cgggaagaagaagaaccca

SEQ ID NO: 12019 - DNA, 20 bp, Artificial Sequence
  Artificially Synthesized Primer Sequence
caggatatggggtcaggcta

SEQ ID NO: 12020 - DNA, 20 bp, Artificial Sequence
  Artificially Synthesized Primer Sequence
tagctgggatgatgtggtca

SEQ ID NO: 12021 - DNA, 20 bp, Artificial Sequence
  Artificially Synthesized Primer Sequence
gtgggcagagctttatcgag

SEQ ID NO: 12022 - DNA, 20 bp, Artificial Sequence
  Artificially Synthesized Primer Sequence
atgctgctacggctacaggt

SEQ ID NO: 12023 - DNA, 20 bp, Artificial Sequence
  Artificially Synthesized Primer Sequence
ctttgttgcctcttgttccc

SEQ ID NO: 12024 - DNA, 20 bp, Artificial Sequence
  Artificially Synthesized Primer Sequence
gtgggcagagctttatcgag

SEQ ID NO: 12025 - DNA, 20 bp, Artificial Sequence
  Artificially Synthesized Primer Sequence
gaggaaagaggagcggagtt

SEQ ID NO: 12026 - DNA, 20 bp, Artificial Sequence
  Artificially Synthesized Primer Sequence
atcctccttccccaagaaga

SEQ ID NO: 12027 - DNA, 20 bp, Artificial Sequence
  Artificially Synthesized Primer Sequence
gtgcagtcctatatgccggt

SEQ ID NO: 12028 - DNA, 20 bp, Artificial Sequence
  Artificially Synthesized Primer Sequence
gtgttgcttgagctgctgac

SEQ ID NO: 12029 - DNA, 20 bp, Artificial Sequence
  Artificially Synthesized Primer Sequence
tgtggcattgcatttacgat

SEQ ID NO: 12030 - DNA, 20 bp, Artificial Sequence
  Artificially Synthesized Primer Sequence
caagtgcagccatctgagaa

SEQ ID NO: 12031 - DNA, 20 bp, Artificial Sequence
  Artificially Synthesized Primer Sequence
cagtgaacaagagccgaaca

SEQ ID NO: 12032 - DNA, 20 bp, Artificial Sequence
  Artificially Synthesized Primer Sequence
gttcatagaggccgtgtggt

SEQ ID NO: 12033 - DNA, 20 bp, Artificial Sequence
  Artificially Synthesized Primer Sequence
gtcgacatcgaccatctcct

SEQ ID NO: 12034 - DNA, 20 bp, Artificial Sequence
  Artificially Synthesized Primer Sequence
ggatttattcccccaaccac

SEQ ID NO: 12035 - DNA, 20 bp, Artificial Sequence
  Artificially Synthesized Primer Sequence
cacacaccggacttattccc

SEQ ID NO: 12036 - DNA, 20 bp, Artificial Sequence
  Artificially Synthesized Primer Sequence
gtcgacatcgaccatctcct

SEQ ID NO: 12037 - DNA, 20 bp, Artificial Sequence
  Artificially Synthesized Primer Sequence
acgaggctgcaatcagagat

SEQ ID NO: 12038 - DNA, 20 bp, Artificial Sequence
  Artificially Synthesized Primer Sequence
tgaaccagtcagctagccct

SEQ ID NO: 12039 - DNA, 20 bp, Artificial Sequence
  Artificially Synthesized Primer Sequence
aacttgagcaggtggaatgg

SEQ ID NO: 12040 - DNA, 20 bp, Artificial Sequence
  Artificially Synthesized Primer Sequence
agggctagctgactggttca

SEQ ID NO: 12041 - DNA, 20 bp, Artificial Sequence
  Artificially Synthesized Primer Sequence
ccagttcaacacattcggtg

SEQ ID NO: 12042 - DNA, 20 bp, Artificial Sequence
  Artificially Synthesized Primer Sequence
gaaccctgacatggcgtagt

SEQ ID NO: 12043 - DNA, 20 bp, Artificial Sequence
  Artificially Synthesized Primer Sequence
taggggttgtgttccaccat

SEQ ID NO: 12044 - DNA, 20 bp, Artificial Sequence
  Artificially Synthesized Primer Sequence
tgagaccgctgttctgtttg

SEQ ID NO: 12045 - DNA, 20 bp, Artificial Sequence
  Artificially Synthesized Primer Sequence
ctgttggcctactggagagc

SEQ ID NO: 12046 - DNA, 20 bp, Artificial Sequence
  Artificially Synthesized Primer Sequence
ctgcgagcaacatcagacat

SEQ ID NO: 12047 - DNA, 20 bp, Artificial Sequence
  Artificially Synthesized Primer Sequence
atttttgttcctgccaatgc

SEQ ID NO: 12048 - DNA, 20 bp, Artificial Sequence
  Artificially Synthesized Primer Sequence
ccaacgacgtggagatcttt

SEQ ID NO: 12049 - DNA, 20 bp, Artificial Sequence
  Artificially Synthesized Primer Sequence
ttcctttggtgaaccaggtc

SEQ ID NO: 12050 - DNA, 20 bp, Artificial Sequence
  Artificially Synthesized Primer Sequence
agcatataccacggtcctgc

SEQ ID NO: 12051 - DNA, 20 bp, Artificial Sequence
  Artificially Synthesized Primer Sequence
gtagcatctggtgcaagcaa

SEQ ID NO: 12052 - DNA, 20 bp, Artificial Sequence
  Artificially Synthesized Primer Sequence
catacatcctcgtcagggct

SEQ ID NO: 12053 - DNA, 20 bp, Artificial Sequence
  Artificially Synthesized Primer Sequence
atgaagcagctgagttccgt

SEQ ID NO: 12054 - DNA, 20 bp, Artificial Sequence
  Artificially Synthesized Primer Sequence
ctctgtcgtgagtgatcgga

SEQ ID NO: 12055 - DNA, 20 bp, Artificial Sequence
  Artificially Synthesized Primer Sequence
atacatggcagagtggaggc

SEQ ID NO: 12056 - DNA, 20 bp, Artificial Sequence
  Artificially Synthesized Primer Sequence
gcatacatgagaccccttgg

SEQ ID NO: 12057 - DNA, 20 bp, Artificial Sequence
  Artificially Synthesized Primer Sequence
tcgccactttcaataccctc

SEQ ID NO: 12058 - DNA, 20 bp, Artificial Sequence
  Artificially Synthesized Primer Sequence
caaccatgctccaacatctg

SEQ ID NO: 12059 - DNA, 20 bp, Artificial Sequence
  Artificially Synthesized Primer Sequence
tgcaaaacaagagcgagcta

SEQ ID NO: 12060 - DNA, 20 bp, Artificial Sequence
  Artificially Synthesized Primer Sequence
gctttgcaaaagatgggaga

SEQ ID NO: 12061 - DNA, 20 bp, Artificial Sequence
  Artificially Synthesized Primer Sequence
ggtacacgctcccaactgat

SEQ ID NO: 12062 - DNA, 20 bp, Artificial Sequence
  Artificially Synthesized Primer Sequence
tgcactcatgaaagtcaggc

SEQ ID NO: 12063 - DNA, 20 bp, Artificial Sequence
  Artificially Synthesized Primer Sequence
tgtcaggcaattgcaacatt

SEQ ID NO: 12064 - DNA, 20 bp, Artificial Sequence
  Artificially Synthesized Primer Sequence
ggtacacgctcccaactgat

SEQ ID NO: 12065 - DNA, 20 bp, Artificial Sequence
  Artificially Synthesized Primer Sequence
tcctagccaatcttcccctt

SEQ ID NO: 12066 - DNA, 20 bp, Artificial Sequence
  Artificially Synthesized Primer Sequence
tgtgctgtcaaaagtgctcc

SEQ ID NO: 12067 - DNA, 20 bp, Artificial Sequence
  Artificially Synthesized Primer Sequence
atcaagcgaaacctgtgtga

SEQ ID NO: 12068 - DNA, 20 bp, Artificial Sequence
  Artificially Synthesized Primer Sequence
ctcaagggtctgtaccctgc

SEQ ID NO: 12069 - DNA, 20 bp, Artificial Sequence
  Artificially Synthesized Primer Sequence
ggagctattcatgaggctgc

SEQ ID NO: 12070 - DNA, 20 bp, Artificial Sequence
  Artificially Synthesized Primer Sequence
aaggaagccgtacccgtagt

SEQ ID NO: 12071 - DNA, 20 bp, Artificial Sequence
  Artificially Synthesized Primer Sequence
caatgtgacgatggcatagg

SEQ ID NO: 12072 - DNA, 20 bp, Artificial Sequence
  Artificially Synthesized Primer Sequence
aaatcgctgctgaccagagt

SEQ ID NO: 12073 - DNA, 20 bp, Artificial Sequence
  Artificially Synthesized Primer Sequence
ctcgagtccatcatctcgct

SEQ ID NO: 12074 - DNA, 20 bp, Artificial Sequence
  Artificially Synthesized Primer Sequence
acagctgttgcaggtgagtg

SEQ ID NO: 12075 - DNA, 20 bp, Artificial Sequence
  Artificially Synthesized Primer Sequence
tacacccaaatgcatggcta

SEQ ID NO: 12076 - DNA, 20 bp, Artificial Sequence
  Artificially Synthesized Primer Sequence
gagaacacgctgatccacag

SEQ ID NO: 12077 - DNA, 20 bp, Artificial Sequence
  Artificially Synthesized Primer Sequence
aattcctcgagcactgttgg

SEQ ID NO: 12078 - DNA, 20 bp, Artificial Sequence
  Artificially Synthesized Primer Sequence
ccttggaggagaggaagagg

SEQ ID NO: 12079 - DNA, 22 bp, Artificial Sequence
  Artificially Synthesized Primer Sequence
aaatgaaccagacatcactcca

SEQ ID NO: 12080 - DNA, 20 bp, Artificial Sequence
  Artificially Synthesized Primer Sequence
agaacgtcaactccgtcgtc

SEQ ID NO: 12081 - DNA, 20 bp, Artificial Sequence
  Artificially Synthesized Primer Sequence
tgctatgtgcaatcctctgc

SEQ ID NO: 12082 - DNA, 20 bp, Artificial Sequence
  Artificially Synthesized Primer Sequence
ctgttttggtgccgattctt

SEQ ID NO: 12083 - DNA, 20 bp, Artificial Sequence
  Artificially Synthesized Primer Sequence
attcatatgctgctggaggc

SEQ ID NO: 12084 - DNA, 20 bp, Artificial Sequence
  Artificially Synthesized Primer Sequence
tgacactctggaggcaacag

SEQ ID NO: 12085 - DNA, 20 bp, Artificial Sequence
  Artificially Synthesized Primer Sequence
cggagaaggtaatatgcgga

SEQ ID NO: 12086 - DNA, 20 bp, Artificial Sequence
  Artificially Synthesized Primer Sequence
ttgcatctgcaacagctttc

SEQ ID NO: 12087 - DNA, 20 bp, Artificial Sequence
  Artificially Synthesized Primer Sequence
cccggcacagttcctatcta

SEQ ID NO: 12088 - DNA, 20 bp, Artificial Sequence
  Artificially Synthesized Primer Sequence
aatgtgtccgccctcatatc

SEQ ID NO: 12089 - DNA, 20 bp, Artificial Sequence
  Artificially Synthesized Primer Sequence
tgttcgccacagtgaaaaag

SEQ ID NO: 12090 - DNA, 20 bp, Artificial Sequence
  Artificially Synthesized Primer Sequence
acggttaacaggcactggac

SEQ ID NO: 12091 - DNA, 20 bp, Artificial Sequence
  Artificially Synthesized Primer Sequence
gcttacggaacacagcgagt

SEQ ID NO: 12092 - DNA, 20 bp, Artificial Sequence
  Artificially Synthesized Primer Sequence
atgagccaatcaccagaagc

SEQ ID NO: 12093 - DNA, 20 bp, Artificial Sequence
  Artificially Synthesized Primer Sequence
ttcttgagcagacacatgcc

SEQ ID NO: 12094 - DNA, 20 bp, Artificial Sequence
  Artificially Synthesized Primer Sequence
ctaccaacccacctaagcca

SEQ ID NO: 12095 - DNA, 20 bp, Artificial Sequence
  Artificially Synthesized Primer Sequence
aatgtacaggcaggcagcat

SEQ ID NO: 12096 - DNA, 20 bp, Artificial Sequence
  Artificially Synthesized Primer Sequence
gatgatcaacgcttcccttg

SEQ ID NO: 12097 - DNA, 20 bp, Artificial Sequence
  Artificially Synthesized Primer Sequence
cgatccatgcgatttttctt

SEQ ID NO: 12098 - DNA, 20 bp, Artificial Sequence
  Artificially Synthesized Primer Sequence
cggttcctagtcggtgatgt

SEQ ID NO: 12099 - DNA, 20 bp, Artificial Sequence
  Artificially Synthesized Primer Sequence
ccacgagagtttccaaggac

SEQ ID NO: 12100 - DNA, 20 bp, Artificial Sequence
  Artificially Synthesized Primer Sequence
tgcttgagcagttactccga

SEQ ID NO: 12101 - DNA, 20 bp, Artificial Sequence
  Artificially Synthesized Primer Sequence
cttgcccaatttcatcctgt

SEQ ID NO: 12102 - DNA, 20 bp, Artificial Sequence
  Artificially Synthesized Primer Sequence
catttgagggtcccaaagaa

SEQ ID NO: 12103 - DNA, 20 bp, Artificial Sequence
  Artificially Synthesized Primer Sequence
acatccgcctggtaactacg

SEQ ID NO: 12104 - DNA, 20 bp, Artificial Sequence
  Artificially Synthesized Primer Sequence
aatcatgtacttgctggggc

SEQ ID NO: 12105 - DNA, 20 bp, Artificial Sequence
  Artificially Synthesized Primer Sequence
gctttaccggcacgtatgtt

SEQ ID NO: 12106 - DNA, 20 bp, Artificial Sequence
  Artificially Synthesized Primer Sequence
cttgttcagcccctccatta

SEQ ID NO: 12107 - DNA, 20 bp, Artificial Sequence
  Artificially Synthesized Primer Sequence
tgccatctcaaaagagcaca

SEQ ID NO: 12108 - DNA, 21 bp, Artificial Sequence
  Artificially Synthesized Primer Sequence
gcgttctcttgcataatggag

SEQ ID NO: 12109 - DNA, 20 bp, Artificial Sequence
  Artificially Synthesized Primer Sequence
tgtgttctctggaagcgatg

SEQ ID NO: 12110 - DNA, 20 bp, Artificial Sequence
  Artificially Synthesized Primer Sequence
ccacattggcgtccttatct

SEQ ID NO: 12111 - DNA, 20 bp, Artificial Sequence
  Artificially Synthesized Primer Sequence
ttgtcctccacaaacaacca

SEQ ID NO: 12112 - DNA, 20 bp, Artificial Sequence
  Artificially Synthesized Primer Sequence
ctttttgcctgagatttcgc

SEQ ID NO: 12113 - DNA, 20 bp, Artificial Sequence
  Artificially Synthesized Primer Sequence
cacgtcaccttcgtcaacac

SEQ ID NO: 12114 - DNA, 20 bp, Artificial Sequence
  Artificially Synthesized Primer Sequence
tcactgtgagtctgatcgcc

SEQ ID NO: 12115 - DNA, 20 bp, Artificial Sequence
  Artificially Synthesized Primer Sequence
catcatggattcatggagca

SEQ ID NO: 12116 - DNA, 20 bp, Artificial Sequence
  Artificially Synthesized Primer Sequence
cgggaaggtgatgaagaaga

SEQ ID NO: 12117 - DNA, 20 bp, Artificial Sequence
  Artificially Synthesized Primer Sequence
ttaaagcttggcgttgaggt

SEQ ID NO: 12118 - DNA, 20 bp, Artificial Sequence
  Artificially Synthesized Primer Sequence
cacaaattaaaaaggggcca

SEQ ID NO: 12119 - DNA, 20 bp, Artificial Sequence
  Artificially Synthesized Primer Sequence
aatgagtccgtctttgcagg

SEQ ID NO: 12120 - DNA, 20 bp, Artificial Sequence
  Artificially Synthesized Primer Sequence
tgggttgtggaattatcggt

SEQ ID NO: 12121 - DNA, 20 bp, Artificial Sequence
  Artificially Synthesized Primer Sequence
gccagcctgcgtattatgtt

SEQ ID NO: 12122 - DNA, 20 bp, Artificial Sequence
  Artificially Synthesized Primer Sequence
gtcagcagcaggagaaaacc

SEQ ID NO: 12123 - DNA, 20 bp, Artificial Sequence
  Artificially Synthesized Primer Sequence
ggtcgccgatgaaatcttag

SEQ ID NO: 12124 - DNA, 20 bp, Artificial Sequence
  Artificially Synthesized Primer Sequence
actggatgcaattttccgac

SEQ ID NO: 12125 - DNA, 20 bp, Artificial Sequence
  Artificially Synthesized Primer Sequence
gtagccatcgtgtcggaagt

SEQ ID NO: 12126 - DNA, 20 bp, Artificial Sequence
  Artificially Synthesized Primer Sequence
tgcagcttcagtagcaagga

SEQ ID NO: 12127 - DNA, 20 bp, Artificial Sequence
  Artificially Synthesized Primer Sequence
ggaccaaggaacttccaaca

SEQ ID NO: 12128 - DNA, 20 bp, Artificial Sequence
  Artificially Synthesized Primer Sequence
gcacaatcaagtcatgtggc

SEQ ID NO: 12129 - DNA, 20 bp, Artificial Sequence
  Artificially Synthesized Primer Sequence
ggccgaattttgctcattta

SEQ ID NO: 12130 - DNA, 20 bp, Artificial Sequence
  Artificially Synthesized Primer Sequence
atcacacagaccagatggca

SEQ ID NO: 12131 - DNA, 20 bp, Artificial Sequence
  Artificially Synthesized Primer Sequence
atcacacagaccagatggca

SEQ ID NO: 12132 - DNA, 20 bp, Artificial Sequence
  Artificially Synthesized Primer Sequence
aaggacctagacctgcggat

SEQ ID NO: 12133 - DNA, 20 bp, Artificial Sequence
  Artificially Synthesized Primer Sequence
gatgggtctgcatttggact

SEQ ID NO: 12134 - DNA, 20 bp, Artificial Sequence
  Artificially Synthesized Primer Sequence
agagggaagtgggaggaaaa

SEQ ID NO: 12135 - DNA, 20 bp, Artificial Sequence
  Artificially Synthesized Primer Sequence
aggcacacaagcaacaacag

SEQ ID NO: 12136 - DNA, 20 bp, Artificial Sequence
  Artificially Synthesized Primer Sequence
gttgtgagccatcgtgaaga

SEQ ID NO: 12137 - DNA, 20 bp, Artificial Sequence
  Artificially Synthesized Primer Sequence
tctacgtccctcgtgcttct

SEQ ID NO: 12138 - DNA, 20 bp, Artificial Sequence
  Artificially Synthesized Primer Sequence
aaggaaagggaaggagtgga

SEQ ID NO: 12139 - DNA, 20 bp, Artificial Sequence
  Artificially Synthesized Primer Sequence
tgacagcttagcttgctcca

SEQ ID NO: 12140 - DNA, 20 bp, Artificial Sequence
  Artificially Synthesized Primer Sequence
gatgcagtcagccatgaaga

SEQ ID NO: 12141 - DNA, 20 bp, Artificial Sequence
  Artificially Synthesized Primer Sequence
ccgcttttcgtcttgttttc

SEQ ID NO: 12142 - DNA, 20 bp, Artificial Sequence
  Artificially Synthesized Primer Sequence
aaaaataggcggagggagaa

SEQ ID NO: 12143 - DNA, 20 bp, Artificial Sequence
  Artificially Synthesized Primer Sequence
gcaacacgaataacgaaacg

SEQ ID NO: 12144 - DNA, 20 bp, Artificial Sequence
  Artificially Synthesized Primer Sequence
catcgagagcaaagaccaga

SEQ ID NO: 12145 - DNA, 20 bp, Artificial Sequence
  Artificially Synthesized Primer Sequence
gagaaaagcgaggctgtcac

SEQ ID NO: 12146 - DNA, 20 bp, Artificial Sequence
  Artificially Synthesized Primer Sequence
tcacttgtctcctcccatcc

SEQ ID NO: 12147 - DNA, 20 bp, Artificial Sequence
  Artificially Synthesized Primer Sequence
tcacttgtctcctcccatcc

SEQ ID NO: 12148 - DNA, 20 bp, Artificial Sequence
  Artificially Synthesized Primer Sequence
gagaaaagcgaggctgtcac

SEQ ID NO: 12149 - DNA, 20 bp, Artificial Sequence
  Artificially Synthesized Primer Sequence
gcagtggtaacaacgcagag

SEQ ID NO: 12150 - DNA, 20 bp, Artificial Sequence
  Artificially Synthesized Primer Sequence
caaagtttttctcacgggga

SEQ ID NO: 12151 - DNA, 20 bp, Artificial Sequence
  Artificially Synthesized Primer Sequence
gccaacatgctgctttcttt

SEQ ID NO: 12152 - DNA, 20 bp, Artificial Sequence
  Artificially Synthesized Primer Sequence
tccattgttccactgctttg

SEQ ID NO: 12153 - DNA, 20 bp, Artificial Sequence
  Artificially Synthesized Primer Sequence
tggccaagaaccagtacctc

SEQ ID NO: 12154 - DNA, 20 bp, Artificial Sequence
  Artificially Synthesized Primer Sequence
cgcgcttaataaggcttcac

SEQ ID NO: 12155 - DNA, 20 bp, Artificial Sequence
  Artificially Synthesized Primer Sequence
ctagccaacacgacaacgaa

SEQ ID NO: 12156 - DNA, 20 bp, Artificial Sequence
  Artificially Synthesized Primer Sequence
tggccaagaaccagtacctc

SEQ ID NO: 12157 - DNA, 20 bp, Artificial Sequence
  Artificially Synthesized Primer Sequence
cgtagaagggcatagaagcg

SEQ ID NO: 12158 - DNA, 20 bp, Artificial Sequence
  Artificially Synthesized Primer Sequence
gggcgttacgataatagcca

SEQ ID NO: 12159 - DNA, 20 bp, Artificial Sequence
  Artificially Synthesized Primer Sequence
tactgcgcttctatgccctt

SEQ ID NO: 12160 - DNA, 20 bp, Artificial Sequence
  Artificially Synthesized Primer Sequence
gagttcggcaacttccagac

SEQ ID NO: 12161 - DNA, 20 bp, Artificial Sequence
  Artificially Synthesized Primer Sequence
ggggtgttatccacaacagg

SEQ ID NO: 12162 - DNA, 20 bp, Artificial Sequence
  Artificially Synthesized Primer Sequence
aaacacggactaaacacccg

SEQ ID NO: 12163 - DNA, 20 bp, Artificial Sequence
  Artificially Synthesized Primer Sequence
gacacgacaaaaccggagag

SEQ ID NO: 12164 - DNA, 20 bp, Artificial Sequence
  Artificially Synthesized Primer Sequence
ggaggacctggtgaaggact

SEQ ID NO: 12165 - DNA, 20 bp, Artificial Sequence
  Artificially Synthesized Primer Sequence
ccgaggagagcagcaaatag

SEQ ID NO: 12166 - DNA, 20 bp, Artificial Sequence
  Artificially Synthesized Primer Sequence
tttttcatgcacaacctcca

SEQ ID NO: 12167 - DNA, 20 bp, Artificial Sequence
  Artificially Synthesized Primer Sequence
cacggatcaaagcagaaaca

SEQ ID NO: 12168 - DNA, 18 bp, Artificial Sequence
  Artificially Synthesized Primer Sequence
atcttctcgcccatgcac

SEQ ID NO: 12169 - DNA, 20 bp, Artificial Sequence
  Artificially Synthesized Primer Sequence
aaggcgcactacgtcaagtt

SEQ ID NO: 12170 - DNA, 20 bp, Artificial Sequence
  Artificially Synthesized Primer Sequence
gcgtgtcggagtaggagaag

SEQ ID NO: 12171 - DNA, 20 bp, Artificial Sequence
  Artificially Synthesized Primer Sequence
gccattgaggactggtgatt

SEQ ID NO: 12172 - DNA, 20 bp, Artificial Sequence
  Artificially Synthesized Primer Sequence
cacaacaaccactacgacgg

SEQ ID NO: 12173 - DNA, 20 bp, Artificial Sequence
  Artificially Synthesized Primer Sequence
cccggatccttcttttcttc

SEQ ID NO: 12174 - DNA, 20 bp, Artificial Sequence
  Artificially Synthesized Primer Sequence
cgtgctcactctctcagacg

SEQ ID NO: 12175 - DNA, 20 bp, Artificial Sequence
  Artificially Synthesized Primer Sequence
cattcacgtcagcagctcat

SEQ ID NO: 12176 - DNA, 20 bp, Artificial Sequence
  Artificially Synthesized Primer Sequence
tgaaagcaaatcggggatag

SEQ ID NO: 12177 - DNA, 20 bp, Artificial Sequence
  Artificially Synthesized Primer Sequence
cagcaattctgcacgaggta

SEQ ID NO: 12178 - DNA, 20 bp, Artificial Sequence
  Artificially Synthesized Primer Sequence
ggatcaaacaagcccagaaa

SEQ ID NO: 12179 - DNA, 20 bp, Artificial Sequence
  Artificially Synthesized Primer Sequence
tatgtatgcaccatcgtcgg

SEQ ID NO: 12180 - DNA, 20 bp, Artificial Sequence
  Artificially Synthesized Primer Sequence
tttctgggcttgtttgatcc

SEQ ID NO: 12181 - DNA, 20 bp, Artificial Sequence
  Artificially Synthesized Primer Sequence
gcaagcttcccttcttcctt

SEQ ID NO: 12182 - DNA, 20 bp, Artificial Sequence
  Artificially Synthesized Primer Sequence
tatgcgaagggctttcttgt

SEQ ID NO: 12183 - DNA, 20 bp, Artificial Sequence
  Artificially Synthesized Primer Sequence
attaaccaacaggcctctgc

SEQ ID NO: 12184 - DNA, 20 bp, Artificial Sequence
  Artificially Synthesized Primer Sequence
attccgctgtgataattggc

SEQ ID NO: 12185 - DNA, 20 bp, Artificial Sequence
  Artificially Synthesized Primer Sequence
acgagggcctaatcaaggat

SEQ ID NO: 12186 - DNA, 20 bp, Artificial Sequence
  Artificially Synthesized Primer Sequence
agaagacgccctttctgtga

SEQ ID NO: 12187 - DNA, 20 bp, Artificial Sequence
  Artificially Synthesized Primer Sequence
cgaacagaagtgagttgcca

SEQ ID NO: 12188 - DNA, 20 bp, Artificial Sequence
  Artificially Synthesized Primer Sequence
ttctttgacgattccgttcc

SEQ ID NO: 12189 - DNA, 20 bp, Artificial Sequence
  Artificially Synthesized Primer Sequence
atcggatcgatcttcacctg

SEQ ID NO: 12190 - DNA, 20 bp, Artificial Sequence
  Artificially Synthesized Primer Sequence
tcgtctggaaatgacagcag

SEQ ID NO: 12191 - DNA, 20 bp, Artificial Sequence
  Artificially Synthesized Primer Sequence
cgtctggaaatgacagcaga

SEQ ID NO: 12192 - DNA, 20 bp, Artificial Sequence
  Artificially Synthesized Primer Sequence
cggtccagcaggtatcctta

SEQ ID NO: 12193 - DNA, 20 bp, Artificial Sequence
  Artificially Synthesized Primer Sequence
tcggatccaaactaggcaac

SEQ ID NO: 12194 - DNA, 20 bp, Artificial Sequence
  Artificially Synthesized Primer Sequence
tgacaatgtccaaggcaaag

SEQ ID NO: 12195 - DNA, 20 bp, Artificial Sequence
  Artificially Synthesized Primer Sequence
tggtacaatgtcgtagcgga

SEQ ID NO: 12196 - DNA, 20 bp, Artificial Sequence
  Artificially Synthesized Primer Sequence
atcggttgagctccacactc

SEQ ID NO: 12197 - DNA, 20 bp, Artificial Sequence
  Artificially Synthesized Primer Sequence
ccaaatcgctagctcagtcc

SEQ ID NO: 12198 - DNA, 20 bp, Artificial Sequence
  Artificially Synthesized Primer Sequence
actcaagctgtagggccaga

SEQ ID NO: 12199 - DNA, 20 bp, Artificial Sequence
  Artificially Synthesized Primer Sequence
tgtttggacaagaagtcgga

SEQ ID NO: 12200 - DNA, 20 bp, Artificial Sequence
  Artificially Synthesized Primer Sequence
ggggagtttgatcatgccta

SEQ ID NO: 12201 - DNA, 20 bp, Artificial Sequence
  Artificially Synthesized Primer Sequence
aacctccaacaacaaccagc

SEQ ID NO: 12202 - DNA, 20 bp, Artificial Sequence
  Artificially Synthesized Primer Sequence
atcgtcctcatcctcctcct

SEQ ID NO: 12203 - DNA, 21 bp, Artificial Sequence
  Artificially Synthesized Primer Sequence
tctgactgaagaaatgccaca

SEQ ID NO: 12204 - DNA, 19 bp, Artificial Sequence
  Artificially Synthesized Primer Sequence
cgacgatgccatgagctac

SEQ ID NO: 12205 - DNA, 20 bp, Artificial Sequence
  Artificially Synthesized Primer Sequence
atattcgcccgttttatccc

SEQ ID NO: 12206 - DNA, 20 bp, Artificial Sequence
  Artificially Synthesized Primer Sequence
cagtatgatcgcaagcagga

SEQ ID NO: 12207 - DNA, 20 bp, Artificial Sequence
  Artificially Synthesized Primer Sequence
acagaaaggcacacaaccct

SEQ ID NO: 12208 - DNA, 20 bp, Artificial Sequence
  Artificially Synthesized Primer Sequence
ctggaggagacaccttggag

SEQ ID NO: 12209 - DNA, 20 bp, Artificial Sequence
  Artificially Synthesized Primer Sequence
actcgccctcactaaaccct

SEQ ID NO: 12210 - DNA, 20 bp, Artificial Sequence
  Artificially Synthesized Primer Sequence
atgacatcgcagtcttgctg

SEQ ID NO: 12211 - DNA, 20 bp, Artificial Sequence
  Artificially Synthesized Primer Sequence
gaaagctagggatgctgcaa

SEQ ID NO: 12212 - DNA, 20 bp, Artificial Sequence
  Artificially Synthesized Primer Sequence
aaaaagaagaagcccaagcc

SEQ ID NO: 12213 - DNA, 20 bp, Artificial Sequence
  Artificially Synthesized Primer Sequence
tcgaagacaatgctggagtg

SEQ ID NO: 12214 - DNA, 20 bp, Artificial Sequence
  Artificially Synthesized Primer Sequence
gttccactatttcccaggca

SEQ ID NO: 12215 - DNA, 20 bp, Artificial Sequence
  Artificially Synthesized Primer Sequence
gttccactatttcccaggca

SEQ ID NO: 12216 - DNA, 20 bp, Artificial Sequence
  Artificially Synthesized Primer Sequence
ctccgtcaagggtatcaagg

SEQ ID NO: 12217 - DNA, 20 bp, Artificial Sequence
  Artificially Synthesized Primer Sequence
gtttggacgaaataagccca

SEQ ID NO: 12218 - DNA, 20 bp, Artificial Sequence
  Artificially Synthesized Primer Sequence
catgatgtgccaccctgtag

SEQ ID NO: 12219 - DNA, 20 bp, Artificial Sequence
  Artificially Synthesized Primer Sequence
aatcaaaccagaccagacgg

SEQ ID NO: 12220 - DNA, 20 bp, Artificial Sequence
  Artificially Synthesized Primer Sequence
gttctcgctggacaaagagg

SEQ ID NO: 12221 - DNA, 20 bp, Artificial Sequence
  Artificially Synthesized Primer Sequence
aattgaagtggcagaggtgg

SEQ ID NO: 12222 - DNA, 20 bp, Artificial Sequence
  Artificially Synthesized Primer Sequence
ccgcatactggtgtacatgc

SEQ ID NO: 12223 - DNA, 20 bp, Artificial Sequence
  Artificially Synthesized Primer Sequence
ctttgcatggctgatgaaga

SEQ ID NO: 12224 - DNA, 20 bp, Artificial Sequence
  Artificially Synthesized Primer Sequence
caatctgatggggagcactt

SEQ ID NO: 12225 - DNA, 20 bp, Artificial Sequence
  Artificially Synthesized Primer Sequence
ggttcactttcggtgcgtat

SEQ ID NO: 12226 - DNA, 20 bp, Artificial Sequence
  Artificially Synthesized Primer Sequence
ggcacccattgtttcactct

SEQ ID NO: 12227 - DNA, 20 bp, Artificial Sequence
  Artificially Synthesized Primer Sequence
gtagcgctatgcgttcttcc

SEQ ID NO: 12228 - DNA, 20 bp, Artificial Sequence
  Artificially Synthesized Primer Sequence
agagtgaaacaatgggtgcc

SEQ ID NO: 12229 - DNA, 20 bp, Artificial Sequence
  Artificially Synthesized Primer Sequence
ggcatgtcagagtgaagcaa

SEQ ID NO: 12230 - DNA, 20 bp, Artificial Sequence
  Artificially Synthesized Primer Sequence
gaacttcctgatctgcctcg

SEQ ID NO: 12231 - DNA, 20 bp, Artificial Sequence
  Artificially Synthesized Primer Sequence
aatgcacaggaggcataacc

SEQ ID NO: 12232 - DNA, 20 bp, Artificial Sequence
  Artificially Synthesized Primer Sequence
gaaattcaatctggagggca

SEQ ID NO: 12233 - DNA, 20 bp, Artificial Sequence
  Artificially Synthesized Primer Sequence
tgtactggccacaaaaccaa

SEQ ID NO: 12234 - DNA, 20 bp, Artificial Sequence
  Artificially Synthesized Primer Sequence
tgtaattgtggtatccgcga

SEQ ID NO: 12235 - DNA, 20 bp, Artificial Sequence
  Artificially Synthesized Primer Sequence
gcgatctcataacgggaaga

SEQ ID NO: 12236 - DNA, 20 bp, Artificial Sequence
  Artificially Synthesized Primer Sequence
gtcgccactcctatggaaaa

SEQ ID NO: 12237 - DNA, 20 bp, Artificial Sequence
  Artificially Synthesized Primer Sequence
ctattgtgatagccggggaa

SEQ ID NO: 12238 - DNA, 20 bp, Artificial Sequence
  Artificially Synthesized Primer Sequence
gaattagggaagaatcgccc

SEQ ID NO: 12239 - DNA, 20 bp, Artificial Sequence
  Artificially Synthesized Primer Sequence
ccccggctatcacaatagaa

SEQ ID NO: 12240 - DNA, 20 bp, Artificial Sequence
  Artificially Synthesized Primer Sequence
ccagaagaaccgaagaccag

SEQ ID NO: 12241 - DNA, 20 bp, Artificial Sequence
  Artificially Synthesized Primer Sequence
cctccgccaagttctacaag

SEQ ID NO: 12242 - DNA, 20 bp, Artificial Sequence
  Artificially Synthesized Primer Sequence
tttccgtggcaaggagatac

SEQ ID NO: 12243 - DNA, 20 bp, Artificial Sequence
  Artificially Synthesized Primer Sequence
gccccaaaggaaagaacagt

SEQ ID NO: 12244 - DNA, 20 bp, Artificial Sequence
  Artificially Synthesized Primer Sequence
atggagggaggaggaggtag

SEQ ID NO: 12245 - DNA, 20 bp, Artificial Sequence
  Artificially Synthesized Primer Sequence
acccccaaagggttatgaag

SEQ ID NO: 12246 - DNA, 20 bp, Artificial Sequence
  Artificially Synthesized Primer Sequence
caccggcaagtattggatct

SEQ ID NO: 12247 - DNA, 20 bp, Artificial Sequence
  Artificially Synthesized Primer Sequence
caacctagcatcgctcatca

SEQ ID NO: 12248 - DNA, 20 bp, Artificial Sequence
  Artificially Synthesized Primer Sequence
attcgtcaagaaatgggcac

SEQ ID NO: 12249 - DNA, 20 bp, Artificial Sequence
  Artificially Synthesized Primer Sequence
taccctcaacccatctggtc

SEQ ID NO: 12250 - DNA, 20 bp, Artificial Sequence
  Artificially Synthesized Primer Sequence
caaattgagcagaactggca

SEQ ID NO: 12251 - DNA, 20 bp, Artificial Sequence
  Artificially Synthesized Primer Sequence
cattgctctcgtgaactcca

SEQ ID NO: 12252 - DNA, 20 bp, Artificial Sequence
  Artificially Synthesized Primer Sequence
tttgttgtagccactgacgg

SEQ ID NO: 12253 - DNA, 20 bp, Artificial Sequence
  Artificially Synthesized Primer Sequence
tcgaatggacacgacatgat

SEQ ID NO: 12254 - DNA, 20 bp, Artificial Sequence
  Artificially Synthesized Primer Sequence
ttgagggtggatgtctgtga

SEQ ID NO: 12255 - DNA, 20 bp, Artificial Sequence
  Artificially Synthesized Primer Sequence
acgcatatgcaaagtggtca

SEQ ID NO: 12256 - DNA, 20 bp, Artificial Sequence
  Artificially Synthesized Primer Sequence
tactgaagcaatggtggcag

SEQ ID NO: 12257 - DNA, 20 bp, Artificial Sequence
  Artificially Synthesized Primer Sequence
ggtcgtacccattatcaccg

SEQ ID NO: 12258 - DNA, 20 bp, Artificial Sequence
  Artificially Synthesized Primer Sequence
tccataccgttcttcttgcc

SEQ ID NO: 12259 - DNA, 20 bp, Artificial Sequence
  Artificially Synthesized Primer Sequence
gggaagcaacaaaggtcaaa

SEQ ID NO: 12260 - DNA, 20 bp, Artificial Sequence
  Artificially Synthesized Primer Sequence
agggcaacacaatcggtatc

SEQ ID NO: 12261 - DNA, 20 bp, Artificial Sequence
  Artificially Synthesized Primer Sequence
acttctccttcgccctcttc

SEQ ID NO: 12262 - DNA, 20 bp, Artificial Sequence
  Artificially Synthesized Primer Sequence
accgaagacgatgatacgct

SEQ ID NO: 12263 - DNA, 20 bp, Artificial Sequence
  Artificially Synthesized Primer Sequence
gacttctccttcgccctctt

SEQ ID NO: 12264 - DNA, 20 bp, Artificial Sequence
  Artificially Synthesized Primer Sequence
aggcctcgttaacgtcgtag

SEQ ID NO: 12265 - DNA, 20 bp, Artificial Sequence
  Artificially Synthesized Primer Sequence
tgtacaacaaagcaggctgg

SEQ ID NO: 12266 - DNA, 20 bp, Artificial Sequence
  Artificially Synthesized Primer Sequence
gcagaactcgttgaatccgt

SEQ ID NO: 12267 - DNA, 20 bp, Artificial Sequence
  Artificially Synthesized Primer Sequence
tcaacacatgcccacaattt

SEQ ID NO: 12268 - DNA, 20 bp, Artificial Sequence
  Artificially Synthesized Primer Sequence
acctgtcgtcctacaccacc

SEQ ID NO: 12269 - DNA, 20 bp, Artificial Sequence
  Artificially Synthesized Primer Sequence
actactcgggcaccatgaac

SEQ ID NO: 12270 - DNA, 20 bp, Artificial Sequence
  Artificially Synthesized Primer Sequence
agcatacacccaccctcttg

SEQ ID NO: 12271 - DNA, 20 bp, Artificial Sequence
  Artificially Synthesized Primer Sequence
aacgagcatacacccacctc

SEQ ID NO: 12272 - DNA, 20 bp, Artificial Sequence
  Artificially Synthesized Primer Sequence
actactcgggcaccatgaac

SEQ ID NO: 12273 - DNA, 20 bp, Artificial Sequence
  Artificially Synthesized Primer Sequence
tatcggattgtgtgcctgaa

SEQ ID NO: 12274 - DNA, 20 bp, Artificial Sequence
  Artificially Synthesized Primer Sequence
gcaagagaaaggcacagacc

SEQ ID NO: 12275 - DNA, 20 bp, Artificial Sequence
  Artificially Synthesized Primer Sequence
tgatgctattacggctccaa

SEQ ID NO: 12276 - DNA, 19 bp, Artificial Sequence
  Artificially Synthesized Primer Sequence
tggaggatcaaaagcgttg

SEQ ID NO: 12277 - DNA, 20 bp, Artificial Sequence
  Artificially Synthesized Primer Sequence
aataagcgccagttgacacc

SEQ ID NO: 12278 - DNA, 20 bp, Artificial Sequence
  Artificially Synthesized Primer Sequence
aacaggcccaatgtgatagc

SEQ ID NO: 12279 - DNA, 20 bp, Artificial Sequence
  Artificially Synthesized Primer Sequence
cgccttcgacacaactgata

SEQ ID NO: 12280 - DNA, 20 bp, Artificial Sequence
  Artificially Synthesized Primer Sequence
accttcctcaagtcacaggc

SEQ ID NO: 12281 - DNA, 20 bp, Artificial Sequence
  Artificially Synthesized Primer Sequence
aggccacacagattacaggg

SEQ ID NO: 12282 - DNA, 20 bp, Artificial Sequence
  Artificially Synthesized Primer Sequence
tccagtcagcagtccaagtg

SEQ ID NO: 12283 - DNA, 20 bp, Artificial Sequence
  Artificially Synthesized Primer Sequence
atacatgcatgccattgtgg

SEQ ID NO: 12284 - DNA, 20 bp, Artificial Sequence
  Artificially Synthesized Primer Sequence
atccatccactgtttgaggg

SEQ ID NO: 12285 - DNA, 20 bp, Artificial Sequence
  Artificially Synthesized Primer Sequence
caactcttgggatggacgtt

SEQ ID NO: 12286 - DNA, 20 bp, Artificial Sequence
  Artificially Synthesized Primer Sequence
ggggctccaatttttctctc

SEQ ID NO: 12287 - DNA, 20 bp, Artificial Sequence
  Artificially Synthesized Primer Sequence
ttaatctgggcaagctccac

SEQ ID NO: 12288 - DNA, 20 bp, Artificial Sequence
  Artificially Synthesized Primer Sequence
gagcatccgttcagcctatc

SEQ ID NO: 12289 - DNA, 20 bp, Artificial Sequence
  Artificially Synthesized Primer Sequence
tgcactgttattagcgtggc

SEQ ID NO: 12290 - DNA, 20 bp, Artificial Sequence
  Artificially Synthesized Primer Sequence
tatttggtctgacgaagccc

SEQ ID NO: 12291 - DNA, 20 bp, Artificial Sequence
  Artificially Synthesized Primer Sequence
tatttggtctgacgaagccc

SEQ ID NO: 12292 - DNA, 20 bp, Artificial Sequence
  Artificially Synthesized Primer Sequence
tgcactgttattagcgtggc

SEQ ID NO: 12293 - DNA, 20 bp, Artificial Sequence
  Artificially Synthesized Primer Sequence
aatgctctgctgtcgacctt

SEQ ID NO: 12294 - DNA, 20 bp, Artificial Sequence
  Artificially Synthesized Primer Sequence
aacgggaacgagaggagaat

SEQ ID NO: 12295 - DNA, 20 bp, Artificial Sequence
  Artificially Synthesized Primer Sequence
acgtgaagtgaagggcagag

SEQ ID NO: 12296 - DNA, 20 bp, Artificial Sequence
  Artificially Synthesized Primer Sequence
cgtctgtgcaagcctagttg

SEQ ID NO: 12297 - DNA, 20 bp, Artificial Sequence
  Artificially Synthesized Primer Sequence
acttgatcggcatatccctc

SEQ ID NO: 12298 - DNA, 19 bp, Artificial Sequence
  Artificially Synthesized Primer Sequence
catagtgcgacacacgcag

SEQ ID NO: 12299 - DNA, 20 bp, Artificial Sequence
  Artificially Synthesized Primer Sequence
gctcgtcgttcaaacaaaca

SEQ ID NO: 12300 - DNA, 20 bp, Artificial Sequence
  Artificially Synthesized Primer Sequence
gctcagctgggtgaactacc

SEQ ID NO: 12301 - DNA, 20 bp, Artificial Sequence
  Artificially Synthesized Primer Sequence
gagagaagcgtggcaagaag

SEQ ID NO: 12302 - DNA, 20 bp, Artificial Sequence
  Artificially Synthesized Primer Sequence
gcccgttccaaaggatataa

SEQ ID NO: 12303 - DNA, 20 bp, Artificial Sequence
  Artificially Synthesized Primer Sequence
cagccaaggtttcagtcgat

SEQ ID NO: 12304 - DNA, 20 bp, Artificial Sequence
  Artificially Synthesized Primer Sequence
ggagtgttggttggtctggt

SEQ ID NO: 12305 - DNA, 20 bp, Artificial Sequence
  Artificially Synthesized Primer Sequence
agctacagggagatgaggca

SEQ ID NO: 12306 - DNA, 20 bp, Artificial Sequence
  Artificially Synthesized Primer Sequence
atgtactcacggccacaaca

SEQ ID NO: 12307 - DNA, 20 bp, Artificial Sequence
  Artificially Synthesized Primer Sequence
atgtactcacggccacaaca

SEQ ID NO: 12308 - DNA, 20 bp, Artificial Sequence
  Artificially Synthesized Primer Sequence
agctacagggagatgaggca

SEQ ID NO: 12309 - DNA, 20 bp, Artificial Sequence
  Artificially Synthesized Primer Sequence
cacatccgatcctgttgttg

SEQ ID NO: 12310 - DNA, 20 bp, Artificial Sequence
  Artificially Synthesized Primer Sequence
gaatacaaggcgcggaaata

SEQ ID NO: 12311 - DNA, 20 bp, Artificial Sequence
  Artificially Synthesized Primer Sequence
agaatctcccaggtcccaag

SEQ ID NO: 12312 - DNA, 18 bp, Artificial Sequence
  Artificially Synthesized Primer Sequence
accttcatggtgaacggc

SEQ ID NO: 12313 - DNA, 20 bp, Artificial Sequence
  Artificially Synthesized Primer Sequence
gaggtggtgtccttctccaa

SEQ ID NO: 12314 - DNA, 20 bp, Artificial Sequence
  Artificially Synthesized Primer Sequence
gtcagttcaggagcgcctac

SEQ ID NO: 12315 - DNA, 20 bp, Artificial Sequence
  Artificially Synthesized Primer Sequence
gtcagttcaggagcgcctac

SEQ ID NO: 12316 - DNA, 20 bp, Artificial Sequence
  Artificially Synthesized Primer Sequence
ctgctacaaggaggtggtgc

SEQ ID NO: 12317 - DNA, 20 bp, Artificial Sequence
  Artificially Synthesized Primer Sequence
aattgatcaacccttgcctg

SEQ ID NO: 12318 - DNA, 20 bp, Artificial Sequence
  Artificially Synthesized Primer Sequence
acatcccaagtccataagcg

SEQ ID NO: 12319 - DNA, 20 bp, Artificial Sequence
  Artificially Synthesized Primer Sequence
cacattagcaagcgcacaat

SEQ ID NO: 12320 - DNA, 20 bp, Artificial Sequence
  Artificially Synthesized Primer Sequence
aattgatcaacccttgcctg

SEQ ID NO: 12321 - DNA, 20 bp, Artificial Sequence
  Artificially Synthesized Primer Sequence
aggacccatacgtcaccaaa

SEQ ID NO: 12322 - DNA, 20 bp, Artificial Sequence
  Artificially Synthesized Primer Sequence
ccgttgaaggtgcagttctt

SEQ ID NO: 12323 - DNA, 19 bp, Artificial Sequence
  Artificially Synthesized Primer Sequence
gatcatgcatcgttgagcc

SEQ ID NO: 12324 - DNA, 20 bp, Artificial Sequence
  Artificially Synthesized Primer Sequence
ccctacatctgcatggacct

SEQ ID NO: 12325 - DNA, 20 bp, Artificial Sequence
  Artificially Synthesized Primer Sequence
gctgagctacccagacaagg

SEQ ID NO: 12326 - DNA, 20 bp, Artificial Sequence
  Artificially Synthesized Primer Sequence
aattggactgtatgccgagg

SEQ ID NO: 12327 - DNA, 20 bp, Artificial Sequence
  Artificially Synthesized Primer Sequence
tgtcacctcgaattcagcac

SEQ ID NO: 12328 - DNA, 19 bp, Artificial Sequence
  Artificially Synthesized Primer Sequence
taagcaatggcatccaagg

SEQ ID NO: 12329 - DNA, 10 bp, Artificial Sequence
  Artificially Synthesized Primer Sequence
  MISC_FEATURE (1)..(10): n stands for any base
nnnnnnnnnn

SEQ ID NO: 12330 - DNA, 10 bp, Artificial Sequence
  Artificially Synthesized Primer Sequence
  MISC_FEATURE (1)..(10): n stands for any base
nnnnnnnnnn

SEQ ID NO: 12331 - DNA, 20 bp, Artificial Sequence
  Artificially Synthesized Primer Sequence
tgctctgcatttcattcagc

SEQ ID NO: 12332 - DNA, 20 bp, Artificial Sequence
  Artificially Synthesized Primer Sequence
cagcgttacaggcattctca

SEQ ID NO: 12333 - DNA, 20 bp, Artificial Sequence
  Artificially Synthesized Primer Sequence
ctacatgctgcagagaccca

SEQ ID NO: 12334 - DNA, 20 bp, Artificial Sequence
  Artificially Synthesized Primer Sequence
atccgatgcatcccaagtag

SEQ ID NO: 12335 - DNA, 20 bp, Artificial Sequence
  Artificially Synthesized Primer Sequence
acacaggtgctccaacaaca

SEQ ID NO: 12336 - DNA, 20 bp, Artificial Sequence
  Artificially Synthesized Primer Sequence
ctacatgctgcagagaccca

SEQ ID NO: 12337 - DNA, 20 bp, Artificial Sequence
  Artificially Synthesized Primer Sequence
ctgctgctccaccactgata

SEQ ID NO: 12338 - DNA, 20 bp, Artificial Sequence
  Artificially Synthesized Primer Sequence
aattctcgagctagaggccc

SEQ ID NO: 12339 - DNA, 20 bp, Artificial Sequence
  Artificially Synthesized Primer Sequence
tctcaactatggcaacccaa

SEQ ID NO: 12340 - DNA, 20 bp, Artificial Sequence
  Artificially Synthesized Primer Sequence
atcacgcaattgagcctttt

SEQ ID NO: 12341 - DNA, 20 bp, Artificial Sequence
  Artificially Synthesized Primer Sequence
agcagaggttcgatgatgct

SEQ ID NO: 12342 - DNA, 20 bp, Artificial Sequence
  Artificially Synthesized Primer Sequence
gagcgtaacgtgcaagaaca

SEQ ID NO: 12343 - DNA, 20 bp, Artificial Sequence
  Artificially Synthesized Primer Sequence
tgtcgagcaatttgttcctg

SEQ ID NO: 12344 - DNA, 20 bp, Artificial Sequence
  Artificially Synthesized Primer Sequence
tggaaagctccaagctgttt

SEQ ID NO: 12345 - DNA, 20 bp, Artificial Sequence
  Artificially Synthesized Primer Sequence
tccaagggtttctgaacgac

SEQ ID NO: 12346 - DNA, 20 bp, Artificial Sequence
  Artificially Synthesized Primer Sequence
ccaccatgtgaaagtgcatc

SEQ ID NO: 12347 - DNA, 20 bp, Artificial Sequence
  Artificially Synthesized Primer Sequence
ggagctctggtagcagcaat

SEQ ID NO: 12348 - DNA, 20 bp, Artificial Sequence
  Artificially Synthesized Primer Sequence
cctcaggtacaatgatgggg

SEQ ID NO: 12349 - DNA, 20 bp, Artificial Sequence
  Artificially Synthesized Primer Sequence
agatggcctccacattcatc

SEQ ID NO: 12350 - DNA, 20 bp, Artificial Sequence
  Artificially Synthesized Primer Sequence
gcaaccaccttccatgagtt

SEQ ID NO: 12351 - DNA, 20 bp, Artificial Sequence
  Artificially Synthesized Primer Sequence
cccttccatgagttttctgc

SEQ ID NO: 12352 - DNA, 20 bp, Artificial Sequence
  Artificially Synthesized Primer Sequence
gacgtccatccaggagatgt

SEQ ID NO: 12353 - DNA, 20 bp, Artificial Sequence
  Artificially Synthesized Primer Sequence
gatcagaagcttgactgggc

SEQ ID NO: 12354 - DNA, 20 bp, Artificial Sequence
  Artificially Synthesized Primer Sequence
aagccttggacatggttcac

SEQ ID NO: 12355 - DNA, 20 bp, Artificial Sequence
  Artificially Synthesized Primer Sequence
aacgtatgcgtgtcctctcc

SEQ ID NO: 12356 - DNA, 20 bp, Artificial Sequence
  Artificially Synthesized Primer Sequence
gcggatgaagctcaagtagc

SEQ ID NO: 12357 - DNA, 20 bp, Artificial Sequence
  Artificially Synthesized Primer Sequence
gaaggcaagctgctaaaacg

SEQ ID NO: 12358 - DNA, 20 bp, Artificial Sequence
  Artificially Synthesized Primer Sequence
gcacacctccaatgtgtttg

SEQ ID NO: 12359 - DNA, 20 bp, Artificial Sequence
  Artificially Synthesized Primer Sequence
aatgtttctagcctgtgccc

SEQ ID NO: 12360 - DNA, 20 bp, Artificial Sequence
  Artificially Synthesized Primer Sequence
caaacacattggaggtgtgc

SEQ ID NO: 12361 - DNA, 20 bp, Artificial Sequence
  Artificially Synthesized Primer Sequence
cttggttgccctagcttcac

SEQ ID NO: 12362 - DNA, 20 bp, Artificial Sequence
  Artificially Synthesized Primer Sequence
agggccttggatatctcgtt

SEQ ID NO: 12363 - DNA, 20 bp, Artificial Sequence
  Artificially Synthesized Primer Sequence
attgcgtacactgatggtgc

SEQ ID NO: 12364 - DNA, 20 bp, Artificial Sequence
  Artificially Synthesized Primer Sequence
agagacatgctgctttggct

SEQ ID NO: 12365 - DNA, 18 bp, Artificial Sequence
  Artificially Synthesized Primer Sequence
ctcctgctccacctgcac

SEQ ID NO: 12366 - DNA, 18 bp, Artificial Sequence
  Artificially Synthesized Primer Sequence
acctgcaggagctgggat

SEQ ID NO: 12367 - DNA, 20 bp, Artificial Sequence
  Artificially Synthesized Primer Sequence
gccagctttcctaagagcaa

SEQ ID NO: 12368 - DNA, 20 bp, Artificial Sequence
  Artificially Synthesized Primer Sequence
agagcgataatggacggatg

SEQ ID NO: 12369 - DNA, 20 bp, Artificial Sequence
  Artificially Synthesized Primer Sequence
ggatctgataaaatcgcgga

SEQ ID NO: 12370 - DNA, 20 bp, Artificial Sequence
  Artificially Synthesized Primer Sequence
ccactgtaagcagcgaacaa

SEQ ID NO: 12371 - DNA, 20 bp, Artificial Sequence
  Artificially Synthesized Primer Sequence
ttccggactatgaaaccctg

SEQ ID NO: 12372 - DNA, 20 bp, Artificial Sequence
  Artificially Synthesized Primer Sequence
ttgttcgctgcttacagtgg

SEQ ID NO: 12373 - DNA, 20 bp, Artificial Sequence
  Artificially Synthesized Primer Sequence
aacacgggctttattgaacg

SEQ ID NO: 12374 - DNA, 20 bp, Artificial Sequence
  Artificially Synthesized Primer Sequence
gttgaaaacaaagctgggga

SEQ ID NO: 12375 - DNA, 20 bp, Artificial Sequence
  Artificially Synthesized Primer Sequence
aaacaaagctggggaatgtg

SEQ ID NO: 12376 - DNA, 20 bp, Artificial Sequence
  Artificially Synthesized Primer Sequence
ggccattgactttgctgact

SEQ ID NO: 12377 - DNA, 18 bp, Artificial Sequence
  Artificially Synthesized Primer Sequence
ggtcactgccgacctcaa

SEQ ID NO: 12378 - DNA, 20 bp, Artificial Sequence
  Artificially Synthesized Primer Sequence
acgctcagagggcataacac

SEQ ID NO: 12379 - DNA, 20 bp, Artificial Sequence
  Artificially Synthesized Primer Sequence
caacagccggataaaactgc

SEQ ID NO: 12380 - DNA, 20 bp, Artificial Sequence
  Artificially Synthesized Primer Sequence
ggatagctgaaccgaatgga

SEQ ID NO: 12381 - DNA, 20 bp, Artificial Sequence
  Artificially Synthesized Primer Sequence
cgctttgtgaatttccccta

SEQ ID NO: 12382 - DNA, 20 bp, Artificial Sequence
  Artificially Synthesized Primer Sequence
tattccgacaccaaagcctc

SEQ ID NO: 12383 - DNA, 20 bp, Artificial Sequence
  Artificially Synthesized Primer Sequence
cagagcattttcatggagca

SEQ ID NO: 12384 - DNA, 20 bp, Artificial Sequence
  Artificially Synthesized Primer Sequence
ctatccgaagttggaggacg

SEQ ID NO: 12385 - DNA, 20 bp, Artificial Sequence
  Artificially Synthesized Primer Sequence
cggatacccttttggctaca

SEQ ID NO: 12386 - DNA, 20 bp, Artificial Sequence
  Artificially Synthesized Primer Sequence
gacgacagcgtttcttcctc

SEQ ID NO: 12387 - DNA, 20 bp, Artificial Sequence
  Artificially Synthesized Primer Sequence
cctgctatggtgggtagcat

SEQ ID NO: 12388 - DNA, 20 bp, Artificial Sequence
  Artificially Synthesized Primer Sequence
aagtgaaccatgtccaaggc

SEQ ID NO: 12389 - DNA, 20 bp, Artificial Sequence
  Artificially Synthesized Primer Sequence
ggtaccaccaatatgtcccg

SEQ ID NO: 12390 - DNA, 20 bp, Artificial Sequence
  Artificially Synthesized Primer Sequence
tgcagtttcatctctgaccg

SEQ ID NO: 12391 - DNA, 20 bp, Artificial Sequence
  Artificially Synthesized Primer Sequence
atcaactatgcacgcaacca

SEQ ID NO: 12392 - DNA, 20 bp, Artificial Sequence
  Artificially Synthesized Primer Sequence
aaggtttcagcggtcagaga

SEQ ID NO: 12393 - DNA, 20 bp, Artificial Sequence
  Artificially Synthesized Primer Sequence
acgatgaggacatggaggag

SEQ ID NO: 12394 - DNA, 20 bp, Artificial Sequence
  Artificially Synthesized Primer Sequence
gcacggtgatccttacaggt

SEQ ID NO: 12395 - DNA, 20 bp, Artificial Sequence
  Artificially Synthesized Primer Sequence
gcacggtgatccttacaggt

SEQ ID NO: 12396 - DNA, 20 bp, Artificial Sequence
  Artificially Synthesized Primer Sequence
gatgaggacatggaggagga

SEQ ID NO: 12397 - DNA, 20 bp, Artificial Sequence
  Artificially Synthesized Primer Sequence
ttgagtgtccttgtcgcttg

SEQ ID NO: 12398 - DNA, 20 bp, Artificial Sequence
  Artificially Synthesized Primer Sequence
ggctcgaacacttcgttctc

SEQ ID NO: 12399 - DNA, 20 bp, Artificial Sequence
  Artificially Synthesized Primer Sequence
aaccttattgcatgccgaac

SEQ ID NO: 12400 - DNA, 20 bp, Artificial Sequence
  Artificially Synthesized Primer Sequence
tcatctcggtgctagtgacg

SEQ ID NO: 12401 - DNA, 18 bp, Artificial Sequence
  Artificially Synthesized Primer Sequence
ggccgatacatcctgcac

SEQ ID NO: 12402 - DNA, 18 bp, Artificial Sequence
  Artificially Synthesized Primer Sequence
gaggagggaggcgaatgt

SEQ ID NO: 12403 - DNA, 22 bp, Artificial Sequence
  Artificially Synthesized Primer Sequence
ttgagatgacaaatccacgact

SEQ ID NO: 12404 - DNA, 20 bp, Artificial Sequence
  Artificially Synthesized Primer Sequence
aaactgcagagatgatgccc

SEQ ID NO: 12405 - DNA, 20 bp, Artificial Sequence
  Artificially Synthesized Primer Sequence
gtgctccgatctaacgcttc

SEQ ID NO: 12406 - DNA, 20 bp, Artificial Sequence
  Artificially Synthesized Primer Sequence
gacaaaacaatgccgcctat

SEQ ID NO: 12407 - DNA, 20 bp, Artificial Sequence
  Artificially Synthesized Primer Sequence
gcctatggtttggatggttg

SEQ ID NO: 12408 - DNA, 20 bp, Artificial Sequence
  Artificially Synthesized Primer Sequence
ctcgtggagaaagccaaaag

SEQ ID NO: 12409 - DNA, 20 bp, Artificial Sequence
  Artificially Synthesized Primer Sequence
aaatccaaatcgcctctcct

SEQ ID NO: 12410 - DNA, 20 bp, Artificial Sequence
  Artificially Synthesized Primer Sequence
gaatcgctggagaactttgc

SEQ ID NO: 12411 - DNA, 20 bp, Artificial Sequence
  Artificially Synthesized Primer Sequence
gcaactgcaagcaaacacat

SEQ ID NO: 12412 - DNA, 20 bp, Artificial Sequence
  Artificially Synthesized Primer Sequence
gtgagcagcaacaagaccaa

SEQ ID NO: 12413 - DNA, 20 bp, Artificial Sequence
  Artificially Synthesized Primer Sequence
cctcatctgacctggttggt

SEQ ID NO: 12414 - DNA, 20 bp, Artificial Sequence
  Artificially Synthesized Primer Sequence
aaatgcctctcgatgtccac

SEQ ID NO: 12415 - DNA, 20 bp, Artificial Sequence
  Artificially Synthesized Primer Sequence
actagcatcgccttgtgctt

SEQ ID NO: 12416 - DNA, 20 bp, Artificial Sequence
  Artificially Synthesized Primer Sequence
agacgagggggtgacagata

SEQ ID NO: 12417 - DNA, 20 bp, Artificial Sequence
  Artificially Synthesized Primer Sequence
aaatggccctgaaacaagtg

SEQ ID NO: 12418 - DNA, 20 bp, Artificial Sequence
  Artificially Synthesized Primer Sequence
tgggacggaaaagaaagatg

SEQ ID NO: 12419 - DNA, 20 bp, Artificial Sequence
  Artificially Synthesized Primer Sequence
tctactgctgcatcacctgg

SEQ ID NO: 12420 - DNA, 20 bp, Artificial Sequence
  Artificially Synthesized Primer Sequence
agccgacacaagagaggatg

SEQ ID NO: 12421 - DNA, 20 bp, Artificial Sequence
  Artificially Synthesized Primer Sequence
aattcctcgagcactgttgg

SEQ ID NO: 12422 - DNA, 20 bp, Artificial Sequence
  Artificially Synthesized Primer Sequence
tctgactggtgagggggtag

SEQ ID NO: 12423 - DNA, 21 bp, Artificial Sequence
  Artificially Synthesized Primer Sequence
tatctgaatacccaagcaggc

SEQ ID NO: 12424 - DNA, 20 bp, Artificial Sequence
  Artificially Synthesized Primer Sequence
cgtgacgagcagatggatac

SEQ ID NO: 12425 - DNA, 20 bp, Artificial Sequence
  Artificially Synthesized Primer Sequence
catgtgttggcattttctgg

SEQ ID NO: 12426 - DNA, 20 bp, Artificial Sequence
  Artificially Synthesized Primer Sequence
ccgattctgttggcctttta

SEQ ID NO: 12427 - DNA, 20 bp, Artificial Sequence
  Artificially Synthesized Primer Sequence
catgccgatgaacaaatcag

SEQ ID NO: 12428 - DNA, 20 bp, Artificial Sequence
  Artificially Synthesized Primer Sequence
catcatgaacttcttccgca

SEQ ID NO: 12429 - DNA, 20 bp, Artificial Sequence
  Artificially Synthesized Primer Sequence
ctcttggaggtactcacggc

SEQ ID NO: 12430 - DNA, 20 bp, Artificial Sequence
  Artificially Synthesized Primer Sequence
aggctgaccgagaaggaaat

SEQ ID NO: 12431 - DNA, 20 bp, Artificial Sequence
  Artificially Synthesized Primer Sequence
ttgctcggcgaaaatataca

SEQ ID NO: 12432 - DNA, 20 bp, Artificial Sequence
  Artificially Synthesized Primer Sequence
catggaccagtctgctctga

SEQ ID NO: 12433 - DNA, 20 bp, Artificial Sequence
  Artificially Synthesized Primer Sequence
ttgttactttcctccgtggg

SEQ ID NO: 12434 - DNA, 20 bp, Artificial Sequence
  Artificially Synthesized Primer Sequence
agggggtaattcacccaaac

SEQ ID NO: 12435 - DNA, 20 bp, Artificial Sequence
  Artificially Synthesized Primer Sequence
cccacggaggaaagtaacaa

SEQ ID NO: 12436 - DNA, 20 bp, Artificial Sequence
  Artificially Synthesized Primer Sequence
cgaagaagaaaaccacccaa

SEQ ID NO: 12437 - DNA, 20 bp, Artificial Sequence
  Artificially Synthesized Primer Sequence
gtggcagcgatccatcttat

SEQ ID NO: 12438 - DNA, 20 bp, Artificial Sequence
  Artificially Synthesized Primer Sequence
attctgctttcccgatgatg

SEQ ID NO: 12439 - DNA, 20 bp, Artificial Sequence
  Artificially Synthesized Primer Sequence
aaccgtcatttctgcaggtc

SEQ ID NO: 12440 - DNA, 20 bp, Artificial Sequence
  Artificially Synthesized Primer Sequence
agccgagaaagtggacaaga

SEQ ID NO: 12441 - DNA, 20 bp, Artificial Sequence
  Artificially Synthesized Primer Sequence
gccatcgttatggttatggg

SEQ ID NO: 12442 - DNA, 20 bp, Artificial Sequence
  Artificially Synthesized Primer Sequence
cccctgtacgacttgaggaa

SEQ ID NO: 12443 - DNA, 20 bp, Artificial Sequence
  Artificially Synthesized Primer Sequence
agcatcgatcttcccatctg

SEQ ID NO: 12444 - DNA, 20 bp, Artificial Sequence
  Artificially Synthesized Primer Sequence
aaaccctctcgatcacctca

SEQ ID NO: 12445 - DNA, 20 bp, Artificial Sequence
  Artificially Synthesized Primer Sequence
ttgctccgtttttatccacc

SEQ ID NO: 12446 - DNA, 20 bp, Artificial Sequence
  Artificially Synthesized Primer Sequence
cctctcgaggatgaacttgc

SEQ ID NO: 12447 - DNA, 20 bp, Artificial Sequence
  Artificially Synthesized Primer Sequence
tgtacacacgaacgacgaca

SEQ ID NO: 12448 - DNA, 20 bp, Artificial Sequence
  Artificially Synthesized Primer Sequence
gcgtttgagaaggaccagag

SEQ ID NO: 12449 - DNA, 20 bp, Artificial Sequence
  Artificially Synthesized Primer Sequence
ctactccagtggcatgcaga

SEQ ID NO: 12450 - DNA, 20 bp, Artificial Sequence
  Artificially Synthesized Primer Sequence
ctagcctgtccacccatgat

SEQ ID NO: 12451 - DNA, 20 bp, Artificial Sequence
  Artificially Synthesized Primer Sequence
gcctctcatgacagcatcaa

SEQ ID NO: 12452 - DNA, 20 bp, Artificial Sequence
  Artificially Synthesized Primer Sequence
catgggtggacaggctagtt

SEQ ID NO: 12453 - DNA, 20 bp, Artificial Sequence
  Artificially Synthesized Primer Sequence
agtcatgggccacaggatac

SEQ ID NO: 12454 - DNA, 20 bp, Artificial Sequence
  Artificially Synthesized Primer Sequence
ccggcggaataatagagtga

SEQ ID NO: 12455 - DNA, 20 bp, Artificial Sequence
  Artificially Synthesized Primer Sequence
cacaacaaaattgtcgctgc

SEQ ID NO: 12456 - DNA, 20 bp, Artificial Sequence
  Artificially Synthesized Primer Sequence
tgaattcgtgacagctggag

SEQ ID NO: 12457 - DNA, 20 bp, Artificial Sequence
  Artificially Synthesized Primer Sequence
gtcgtcgacctggagaacat

SEQ ID NO: 12458 - DNA, 20 bp, Artificial Sequence
  Artificially Synthesized Primer Sequence
cacatgaagccgaggaactt

SEQ ID NO: 12459 - DNA, 20 bp, Artificial Sequence
  Artificially Synthesized Primer Sequence
ccaggaaggaagcatttcat

SEQ ID NO: 12460 - DNA, 20 bp, Artificial Sequence
  Artificially Synthesized Primer Sequence
atcgagaccatccagcagtc

SEQ ID NO: 12461 - DNA, 20 bp, Artificial Sequence
  Artificially Synthesized Primer Sequence
ttccaaggggagatgagatg

SEQ ID NO: 12462 - DNA, 20 bp, Artificial Sequence
  Artificially Synthesized Primer Sequence
taagggaacgtacgaccagc

SEQ ID NO: 12463 - DNA, 20 bp, Artificial Sequence
  Artificially Synthesized Primer Sequence
catctcatctccccttggaa

SEQ ID NO: 12464 - DNA, 20 bp, Artificial Sequence
  Artificially Synthesized Primer Sequence
caggtcattttcctcaaccc

SEQ ID NO: 12465 - DNA, 20 bp, Artificial Sequence
  Artificially Synthesized Primer Sequence
gccaaccctgatgacagttt

SEQ ID NO: 12466 - DNA, 20 bp, Artificial Sequence
  Artificially Synthesized Primer Sequence
tcattcaggccacaaaatca

SEQ ID NO: 12467 - DNA, 20 bp, Artificial Sequence
  Artificially Synthesized Primer Sequence
tgctataccccatgctctcc

SEQ ID NO: 12468 - DNA, 19 bp, Artificial Sequence
  Artificially Synthesized Primer Sequence
atgtatcgctgacgttggg

SEQ ID NO: 12469 - DNA, 20 bp, Artificial Sequence
  Artificially Synthesized Primer Sequence
cctcgcatagcctacgtcat

SEQ ID NO: 12470 - DNA, 20 bp, Artificial Sequence
  Artificially Synthesized Primer Sequence
gcctttatgaagcggtcaag

SEQ ID NO: 12471 - DNA, 21 bp, Artificial Sequence
  Artificially Synthesized Primer Sequence
cctcagcctcagtctcaaatg

SEQ ID NO: 12472 - DNA, 20 bp, Artificial Sequence
  Artificially Synthesized Primer Sequence
tgtacgaccagaccagacca

SEQ ID NO: 12473 - DNA, 20 bp, Artificial Sequence
  Artificially Synthesized Primer Sequence
tgctttcaacaggatgcttg

SEQ ID NO: 12474 - DNA, 20 bp, Artificial Sequence
  Artificially Synthesized Primer Sequence
agcacagtaaattggcctgg

SEQ ID NO: 12475 - DNA, 20 bp, Artificial Sequence
  Artificially Synthesized Primer Sequence
tacatgagcagccaggtgaa

SEQ ID NO: 12476 - DNA, 20 bp, Artificial Sequence
  Artificially Synthesized Primer Sequence
tggacagggaagacgtaagg

SEQ ID NO: 12477 - DNA, 20 bp, Artificial Sequence
  Artificially Synthesized Primer Sequence
gtgagcgagtaccccattgt

SEQ ID NO: 12478 - DNA, 20 bp, Artificial Sequence
  Artificially Synthesized Primer Sequence
ggacagaccaacagccaaat

SEQ ID NO: 12479 - DNA, 20 bp, Artificial Sequence
  Artificially Synthesized Primer Sequence
atatccgtcgttccgttcac

SEQ ID NO: 12480 - DNA, 20 bp, Artificial Sequence
  Artificially Synthesized Primer Sequence
tcatgcaatgctcttctgct

SEQ ID NO: 12481 - DNA, 20 bp, Artificial Sequence
  Artificially Synthesized Primer Sequence
tgatggttgtggcaggaata

SEQ ID NO: 12482 - DNA, 20 bp, Artificial Sequence
  Artificially Synthesized Primer Sequence
tcgatgttattccaaagccc

SEQ ID NO: 12483 - DNA, 20 bp, Artificial Sequence
  Artificially Synthesized Primer Sequence
tctattcgcgacacatcgtc

SEQ ID NO: 12484 - DNA, 20 bp, Artificial Sequence
  Artificially Synthesized Primer Sequence
gccatcttgtgctatccgtt

SEQ ID NO: 12485 - DNA, 20 bp, Artificial Sequence
  Artificially Synthesized Primer Sequence
acaccattgtccattcagca

SEQ ID NO: 12486 - DNA, 20 bp, Artificial Sequence
  Artificially Synthesized Primer Sequence
aaccattagggccaaaggac

SEQ ID NO: 12487 - DNA, 20 bp, Artificial Sequence
  Artificially Synthesized Primer Sequence
cgtacaaagctccctcgaac

SEQ ID NO: 12488 - DNA, 20 bp, Artificial Sequence
  Artificially Synthesized Primer Sequence
atccctgtgctgttctggac

SEQ ID NO: 12489 - DNA, 20 bp, Artificial Sequence
  Artificially Synthesized Primer Sequence
ccccctcactcacattccta

SEQ ID NO: 12490 - DNA, 20 bp, Artificial Sequence
  Artificially Synthesized Primer Sequence
tagtgttgggttgggagagg

SEQ ID NO: 12491 - DNA, 20 bp, Artificial Sequence
  Artificially Synthesized Primer Sequence
ttgattttatggggcgtctc

SEQ ID NO: 12492 - DNA, 20 bp, Artificial Sequence
  Artificially Synthesized Primer Sequence
tttttccatcgcagtcatca

SEQ ID NO: 12493 - DNA, 20 bp, Artificial Sequence
  Artificially Synthesized Primer Sequence
cacagcgtcaaagtttccaa

SEQ ID NO: 12494 - DNA, 20 bp, Artificial Sequence
  Artificially Synthesized Primer Sequence
cctcctccatttatccgtca

SEQ ID NO: 12495 - DNA, 20 bp, Artificial Sequence
  Artificially Synthesized Primer Sequence
agtgtttgagtacagcgcga

SEQ ID NO: 12496 - DNA, 20 bp, Artificial Sequence
  Artificially Synthesized Primer Sequence
tgacggataaatggaggagg

SEQ ID NO: 12497 - DNA, 20 bp, Artificial Sequence
  Artificially Synthesized Primer Sequence
tgatggttgtggcaggaata

SEQ ID NO: 12498 - DNA, 20 bp, Artificial Sequence
  Artificially Synthesized Primer Sequence
agcgttccaaatacgtggtc

SEQ ID NO: 12499 - DNA, 20 bp, Artificial Sequence
  Artificially Synthesized Primer Sequence
aatgaacgaccctggtgcta

SEQ ID NO: 12500 - DNA, 20 bp, Artificial Sequence
  Artificially Synthesized Primer Sequence
ctcgttcgatccagcaaaat

SEQ ID NO: 12501 - DNA, 20 bp, Artificial Sequence
  Artificially Synthesized Primer Sequence
acctcaacaaggtgacggac

SEQ ID NO: 12502 - DNA, 20 bp, Artificial Sequence
  Artificially Synthesized Primer Sequence
cagatttcaggtccggttgt

SEQ ID NO: 12503 - DNA, 20 bp, Artificial Sequence
  Artificially Synthesized Primer Sequence
acactggctgacacatggaa

SEQ ID NO: 12504 - DNA, 20 bp, Artificial Sequence
  Artificially Synthesized Primer Sequence
ttgctcagaggcctgaaaat

SEQ ID NO: 12505 - DNA, 20 bp, Artificial Sequence
  Artificially Synthesized Primer Sequence
acctcaacaaggtgacggac

SEQ ID NO: 12506 - DNA, 20 bp, Artificial Sequence
  Artificially Synthesized Primer Sequence
ccaaagccagaaagaagacg

SEQ ID NO: 12507 - DNA, 20 bp, Artificial Sequence
  Artificially Synthesized Primer Sequence
ccagaaggccaacacagagt

SEQ ID NO: 12508 - DNA, 20 bp, Artificial Sequence
  Artificially Synthesized Primer Sequence
ttgctggttgggatctcttc

SEQ ID NO: 12509 - DNA, 20 bp, Artificial Sequence
  Artificially Synthesized Primer Sequence
tttcacgctgattgttgagc

SEQ ID NO: 12510 - DNA, 20 bp, Artificial Sequence
  Artificially Synthesized Primer Sequence
ctccagtttgatgaacccgt

SEQ ID NO: 12511 - DNA, 20 bp, Artificial Sequence
  Artificially Synthesized Primer Sequence
ggtgacgatgaatccaggac

SEQ ID NO: 12512 - DNA, 20 bp, Artificial Sequence
  Artificially Synthesized Primer Sequence
gtgaggtacaagtccggcag

SEQ ID NO: 12513 - DNA, 20 bp, Artificial Sequence
  Artificially Synthesized Primer Sequence
tccctctttgctttccttga

SEQ ID NO: 12514 - DNA, 20 bp, Artificial Sequence
  Artificially Synthesized Primer Sequence
aacgtaccaggccagtcatc

SEQ ID NO: 12515 - DNA, 20 bp, Artificial Sequence
  Artificially Synthesized Primer Sequence
cccatcatgcaacaacaaag

SEQ ID NO: 12516 - DNA, 20 bp, Artificial Sequence
  Artificially Synthesized Primer Sequence
gttgtgaagtgggcaaggtt

SEQ ID NO: 12517 - DNA, 20 bp, Artificial Sequence
  Artificially Synthesized Primer Sequence
caaatcgcacattccagatg

SEQ ID NO: 12518 - DNA, 20 bp, Artificial Sequence
  Artificially Synthesized Primer Sequence
cgagctttcacgatttctcc

SEQ ID NO: 12519 - DNA, 20 bp, Artificial Sequence
  Artificially Synthesized Primer Sequence
gtttggtgttctcccagcat

SEQ ID NO: 12520 - DNA, 20 bp, Artificial Sequence
  Artificially Synthesized Primer Sequence
gtttccagagactgcaaggg

SEQ ID NO: 12521 - DNA, 20 bp, Artificial Sequence
  Artificially Synthesized Primer Sequence
gtacgtatgaatgcccgctt

SEQ ID NO: 12522 - DNA, 20 bp, Artificial Sequence
  Artificially Synthesized Primer Sequence
gcgcagtgaaaagtaggacc

SEQ ID NO: 12523 - DNA, 20 bp, Artificial Sequence
  Artificially Synthesized Primer Sequence
cacgggacatgaagattgtg

SEQ ID NO: 12524 - DNA, 19 bp, Artificial Sequence
  Artificially Synthesized Primer Sequence
gtcactctgttcagcgcct

SEQ ID NO: 12525 - DNA, 20 bp, Artificial Sequence
  Artificially Synthesized Primer Sequence
gtcgactacctgatccgctc

SEQ ID NO: 12526 - DNA, 20 bp, Artificial Sequence
  Artificially Synthesized Primer Sequence
ggagaaggaaaacccaaagc

SEQ ID NO: 12527 - DNA, 20 bp, Artificial Sequence
  Artificially Synthesized Primer Sequence
agaccgttactcatggaccg

SEQ ID NO: 12528 - DNA, 20 bp, Artificial Sequence
  Artificially Synthesized Primer Sequence
gtgggctcgtcaaactgaat

SEQ ID NO: 12529 - DNA, 20 bp, Artificial Sequence
  Artificially Synthesized Primer Sequence
ttatggatcaaggtgcgtca

SEQ ID NO: 12530 - DNA, 20 bp, Artificial Sequence
  Artificially Synthesized Primer Sequence
caccacagttggtgatcctg

SEQ ID NO: 12531 - DNA, 20 bp, Artificial Sequence
  Artificially Synthesized Primer Sequence
tacgagcactgcttactgcg

SEQ ID NO: 12532 - DNA, 20 bp, Artificial Sequence
  Artificially Synthesized Primer Sequence
atccacacccacatgtgcta

SEQ ID NO: 12533 - DNA, 20 bp, Artificial Sequence
  Artificially Synthesized Primer Sequence
ctcaagtttgccctcgagtc

SEQ ID NO: 12534 - DNA, 20 bp, Artificial Sequence
  Artificially Synthesized Primer Sequence
agcactgggacggtatcaac

SEQ ID NO: 12535 - DNA, 20 bp, Artificial Sequence
  Artificially Synthesized Primer Sequence
acatcctgccgagaaacaac

SEQ ID NO: 12536 - DNA, 20 bp, Artificial Sequence
  Artificially Synthesized Primer Sequence
gtgtacgacatccactcccc

SEQ ID NO: 12537 - DNA, 20 bp, Artificial Sequence
  Artificially Synthesized Primer Sequence
ggatcccagctacaagtgga

SEQ ID NO: 12538 - DNA, 20 bp, Artificial Sequence
  Artificially Synthesized Primer Sequence
gctcggcattagttcgtttc

SEQ ID NO: 12539 - DNA, 20 bp, Artificial Sequence
  Artificially Synthesized Primer Sequence
gctcggcattagttcgtttc

SEQ ID NO: 12540 - DNA, 20 bp, Artificial Sequence
  Artificially Synthesized Primer Sequence
ggatcccagctacaagtgga

SEQ ID NO: 12541 - DNA, 20 bp, Artificial Sequence
  Artificially Synthesized Primer Sequence
gggaggaatgcaaaagtcaa

SEQ ID NO: 12542 - DNA, 20 bp, Artificial Sequence
  Artificially Synthesized Primer Sequence
gaagagagggggagaggaaa

SEQ ID NO: 12543 - DNA, 20 bp, Artificial Sequence
  Artificially Synthesized Primer Sequence
gtccgtccgtaacaaaggaa

SEQ ID NO: 12544 - DNA, 20 bp, Artificial Sequence
  Artificially Synthesized Primer Sequence
tgcgattgataaactgcgag

SEQ ID NO: 12545 - DNA, 20 bp, Artificial Sequence
  Artificially Synthesized Primer Sequence
gcactgttggcctactggat

SEQ ID NO: 12546 - DNA, 20 bp, Artificial Sequence
  Artificially Synthesized Primer Sequence
tctcattctgtcgagcatgg

SEQ ID NO: 12547 - DNA, 20 bp, Artificial Sequence
  Artificially Synthesized Primer Sequence
caaagggatctcctggtcaa

SEQ ID NO: 12548 - DNA, 20 bp, Artificial Sequence
  Artificially Synthesized Primer Sequence
cgatgatcctttccttccag

SEQ ID NO: 12549 - DNA, 20 bp, Artificial Sequence
  Artificially Synthesized Primer Sequence
tgacactgcctctcaacctg

SEQ ID NO: 12550 - DNA, 20 bp, Artificial Sequence
  Artificially Synthesized Primer Sequence
gcaattcgcttctttcttgc

SEQ ID NO: 12551 - DNA, 20 bp, Artificial Sequence
  Artificially Synthesized Primer Sequence
gcaattcgcttctttcttgc

SEQ ID NO: 12552 - DNA, 20 bp, Artificial Sequence
  Artificially Synthesized Primer Sequence
tgacactgcctctcaacctg

SEQ ID NO: 12553 - DNA, 20 bp, Artificial Sequence
  Artificially Synthesized Primer Sequence
caacttagagtcggccttgc

SEQ ID NO: 12554 - DNA, 20 bp, Artificial Sequence
  Artificially Synthesized Primer Sequence
cattggagttcgcaacagtg

SEQ ID NO: 12555 - DNA, 20 bp, Artificial Sequence
  Artificially Synthesized Primer Sequence
acactcttttgcagctcggt

SEQ ID NO: 12556 - DNA, 20 bp, Artificial Sequence
  Artificially Synthesized Primer Sequence
tcaattgcaagctcacttgg

SEQ ID NO: 12557 - DNA, 20 bp, Artificial Sequence
  Artificially Synthesized Primer Sequence
atggcatcggtagtgctttc

SEQ ID NO: 12558 - DNA, 20 bp, Artificial Sequence
  Artificially Synthesized Primer Sequence
cacccagagagtgcaaacaa

SEQ ID NO: 12559 - DNA, 20 bp, Artificial Sequence
  Artificially Synthesized Primer Sequence
cttctccaaacaaacgccat

SEQ ID NO: 12560 - DNA, 20 bp, Artificial Sequence
  Artificially Synthesized Primer Sequence
ctgcaacctcctcaaagcat

SEQ ID NO: 12561 - DNA, 20 bp, Artificial Sequence
  Artificially Synthesized Primer Sequence
caggaattcggaacgaggta

SEQ ID NO: 12562 - DNA, 20 bp, Artificial Sequence
  Artificially Synthesized Primer Sequence
cgcttagcctcaaactggtc

SEQ ID NO: 12563 - DNA, 20 bp, Artificial Sequence
  Artificially Synthesized Primer Sequence
cgaggtgcgactgaacctat

SEQ ID NO: 12564 - DNA, 20 bp, Artificial Sequence
  Artificially Synthesized Primer Sequence
aatgggacatgtcttgagcc

SEQ ID NO: 12565 - DNA, 20 bp, Artificial Sequence
  Artificially Synthesized Primer Sequence
tttgtagcaccatgagcagc

SEQ ID NO: 12566 - DNA, 20 bp, Artificial Sequence
  Artificially Synthesized Primer Sequence
tcctctccatgatcccaaag

SEQ ID NO: 12567 - DNA, 20 bp, Artificial Sequence
  Artificially Synthesized Primer Sequence
acaacatccgacacccaaat

SEQ ID NO: 12568 - DNA, 20 bp, Artificial Sequence
  Artificially Synthesized Primer Sequence
cgacttgaagctgcactgac

SEQ ID NO: 12569 - DNA, 20 bp, Artificial Sequence
  Artificially Synthesized Primer Sequence
cgggtcatgtgcatacagtc

SEQ ID NO: 12570 - DNA, 20 bp, Artificial Sequence
  Artificially Synthesized Primer Sequence
aggcggggtaaggtcttaaa

SEQ ID NO: 12571 - DNA, 20 bp, Artificial Sequence
  Artificially Synthesized Primer Sequence
aaggtggaataaccagcacg

SEQ ID NO: 12572 - DNA, 20 bp, Artificial Sequence
  Artificially Synthesized Primer Sequence
cgggtcatgtgcatacagtc

SEQ ID NO: 12573 - DNA, 20 bp, Artificial Sequence
  Artificially Synthesized Primer Sequence
tgtttcctttaccagacccg

SEQ ID NO: 12574 - DNA, 20 bp, Artificial Sequence
  Artificially Synthesized Primer Sequence
aagtaatgtcagggcaaccg

SEQ ID NO: 12575 - DNA, 21 bp, Artificial Sequence
  Artificially Synthesized Primer Sequence
gccctatccaaagaaaacagc

SEQ ID NO: 12576 - DNA, 20 bp, Artificial Sequence
  Artificially Synthesized Primer Sequence
aaggtgcttcagatgagcgt

SEQ ID NO: 12577 - DNA, 20 bp, Artificial Sequence
  Artificially Synthesized Primer Sequence
cctctgggacaaactgtcgt

SEQ ID NO: 12578 - DNA, 20 bp, Artificial Sequence
  Artificially Synthesized Primer Sequence
ggaggtgaagcaccattgat

SEQ ID NO: 12579 - DNA, 20 bp, Artificial Sequence
  Artificially Synthesized Primer Sequence
gagacatcagctccctctgc

SEQ ID NO: 12580 - DNA, 20 bp, Artificial Sequence
  Artificially Synthesized Primer Sequence
cagcatgacaaccaccagac

SEQ ID NO: 12581 - DNA, 20 bp, Artificial Sequence
  Artificially Synthesized Primer Sequence
gtttcatcaggcagaggagc

SEQ ID NO: 12582 - DNA, 20 bp, Artificial Sequence
  Artificially Synthesized Primer Sequence
gtagagaagtgtttcgccgc

SEQ ID NO: 12583 - DNA, 20 bp, Artificial Sequence
  Artificially Synthesized Primer Sequence
tagtcctccgtcaggcattt

SEQ ID NO: 12584 - DNA, 20 bp, Artificial Sequence
  Artificially Synthesized Primer Sequence
gcggcgaaacacttctctac

SEQ ID NO: 12585 - DNA, 20 bp, Artificial Sequence
  Artificially Synthesized Primer Sequence
gtttcccttgatagcggtga

SEQ ID NO: 12586 - DNA, 20 bp, Artificial Sequence
  Artificially Synthesized Primer Sequence
cgaacacccagttcttccat

SEQ ID NO: 12587 - DNA, 20 bp, Artificial Sequence
  Artificially Synthesized Primer Sequence
gacttctttgcttgggtgct

SEQ ID NO: 12588 - DNA, 20 bp, Artificial Sequence
  Artificially Synthesized Primer Sequence
taggaaatatccaccgccaa

SEQ ID NO: 12589 - DNA, 20 bp, Artificial Sequence
  Artificially Synthesized Primer Sequence
tcgctcaaacaatcatcagc

SEQ ID NO: 12590 - DNA, 20 bp, Artificial Sequence
  Artificially Synthesized Primer Sequence
accactaccagtgcctggac

SEQ ID NO: 12591 - DNA, 20 bp, Artificial Sequence
  Artificially Synthesized Primer Sequence
cgttcggttcttcatccttc

SEQ ID NO: 12592 - DNA, 20 bp, Artificial Sequence
  Artificially Synthesized Primer Sequence
tcgctcaaacaatcatcagc

SEQ ID NO: 12593 - DNA, 20 bp, Artificial Sequence
  Artificially Synthesized Primer Sequence
gaggtctccgtcaagtctgc

SEQ ID NO: 12594 - DNA, 20 bp, Artificial Sequence
  Artificially Synthesized Primer Sequence
tccatgaaacattgcgaaaa

SEQ ID NO: 12595 - DNA, 20 bp, Artificial Sequence
  Artificially Synthesized Primer Sequence
cgaatccagttatcgcatga

SEQ ID NO: 12596 - DNA, 20 bp, Artificial Sequence
  Artificially Synthesized Primer Sequence
acttgccctcaacaggctaa

SEQ ID NO: 12597 - DNA, 20 bp, Artificial Sequence
  Artificially Synthesized Primer Sequence
acatcttgtgggagctgctt

SEQ ID NO: 12598 - DNA, 20 bp, Artificial Sequence
  Artificially Synthesized Primer Sequence
tctacggttctgccatgttg

SEQ ID NO: 12599 - DNA, 20 bp, Artificial Sequence
  Artificially Synthesized Primer Sequence
ccagatcaacaaacaccacg

SEQ ID NO: 12600 - DNA, 20 bp, Artificial Sequence
  Artificially Synthesized Primer Sequence
tggagtcatctgaagcgatg

SEQ ID NO: 12601 - DNA, 20 bp, Artificial Sequence
  Artificially Synthesized Primer Sequence
attagagggggtgtggttcc

SEQ ID NO: 12602 - DNA, 20 bp, Artificial Sequence
  Artificially Synthesized Primer Sequence
ccaacacattgcttcaatcg

SEQ ID NO: 12603 - DNA, 20 bp, Artificial Sequence
  Artificially Synthesized Primer Sequence
ctgtgtgtaaggtggtgcgt

SEQ ID NO: 12604 - DNA, 20 bp, Artificial Sequence
  Artificially Synthesized Primer Sequence
agcagcctcgaatcatcatc

SEQ ID NO: 12605 - DNA, 20 bp, Artificial Sequence
  Artificially Synthesized Primer Sequence
tcactcctcgaggctaggaa

SEQ ID NO: 12606 - DNA, 20 bp, Artificial Sequence
  Artificially Synthesized Primer Sequence
ccagaccccctaaaaagctc

SEQ ID NO: 12607 - DNA, 20 bp, Artificial Sequence
  Artificially Synthesized Primer Sequence
gaaattagcttgggcttccc

SEQ ID NO: 12608 - DNA, 20 bp, Artificial Sequence
  Artificially Synthesized Primer Sequence
ccactccgcgtaatcttgtt

SEQ ID NO: 12609 - DNA, 20 bp, Artificial Sequence
  Artificially Synthesized Primer Sequence
aagatcagccacggctctaa

SEQ ID NO: 12610 - DNA, 20 bp, Artificial Sequence
  Artificially Synthesized Primer Sequence
ttttgagggcatcatgttca

SEQ ID NO: 12611 - DNA, 20 bp, Artificial Sequence
  Artificially Synthesized Primer Sequence
cgaagccatcctattggaaa

SEQ ID NO: 12612 - DNA, 20 bp, Artificial Sequence
  Artificially Synthesized Primer Sequence
ttcaggcctgctactttgct

SEQ ID NO: 12613 - DNA, 20 bp, Artificial Sequence
  Artificially Synthesized Primer Sequence
acaagaatggttcgaatggc

SEQ ID NO: 12614 - DNA, 20 bp, Artificial Sequence
  Artificially Synthesized Primer Sequence
aggagaatgtctcgctccaa

SEQ ID NO: 12615 - DNA, 20 bp, Artificial Sequence
  Artificially Synthesized Primer Sequence
tcgtcgcatggtatcaaaaa

SEQ ID NO: 12616 - DNA, 20 bp, Artificial Sequence
  Artificially Synthesized Primer Sequence
cttcgaaacagcgagagagc

SEQ ID NO: 12617 - DNA, 20 bp, Artificial Sequence
  Artificially Synthesized Primer Sequence
tttgaaggggcaaatgactc

SEQ ID NO: 12618 - DNA, 20 bp, Artificial Sequence
  Artificially Synthesized Primer Sequence
tttcaaataaccctggctgg

SEQ ID NO: 12619 - DNA, 20 bp, Artificial Sequence
  Artificially Synthesized Primer Sequence
ggattacagtggggctgaaa

SEQ ID NO: 12620 - DNA, 20 bp, Artificial Sequence
  Artificially Synthesized Primer Sequence
tgctggaaatgctaatgcag

SEQ ID NO: 12621 - DNA, 20 bp, Artificial Sequence
  Artificially Synthesized Primer Sequence
aatcttgcatccgaaaatgc

SEQ ID NO: 12622 - DNA, 20 bp, Artificial Sequence
  Artificially Synthesized Primer Sequence
aaaacaattagcgcacaccc

SEQ ID NO: 12623 - DNA, 20 bp, Artificial Sequence
  Artificially Synthesized Primer Sequence
gcattttcggatgcaagatt

SEQ ID NO: 12624 - DNA, 21 bp, Artificial Sequence
  Artificially Synthesized Primer Sequence
tttgtccgaagagagaaacga

SEQ ID NO: 12625 - DNA, 20 bp, Artificial Sequence
  Artificially Synthesized Primer Sequence
ctagggggaaggagatggag

SEQ ID NO: 12626 - DNA, 20 bp, Artificial Sequence
  Artificially Synthesized Primer Sequence
ctgggacattgggtaacacc

SEQ ID NO: 12627 - DNA, 20 bp, Artificial Sequence
  Artificially Synthesized Primer Sequence
attgggtaacaccttgaccg

SEQ ID NO: 12628 - DNA, 20 bp, Artificial Sequence
  Artificially Synthesized Primer Sequence
acccgatggtagtggaactg

SEQ ID NO: 12629 - DNA, 20 bp, Artificial Sequence
  Artificially Synthesized Primer Sequence
gacttcgtcttcggcaactc

SEQ ID NO: 12630 - DNA, 20 bp, Artificial Sequence
  Artificially Synthesized Primer Sequence
gtaatgacgcggaacacctt

SEQ ID NO: 12631 - DNA, 20 bp, Artificial Sequence
  Artificially Synthesized Primer Sequence
atgacgatgacattttccgc

SEQ ID NO: 12632 - DNA, 20 bp, Artificial Sequence
  Artificially Synthesized Primer Sequence
cgagtaccagaacacgggac

SEQ ID NO: 12633 - DNA, 20 bp, Artificial Sequence
  Artificially Synthesized Primer Sequence
gacgagagcaccatagaggc

SEQ ID NO: 12634 - DNA, 20 bp, Artificial Sequence
  Artificially Synthesized Primer Sequence
gttcctggatgcagcaaaat

SEQ ID NO: 12635 - DNA, 20 bp, Artificial Sequence
  Artificially Synthesized Primer Sequence
gtgggttcaggcattgagtt

SEQ ID NO: 12636 - DNA, 20 bp, Artificial Sequence
  Artificially Synthesized Primer Sequence
gtttctcgttggttgcgaat

SEQ ID NO: 12637 - DNA, 20 bp, Artificial Sequence
  Artificially Synthesized Primer Sequence
aacccattgtgacctcttgc

SEQ ID NO: 12638 - DNA, 20 bp, Artificial Sequence
  Artificially Synthesized Primer Sequence
ttggcatggaaaagagatcc

SEQ ID NO: 12639 - DNA, 20 bp, Artificial Sequence
  Artificially Synthesized Primer Sequence
gggtcgtcatcacaagaggt

SEQ ID NO: 12640 - DNA, 20 bp, Artificial Sequence
  Artificially Synthesized Primer Sequence
agctccgtaagcgatttgag

SEQ ID NO: 12641 - DNA, 20 bp, Artificial Sequence
  Artificially Synthesized Primer Sequence
acttcactccgctcaccact

SEQ ID NO: 12642 - DNA, 20 bp, Artificial Sequence
  Artificially Synthesized Primer Sequence
accagcactggtgaaaatcc

SEQ ID NO: 12643 - DNA, 20 bp, Artificial Sequence
  Artificially Synthesized Primer Sequence
gccatcccttgtcgaagata

SEQ ID NO: 12644 - DNA, 20 bp, Artificial Sequence
  Artificially Synthesized Primer Sequence
tatagtggagttgggggtgc

SEQ ID NO: 12645 - DNA, 20 bp, Artificial Sequence
  Artificially Synthesized Primer Sequence
gcttttgaaacaatccccaa

SEQ ID NO: 12646 - DNA, 20 bp, Artificial Sequence
  Artificially Synthesized Primer Sequence
aaatacctaagccgcagggt

SEQ ID NO: 12647 - DNA, 20 bp, Artificial Sequence
  Artificially Synthesized Primer Sequence
ttcgctgcagatcatttcac

SEQ ID NO: 12648 - DNA, 20 bp, Artificial Sequence
  Artificially Synthesized Primer Sequence
gatgccgagaaaaaggagtg

SEQ ID NO: 12649 - DNA, 20 bp, Artificial Sequence
  Artificially Synthesized Primer Sequence
agatcccgtgatgaagttgc

SEQ ID NO: 12650 - DNA, 20 bp, Artificial Sequence
  Artificially Synthesized Primer Sequence
tttgcacgttgaattgtggt

SEQ ID NO: 12651 - DNA, 20 bp, Artificial Sequence
  Artificially Synthesized Primer Sequence
aagatcctgctgatgatggc

SEQ ID NO: 12652 - DNA, 20 bp, Artificial Sequence
  Artificially Synthesized Primer Sequence
cccaggattgcaaaaacact

SEQ ID NO: 12653 - DNA, 20 bp, Artificial Sequence
  Artificially Synthesized Primer Sequence
taccagtgggatggtggatt

SEQ ID NO: 12654 - DNA, 20 bp, Artificial Sequence
  Artificially Synthesized Primer Sequence
gttgtacccatcgcggtagt

SEQ ID NO: 12655 - DNA, 20 bp, Artificial Sequence
  Artificially Synthesized Primer Sequence
atcttccttcgttgcattgg

SEQ ID NO: 12656 - DNA, 20 bp, Artificial Sequence
  Artificially Synthesized Primer Sequence
cactagctcccagagcatcc

SEQ ID NO: 12657 - DNA, 20 bp, Artificial Sequence
  Artificially Synthesized Primer Sequence
cgagctgttgatgtggagaa

SEQ ID NO: 12658 - DNA, 20 bp, Artificial Sequence
  Artificially Synthesized Primer Sequence
tccattttcttgacccttgc

SEQ ID NO: 12659 - DNA, 20 bp, Artificial Sequence
  Artificially Synthesized Primer Sequence
cgatacaggaccatcggttt

SEQ ID NO: 12660 - DNA, 20 bp, Artificial Sequence
  Artificially Synthesized Primer Sequence
gcaagggtcaagaaaatgga

SEQ ID NO: 12661 - DNA, 20 bp, Artificial Sequence
  Artificially Synthesized Primer Sequence
gcatgaagctgtggttgaga

SEQ ID NO: 12662 - DNA, 20 bp, Artificial Sequence
  Artificially Synthesized Primer Sequence
tgcacttctggttgttttgc

SEQ ID NO: 12663 - DNA, 20 bp, Artificial Sequence
  Artificially Synthesized Primer Sequence
gccagtgaatcagacggttt

SEQ ID NO: 12664 - DNA, 20 bp, Artificial Sequence
  Artificially Synthesized Primer Sequence
aattcgacatgttcgggaag

SEQ ID NO: 12665 - DNA, 20 bp, Artificial Sequence
  Artificially Synthesized Primer Sequence
cctccaaggatgtggaccta

SEQ ID NO: 12666 - DNA, 20 bp, Artificial Sequence
  Artificially Synthesized Primer Sequence
tcttggaatgactctcggct

SEQ ID NO: 12667 - DNA, 20 bp, Artificial Sequence
  Artificially Synthesized Primer Sequence
tcacccatcttcttccctca

SEQ ID NO: 12668 - DNA, 20 bp, Artificial Sequence
  Artificially Synthesized Primer Sequence
agttgcagtcagtgtggtgg

SEQ ID NO: 12669 - DNA, 20 bp, Artificial Sequence
  Artificially Synthesized Primer Sequence
tgtatacgacggccagtgaa

SEQ ID NO: 12670 - DNA, 20 bp, Artificial Sequence
  Artificially Synthesized Primer Sequence
tacaggaacaggaaggtggc

SEQ ID NO: 12671 - DNA, 21 bp, Artificial Sequence
  Artificially Synthesized Primer Sequence
catctcctctgcctaacaagc

SEQ ID NO: 12672 - DNA, 20 bp, Artificial Sequence
  Artificially Synthesized Primer Sequence
tacaggaacaggaaggtggc

SEQ ID NO: 12673 - DNA, 20 bp, Artificial Sequence
  Artificially Synthesized Primer Sequence
aggtcttcctgggatcctgt

SEQ ID NO: 12674 - DNA, 20 bp, Artificial Sequence
  Artificially Synthesized Primer Sequence
gcttcatcttttggtcaggc

SEQ ID NO: 12675 - DNA, 20 bp, Artificial Sequence
  Artificially Synthesized Primer Sequence
tcaaggaggcttgttccagt

SEQ ID NO: 12676 - DNA, 20 bp, Artificial Sequence
  Artificially Synthesized Primer Sequence
agtccagaggtcatgttggc

SEQ ID NO: 12677 - DNA, 20 bp, Artificial Sequence
  Artificially Synthesized Primer Sequence
attgcccgtgaatgtggtat

SEQ ID NO: 12678 - DNA, 20 bp, Artificial Sequence
  Artificially Synthesized Primer Sequence
caagcaaggcgacaacatta

SEQ ID NO: 12679 - DNA, 20 bp, Artificial Sequence
  Artificially Synthesized Primer Sequence
cagctcttctcaggcttgct

SEQ ID NO: 12680 - DNA, 20 bp, Artificial Sequence
  Artificially Synthesized Primer Sequence
ctccagacgcaaggaaaaac

SEQ ID NO: 12681 - DNA, 20 bp, Artificial Sequence
  Artificially Synthesized Primer Sequence
tccctggggaagaagaagat

SEQ ID NO: 12682 - DNA, 20 bp, Artificial Sequence
  Artificially Synthesized Primer Sequence
agaatggggcactgaatgag

SEQ ID NO: 12683 - DNA, 20 bp, Artificial Sequence
  Artificially Synthesized Primer Sequence
cctgatcaactggctggatt

SEQ ID NO: 12684 - DNA, 20 bp, Artificial Sequence
  Artificially Synthesized Primer Sequence
gctcttgcaaggatggaaag

SEQ ID NO: 12685 - DNA, 20 bp, Artificial Sequence
  Artificially Synthesized Primer Sequence
ttcaggacctgtctggctct

SEQ ID NO: 12686 - DNA, 20 bp, Artificial Sequence
  Artificially Synthesized Primer Sequence
caattgcctagtttcgccat

SEQ ID NO: 12687 - DNA, 20 bp, Artificial Sequence
  Artificially Synthesized Primer Sequence
ggcaacggcagatttctcta

SEQ ID NO: 12688 - DNA, 20 bp, Artificial Sequence
  Artificially Synthesized Primer Sequence
tcagcaatgtgcctatcgag

SEQ ID NO: 12689 - DNA, 20 bp, Artificial Sequence
  Artificially Synthesized Primer Sequence
atccacatcagggaagatcg

SEQ ID NO: 12690 - DNA, 20 bp, Artificial Sequence
  Artificially Synthesized Primer Sequence
cgtcatcagtgaaggaagca

SEQ ID NO: 12691 - DNA, 20 bp, Artificial Sequence
  Artificially Synthesized Primer Sequence
ctgtacctcgccgtgtatga

SEQ ID NO: 12692 - DNA, 20 bp, Artificial Sequence
  Artificially Synthesized Primer Sequence
aggatgtgctcatggaaacc

SEQ ID NO: 12693 - DNA, 20 bp, Artificial Sequence
  Artificially Synthesized Primer Sequence
agtctctgaaagacgcggaa

SEQ ID NO: 12694 - DNA, 20 bp, Artificial Sequence
  Artificially Synthesized Primer Sequence
ccaagagcctgaccaatcat

SEQ ID NO: 12695 - DNA, 20 bp, Artificial Sequence
  Artificially Synthesized Primer Sequence
tttcgcaactcatgatggtc

SEQ ID NO: 12696 - DNA, 20 bp, Artificial Sequence
  Artificially Synthesized Primer Sequence
gtcaggctcttggtggaaag

SEQ ID NO: 12697 - DNA, 20 bp, Artificial Sequence
  Artificially Synthesized Primer Sequence
catcatcatctggcttggtg

SEQ ID NO: 12698 - DNA, 20 bp, Artificial Sequence
  Artificially Synthesized Primer Sequence
acataagcgcaattggttcc

SEQ ID NO: 12699 - DNA, 20 bp, Artificial Sequence
  Artificially Synthesized Primer Sequence
caccaagccagatgatgatg

SEQ ID NO: 12700 - DNA, 20 bp, Artificial Sequence
  Artificially Synthesized Primer Sequence
ttggttcagcgagactgttg

SEQ ID NO: 12701 - DNA, 20 bp, Artificial Sequence
  Artificially Synthesized Primer Sequence
cagtcagaggcagacaccaa

SEQ ID NO: 12702 - DNA, 20 bp, Artificial Sequence
  Artificially Synthesized Primer Sequence
gacggactatttcccgttca

SEQ ID NO: 12703 - DNA, 20 bp, Artificial Sequence
  Artificially Synthesized Primer Sequence
gaaaagcatggccctatgaa

SEQ ID NO: 12704 - DNA, 20 bp, Artificial Sequence
  Artificially Synthesized Primer Sequence
agtggttgttggttgcatga

SEQ ID NO: 12705 - DNA, 20 bp, Artificial Sequence
  Artificially Synthesized Primer Sequence
gatggttgttgccacacttg

SEQ ID NO: 12706 - DNA, 20 bp, Artificial Sequence
  Artificially Synthesized Primer Sequence
aaacagtccgatgccaaaac

SEQ ID NO: 12707 - DNA, 20 bp, Artificial Sequence
  Artificially Synthesized Primer Sequence
aaaacggggagaggagaaaa

SEQ ID NO: 12708 - DNA, 20 bp, Artificial Sequence
  Artificially Synthesized Primer Sequence
attgacagggaagagtggca

SEQ ID NO: 12709 - DNA, 20 bp, Artificial Sequence
  Artificially Synthesized Primer Sequence
tttaggcttcccatggattg

SEQ ID NO: 12710 - DNA, 20 bp, Artificial Sequence
  Artificially Synthesized Primer Sequence
catgagcggggagaaataaa

SEQ ID NO: 12711 - DNA, 20 bp, Artificial Sequence
  Artificially Synthesized Primer Sequence
caatccatgggaagcctaaa

SEQ ID NO: 12712 - DNA, 20 bp, Artificial Sequence
  Artificially Synthesized Primer Sequence
gcttggcgagaacttgtacc

SEQ ID NO: 12713 - DNA, 20 bp, Artificial Sequence
  Artificially Synthesized Primer Sequence
gagcttggccataattgcat

SEQ ID NO: 12714 - DNA, 20 bp, Artificial Sequence
  Artificially Synthesized Primer Sequence
gccttgaagaaatcgacagc

SEQ ID NO: 12715 - DNA, 20 bp, Artificial Sequence
  Artificially Synthesized Primer Sequence
gcgtgttttgccatttaggt

SEQ ID NO: 12716 - DNA, 20 bp, Artificial Sequence
  Artificially Synthesized Primer Sequence
ggagccaggcgttgtaataa

SEQ ID NO: 12717 - DNA, 20 bp, Artificial Sequence
  Artificially Synthesized Primer Sequence
atgaggtgtgaggagttggg

SEQ ID NO: 12718 - DNA, 20 bp, Artificial Sequence
  Artificially Synthesized Primer Sequence
gctgcttctccttgaacacc

SEQ ID NO: 12719 - DNA, 20 bp, Artificial Sequence
  Artificially Synthesized Primer Sequence
cggccgataagaagtgaaat

SEQ ID NO: 12720 - DNA, 20 bp, Artificial Sequence
  Artificially Synthesized Primer Sequence
caaaccaaaccccagagaag

SEQ ID NO: 12721 - DNA, 20 bp, Artificial Sequence
  Artificially Synthesized Primer Sequence
tggcagcacaagtttttcag

SEQ ID NO: 12722 - DNA, 20 bp, Artificial Sequence
  Artificially Synthesized Primer Sequence
gcaaacgtgaggggaaataa

SEQ ID NO: 12723 - DNA, 20 bp, Artificial Sequence
  Artificially Synthesized Primer Sequence
gcaaacgtgaggggaaataa

SEQ ID NO: 12724 - DNA, 20 bp, Artificial Sequence
  Artificially Synthesized Primer Sequence
tggcagcacaagtttttcag

SEQ ID NO: 12725 - DNA, 20 bp, Artificial Sequence
  Artificially Synthesized Primer Sequence
tggcagaaagaagaggagga

SEQ ID NO: 12726 - DNA, 20 bp, Artificial Sequence
  Artificially Synthesized Primer Sequence
tggaaatttggggaagagtg

SEQ ID NO: 12727 - DNA, 20 bp, Artificial Sequence
  Artificially Synthesized Primer Sequence
agactgggcaaccttgtctg

SEQ ID NO: 12728 - DNA, 20 bp, Artificial Sequence
  Artificially Synthesized Primer Sequence
gaggatgacgaagcaaaagc

SEQ ID NO: 12729 - DNA, 20 bp, Artificial Sequence
  Artificially Synthesized Primer Sequence
aagtttgatggcatccttgg

SEQ ID NO: 12730 - DNA, 20 bp, Artificial Sequence
  Artificially Synthesized Primer Sequence
atggtgggtttcccctaaag

SEQ ID NO: 12731 - DNA, 20 bp, Artificial Sequence
  Artificially Synthesized Primer Sequence
gtaggtgaggtcgctcgaag

SEQ ID NO: 12732 - DNA, 20 bp, Artificial Sequence
  Artificially Synthesized Primer Sequence
cctctctctccattgccaac

SEQ ID NO: 12733 - DNA, 20 bp, Artificial Sequence
  Artificially Synthesized Primer Sequence
aggttgttcatcatcggagc

SEQ ID NO: 12734 - DNA, 20 bp, Artificial Sequence
  Artificially Synthesized Primer Sequence
acatctgttcccaggcgtag

SEQ ID NO: 12735 - DNA, 20 bp, Artificial Sequence
  Artificially Synthesized Primer Sequence
atcggtggcaacgacatact

SEQ ID NO: 12736 - DNA, 20 bp, Artificial Sequence
  Artificially Synthesized Primer Sequence
tacttgtcgctcatgttccg

SEQ ID NO: 12737 - DNA, 20 bp, Artificial Sequence
  Artificially Synthesized Primer Sequence
ggcgacaagttttctgcttc

SEQ ID NO: 12738 - DNA, 20 bp, Artificial Sequence
  Artificially Synthesized Primer Sequence
atggacacacgctcccttac

SEQ ID NO: 12739 - DNA, 20 bp, Artificial Sequence
  Artificially Synthesized Primer Sequence
gacacacgctcccctacaat

SEQ ID NO: 12740 - DNA, 20 bp, Artificial Sequence
  Artificially Synthesized Primer Sequence
ggcgacaagttttctgcttc

SEQ ID NO: 12741 - DNA, 20 bp, Artificial Sequence
  Artificially Synthesized Primer Sequence
aagaagatgccttgcctgaa

SEQ ID NO: 12742 - DNA, 20 bp, Artificial Sequence
  Artificially Synthesized Primer Sequence
tggccattaaactgacacga

SEQ ID NO: 12743 - DNA, 20 bp, Artificial Sequence
  Artificially Synthesized Primer Sequence
tgaggtagaagcgggacttg

SEQ ID NO: 12744 - DNA, 20 bp, Artificial Sequence
  Artificially Synthesized Primer Sequence
gttctcaagggttcagtgcc

SEQ ID NO: 12745 - DNA, 20 bp, Artificial Sequence
  Artificially Synthesized Primer Sequence
tctgcgagaggccaaatact

SEQ ID NO: 12746 - DNA, 20 bp, Artificial Sequence
  Artificially Synthesized Primer Sequence
tccccagcctaaacatcaag

SEQ ID NO: 12747 - DNA, 20 bp, Artificial Sequence
  Artificially Synthesized Primer Sequence
tcactcttcgcagtcttgga

SEQ ID NO: 12748 - DNA, 20 bp, Artificial Sequence
  Artificially Synthesized Primer Sequence
ttttgcaagtgctcttgtgc

SEQ ID NO: 12749 - DNA, 20 bp, Artificial Sequence
  Artificially Synthesized Primer Sequence
cttgtatcggcttctggagg

SEQ ID NO: 12750 - DNA, 20 bp, Artificial Sequence
  Artificially Synthesized Primer Sequence
ttgcttaaggtgaggttggg

SEQ ID NO: 12751 - DNA, 20 bp, Artificial Sequence
  Artificially Synthesized Primer Sequence
caggcgccatcatttaattt

SEQ ID NO: 12752 - DNA, 20 bp, Artificial Sequence
  Artificially Synthesized Primer Sequence
cctgtcgtggagaggtttgt

SEQ ID NO: 12753 - DNA, 20 bp, Artificial Sequence
  Artificially Synthesized Primer Sequence
gaactcccaccccaagaact

SEQ ID NO: 12754 - DNA, 20 bp, Artificial Sequence
  Artificially Synthesized Primer Sequence
ataaatggcttcctccaggg

SEQ ID NO: 12755 - DNA, 20 bp, Artificial Sequence
  Artificially Synthesized Primer Sequence
ccgaatgataaatggcttcc

SEQ ID NO: 12756 - DNA, 19 bp, Artificial Sequence
  Artificially Synthesized Primer Sequence
aacgtctggaactcccacc

SEQ ID NO: 12757 - DNA, 20 bp, Artificial Sequence
  Artificially Synthesized Primer Sequence
actacatgtccggcttccac

SEQ ID NO: 12758 - DNA, 20 bp, Artificial Sequence
  Artificially Synthesized Primer Sequence
gcactgcctagcttattcgg

SEQ ID NO: 12759 - DNA, 20 bp, Artificial Sequence
  Artificially Synthesized Primer Sequence
ctgcctagcttattcggcac

SEQ ID NO: 12760 - DNA, 20 bp, Artificial Sequence
  Artificially Synthesized Primer Sequence
actacatgtccggcttccac

SEQ ID NO: 12761 - DNA, 20 bp, Artificial Sequence
  Artificially Synthesized Primer Sequence
atgtgctgctctcggtaggt

SEQ ID NO: 12762 - DNA, 20 bp, Artificial Sequence
  Artificially Synthesized Primer Sequence
caaacctatgtgctcgctga

SEQ ID NO: 12763 - DNA, 20 bp, Artificial Sequence
  Artificially Synthesized Primer Sequence
tacatcggaatttcttgggc

SEQ ID NO: 12764 - DNA, 20 bp, Artificial Sequence
  Artificially Synthesized Primer Sequence
gggtgtaaaactgggagcaa

SEQ ID NO: 12765 - DNA, 20 bp, Artificial Sequence
  Artificially Synthesized Primer Sequence
tgacgttccaaacaaaacca

SEQ ID NO: 12766 - DNA, 20 bp, Artificial Sequence
  Artificially Synthesized Primer Sequence
tgcctgatgtggtgatcatt

SEQ ID NO: 12767 - DNA, 20 bp, Artificial Sequence
  Artificially Synthesized Primer Sequence
tgtttgggcctcctaaactg

SEQ ID NO: 12768 - DNA, 20 bp, Artificial Sequence
  Artificially Synthesized Primer Sequence
acacaatgattggcagagca

SEQ ID NO: 12769 - DNA, 20 bp, Artificial Sequence
  Artificially Synthesized Primer Sequence
agttgtcaccggaggagcta

SEQ ID NO: 12770 - DNA, 20 bp, Artificial Sequence
  Artificially Synthesized Primer Sequence
ttttgggtcatctttgcctc

SEQ ID NO: 12771 - DNA, 20 bp, Artificial Sequence
  Artificially Synthesized Primer Sequence
gaagaaccaaaatgggcaaa

SEQ ID NO: 12772 - DNA, 20 bp, Artificial Sequence
  Artificially Synthesized Primer Sequence
atggaaccagcagaagcaag

SEQ ID NO: 12773 - DNA, 20 bp, Artificial Sequence
  Artificially Synthesized Primer Sequence
gcaggattcactgttgctca

SEQ ID NO: 12774 - DNA, 20 bp, Artificial Sequence
  Artificially Synthesized Primer Sequence
ccatgctgttcttgctgaaa

SEQ ID NO: 12775 - DNA, 20 bp, Artificial Sequence
  Artificially Synthesized Primer Sequence
ccaagttaggccaacgaaga

SEQ ID NO: 12776 - DNA, 20 bp, Artificial Sequence
  Artificially Synthesized Primer Sequence
acgaggaattgttcgacgag

SEQ ID NO: 12777 - DNA, 20 bp, Artificial Sequence
  Artificially Synthesized Primer Sequence
tttctatttccccatcagcg

SEQ ID NO: 12778 - DNA, 20 bp, Artificial Sequence
  Artificially Synthesized Primer Sequence
aaaagagggctcaaacacga

SEQ ID NO: 12779 - DNA, 20 bp, Artificial Sequence
  Artificially Synthesized Primer Sequence
caccttcttctccgtcaagc

SEQ ID NO: 12780 - DNA, 20 bp, Artificial Sequence
  Artificially Synthesized Primer Sequence
attgaagtacgccggaacag

SEQ ID NO: 12781 - DNA, 20 bp, Artificial Sequence
  Artificially Synthesized Primer Sequence
tcgtgttctgaaccttgctg

SEQ ID NO: 12782 - DNA, 20 bp, Artificial Sequence
  Artificially Synthesized Primer Sequence
ctgtctccaacccgttgttt

SEQ ID NO: 12783 - DNA, 20 bp, Artificial Sequence
  Artificially Synthesized Primer Sequence
catgtcaaacatctccacgg

SEQ ID NO: 12784 - DNA, 20 bp, Artificial Sequence
  Artificially Synthesized Primer Sequence
ttctcctcgtctgttccgtt

SEQ ID NO: 12785 - DNA, 20 bp, Artificial Sequence
  Artificially Synthesized Primer Sequence
gactcggtgtgcctatggtt

SEQ ID NO: 12786 - DNA, 20 bp, Artificial Sequence
  Artificially Synthesized Primer Sequence
aaaggcggcaagaagtacaa

SEQ ID NO: 12787 - DNA, 20 bp, Artificial Sequence
  Artificially Synthesized Primer Sequence
caaaacagaagcgaacgtca

SEQ ID NO: 12788 - DNA, 20 bp, Artificial Sequence
  Artificially Synthesized Primer Sequence
gactcggtgtgcctatggtt

SEQ ID NO: 12789 - DNA, 20 bp, Artificial Sequence
  Artificially Synthesized Primer Sequence
ccgtgttgacctatccgact

SEQ ID NO: 12790 - DNA, 20 bp, Artificial Sequence
  Artificially Synthesized Primer Sequence
gttactgcaagccatggtca

SEQ ID NO: 12791 - DNA, 20 bp, Artificial Sequence
  Artificially Synthesized Primer Sequence
tttagaaacggagggagtgc

SEQ ID NO: 12792 - DNA, 20 bp, Artificial Sequence
  Artificially Synthesized Primer Sequence
tagatgggttaccaatgggc

SEQ ID NO: 12793 - DNA, 20 bp, Artificial Sequence
  Artificially Synthesized Primer Sequence
ccctgcattcgtcatcctat

SEQ ID NO: 12794 - DNA, 20 bp, Artificial Sequence
  Artificially Synthesized Primer Sequence
tcaatcttccccgatagcac

SEQ ID NO: 12795 - DNA, 20 bp, Artificial Sequence
  Artificially Synthesized Primer Sequence
atggacgtcattcaaaaggc

SEQ ID NO: 12796 - DNA, 20 bp, Artificial Sequence
  Artificially Synthesized Primer Sequence
ccctgcattcgtcatcctat

SEQ ID NO: 12797 - DNA, 20 bp, Artificial Sequence
  Artificially Synthesized Primer Sequence
cggagctatcaccctgatgt

SEQ ID NO: 12798 - DNA, 20 bp, Artificial Sequence
  Artificially Synthesized Primer Sequence
aagtggtgtccttgtggagg

SEQ ID NO: 12799 - DNA, 20 bp, Artificial Sequence
  Artificially Synthesized Primer Sequence
gctcggctaaagcatacgac

SEQ ID NO: 12800 - DNA, 20 bp, Artificial Sequence
  Artificially Synthesized Primer Sequence
ccgggtacaactctggtgat

SEQ ID NO: 12801 - DNA, 20 bp, Artificial Sequence
  Artificially Synthesized Primer Sequence
ttcatcatcatccgcctgta

SEQ ID NO: 12802 - DNA, 20 bp, Artificial Sequence
  Artificially Synthesized Primer Sequence
caagctcccatccttagcag

SEQ ID NO: 12803 - DNA, 20 bp, Artificial Sequence
  Artificially Synthesized Primer Sequence
gcaattgcaggacaggaaat

SEQ ID NO: 12804 - DNA, 20 bp, Artificial Sequence
  Artificially Synthesized Primer Sequence
cccaagaatgcagtggagat

SEQ ID NO: 12805 - DNA, 20 bp, Artificial Sequence
  Artificially Synthesized Primer Sequence
ccctgtttcggtcactcaat

SEQ ID NO: 12806 - DNA, 20 bp, Artificial Sequence
  Artificially Synthesized Primer Sequence
gcttcaatgcactatggggt

SEQ ID NO: 12807 - DNA, 20 bp, Artificial Sequence
  Artificially Synthesized Primer Sequence
ctaaggacaagaggcgcaac

SEQ ID NO: 12808 - DNA, 20 bp, Artificial Sequence
  Artificially Synthesized Primer Sequence
accccatagtgcattgaagc

SEQ ID NO: 12809 - DNA, 20 bp, Artificial Sequence
  Artificially Synthesized Primer Sequence
gcaatgaatttccgtccagt

SEQ ID NO: 12810 - DNA, 20 bp, Artificial Sequence
  Artificially Synthesized Primer Sequence
tttggccaaccttactaccg

SEQ ID NO: 12811 - DNA, 20 bp, Artificial Sequence
  Artificially Synthesized Primer Sequence
ctttgccacatctggagaca

SEQ ID NO: 12812 - DNA, 20 bp, Artificial Sequence
  Artificially Synthesized Primer Sequence
gactctttgggccatgttgt

SEQ ID NO: 12813 - DNA, 20 bp, Artificial Sequence
  Artificially Synthesized Primer Sequence
accaaagggcattgaatgag

SEQ ID NO: 12814 - DNA, 20 bp, Artificial Sequence
  Artificially Synthesized Primer Sequence
tattcatcggagggcagttc

SEQ ID NO: 12815 - DNA, 20 bp, Artificial Sequence
  Artificially Synthesized Primer Sequence
ttcgttgctgacttgcaaac

SEQ ID NO: 12816 - DNA, 20 bp, Artificial Sequence
  Artificially Synthesized Primer Sequence
gaactgccctccgatgaata

SEQ ID NO: 12817 - DNA, 20 bp, Artificial Sequence
  Artificially Synthesized Primer Sequence
ttgtccaaaaccttgaagcc

SEQ ID NO: 12818 - DNA, 20 bp, Artificial Sequence
  Artificially Synthesized Primer Sequence
cttcgccattctttggtgat

SEQ ID NO: 12819 - DNA, 20 bp, Artificial Sequence
  Artificially Synthesized Primer Sequence
tgccaaacaattgtcagctc

SEQ ID NO: 12820 - DNA, 20 bp, Artificial Sequence
  Artificially Synthesized Primer Sequence
aactggttgcacagtgcttg

SEQ ID NO: 12821 - DNA, 20 bp, Artificial Sequence
  Artificially Synthesized Primer Sequence
gcttgaggctctgtaatgcc

SEQ ID NO: 12822 - DNA, 20 bp, Artificial Sequence
  Artificially Synthesized Primer Sequence
cacattgacaagacccgatg

SEQ ID NO: 12823 - DNA, 20 bp, Artificial Sequence
  Artificially Synthesized Primer Sequence
gattttgcacagttcatgcg

SEQ ID NO: 12824 - DNA, 20 bp, Artificial Sequence
  Artificially Synthesized Primer Sequence
gccactgcttgagagtgatg

SEQ ID NO: 12825 - DNA, 20 bp, Artificial Sequence
  Artificially Synthesized Primer Sequence
accaccaccgataccatcat

SEQ ID NO: 12826 - DNA, 20 bp, Artificial Sequence
  Artificially Synthesized Primer Sequence
gagagctccatcaggtcagc

SEQ ID NO: 12827 - DNA, 20 bp, Artificial Sequence
  Artificially Synthesized Primer Sequence
ttctcatcatcccatcccat

SEQ ID NO: 12828 - DNA, 20 bp, Artificial Sequence
  Artificially Synthesized Primer Sequence
tgtgttcgatcgagaagtgg

SEQ ID NO: 12829 - DNA, 20 bp, Artificial Sequence
  Artificially Synthesized Primer Sequence
aaggaagccggaactgaaat

SEQ ID NO: 12830 - DNA, 20 bp, Artificial Sequence
  Artificially Synthesized Primer Sequence
ttcctcagaagttcaggcgt

SEQ ID NO: 12831 - DNA, 20 bp, Artificial Sequence
  Artificially Synthesized Primer Sequence
agctccaacacacactgacg

SEQ ID NO: 12832 - DNA, 20 bp, Artificial Sequence
  Artificially Synthesized Primer Sequence
acgcctgaacttctgaggaa

SEQ ID NO: 12833 - DNA, 20 bp, Artificial Sequence
  Artificially Synthesized Primer Sequence
tcaaggttgaagttccccac

SEQ ID NO: 12834 - DNA, 20 bp, Artificial Sequence
  Artificially Synthesized Primer Sequence
taacctttcccgacaagcac

SEQ ID NO: 12835 - DNA, 20 bp, Artificial Sequence
  Artificially Synthesized Primer Sequence
gcagagcatccagaacatca

SEQ ID NO: 12836 - DNA, 20 bp, Artificial Sequence
  Artificially Synthesized Primer Sequence
caccattgaccattgcgtag

SEQ ID NO: 12837 - DNA, 20 bp, Artificial Sequence
  Artificially Synthesized Primer Sequence
tggtgttgctgcttcttttg

SEQ ID NO: 12838 - DNA, 20 bp, Artificial Sequence
  Artificially Synthesized Primer Sequence
tggatttcttgaaagggcac

SEQ ID NO: 12839 - DNA, 20 bp, Artificial Sequence
  Artificially Synthesized Primer Sequence
tgtgcaacagtggtgatcct

SEQ ID NO: 12840 - DNA, 20 bp, Artificial Sequence
  Artificially Synthesized Primer Sequence
cagcgattatgaccctcgat

SEQ ID NO: 12841 - DNA, 20 bp, Artificial Sequence
  Artificially Synthesized Primer Sequence
agccacagaaccaattccag

SEQ ID NO: 12842 - DNA, 20 bp, Artificial Sequence
  Artificially Synthesized Primer Sequence
aaggggaacgtgcataacag

SEQ ID NO: 12843 - DNA, 20 bp, Artificial Sequence
  Artificially Synthesized Primer Sequence
aagaacaattgggttgcagg

SEQ ID NO: 12844 - DNA, 20 bp, Artificial Sequence
  Artificially Synthesized Primer Sequence
agtaaaagggccgaagccta

SEQ ID NO: 12845 - DNA, 20 bp, Artificial Sequence
  Artificially Synthesized Primer Sequence
agaggaaagcacacttcgga

SEQ ID NO: 12846 - DNA, 20 bp, Artificial Sequence
  Artificially Synthesized Primer Sequence
caacacgtgctgttcagctt

SEQ ID NO: 12847 - DNA, 21 bp, Artificial Sequence
  Artificially Synthesized Primer Sequence
agtatggcatccaaccatctg

SEQ ID NO: 12848 - DNA, 20 bp, Artificial Sequence
  Artificially Synthesized Primer Sequence
agcttaagaggtggcgtgaa

SEQ ID NO: 12849 - DNA, 20 bp, Artificial Sequence
  Artificially Synthesized Primer Sequence
gcagaagcagcacctaaagc

SEQ ID NO: 12850 - DNA, 20 bp, Artificial Sequence
  Artificially Synthesized Primer Sequence
cccaaacccctaggttcaat

SEQ ID NO: 12851 - DNA, 20 bp, Artificial Sequence
  Artificially Synthesized Primer Sequence
ttcaatgcaggcgatgatta

SEQ ID NO: 12852 - DNA, 20 bp, Artificial Sequence
  Artificially Synthesized Primer Sequence
ctgtgctcttcctctcgctc

SEQ ID NO: 12853 - DNA, 20 bp, Artificial Sequence
  Artificially Synthesized Primer Sequence
accttcggttctgtcaccac

SEQ ID NO: 12854 - DNA, 20 bp, Artificial Sequence
  Artificially Synthesized Primer Sequence
tggttgacattgcaacgatt

SEQ ID NO: 12855 - DNA, 20 bp, Artificial Sequence
  Artificially Synthesized Primer Sequence
atctcataacttgctgcccc

SEQ ID NO: 12856 - DNA, 20 bp, Artificial Sequence
  Artificially Synthesized Primer Sequence
ccaatatccctcttggctca

SEQ ID NO: 12857 - DNA, 20 bp, Artificial Sequence
  Artificially Synthesized Primer Sequence
tgctcacagtgaaatgagcc

SEQ ID NO: 12858 - DNA, 20 bp, Artificial Sequence
  Artificially Synthesized Primer Sequence
cttgcaatctgccagtgaaa

SEQ ID NO: 12859 - DNA, 20 bp, Artificial Sequence
  Artificially Synthesized Primer Sequence
atctcaaatggggaggctct

SEQ ID NO: 12860 - DNA, 20 bp, Artificial Sequence
  Artificially Synthesized Primer Sequence
gcctgagggttggtcaatta

SEQ ID NO: 12861 - DNA, 20 bp, Artificial Sequence
  Artificially Synthesized Primer Sequence
agtgccaggaactcgagaaa

SEQ ID NO: 12862 - DNA, 20 bp, Artificial Sequence
  Artificially Synthesized Primer Sequence
ttccaccctgatggcttaac

SEQ ID NO: 12863 - DNA, 20 bp, Artificial Sequence
  Artificially Synthesized Primer Sequence
gaatgactcgacatcagcga

SEQ ID NO: 12864 - DNA, 20 bp, Artificial Sequence
  Artificially Synthesized Primer Sequence
gacagcacaacgggaggtat

SEQ ID NO: 12865 - DNA, 20 bp, Artificial Sequence
  Artificially Synthesized Primer Sequence
accattggcagcctagacat

SEQ ID NO: 12866 - DNA, 20 bp, Artificial Sequence
  Artificially Synthesized Primer Sequence
gacaagaattttgggacgga

SEQ ID NO: 12867 - DNA, 20 bp, Artificial Sequence
  Artificially Synthesized Primer Sequence
ggtttcacgggttcacactt

SEQ ID NO: 12868 - DNA, 20 bp, Artificial Sequence
  Artificially Synthesized Primer Sequence
acctacacatacatgcgcca

SEQ ID NO: 12869 - DNA, 20 bp, Artificial Sequence
  Artificially Synthesized Primer Sequence
tttttcatggcttgggtctc

SEQ ID NO: 12870 - DNA, 20 bp, Artificial Sequence
  Artificially Synthesized Primer Sequence
gaaggggagaggacaggaac

SEQ ID NO: 12871 - DNA, 20 bp, Artificial Sequence
  Artificially Synthesized Primer Sequence
tgcctggggttgaagaatac

SEQ ID NO: 12872 - DNA, 20 bp, Artificial Sequence
  Artificially Synthesized Primer Sequence
ccgcgcttaagtgaaaatgt

SEQ ID NO: 12873 - DNA, 20 bp, Artificial Sequence
  Artificially Synthesized Primer Sequence
tgcagtatcatcccgaatca

SEQ ID NO: 12874 - DNA, 20 bp, Artificial Sequence
  Artificially Synthesized Primer Sequence
gtgcaaaaggcttcataggc

SEQ ID NO: 12875 - DNA, 20 bp, Artificial Sequence
  Artificially Synthesized Primer Sequence
cacgagtgaatgctttccaa

SEQ ID NO: 12876 - DNA, 20 bp, Artificial Sequence
  Artificially Synthesized Primer Sequence
cttggttgccaaggacaagt

SEQ ID NO: 12877 - DNA, 20 bp, Artificial Sequence
  Artificially Synthesized Primer Sequence
cacgtcctcgtcacctacct

SEQ ID NO: 12878 - DNA, 20 bp, Artificial Sequence
  Artificially Synthesized Primer Sequence
ggagacgacaatggagaagc

SEQ ID NO: 12879 - DNA, 20 bp, Artificial Sequence
  Artificially Synthesized Primer Sequence
cgttgcaactccttggtttt

SEQ ID NO: 12880 - DNA, 20 bp, Artificial Sequence
  Artificially Synthesized Primer Sequence
aaaaggaaacagagccgatg

SEQ ID NO: 12881 - DNA, 20 bp, Artificial Sequence
  Artificially Synthesized Primer Sequence
caacttgaccaagctgcaaa

SEQ ID NO: 12882 - DNA, 20 bp, Artificial Sequence
  Artificially Synthesized Primer Sequence
gattcccatcctcttcgtca

SEQ ID NO: 12883 - DNA, 20 bp, Artificial Sequence
  Artificially Synthesized Primer Sequence
acatattgctgataggggcg

SEQ ID NO: 12884 - DNA, 20 bp, Artificial Sequence
  Artificially Synthesized Primer Sequence
gatgacgaagaggatgggaa

SEQ ID NO: 12885 - DNA, 20 bp, Artificial Sequence
  Artificially Synthesized Primer Sequence
aattgatgccatggagctgt

SEQ ID NO: 12886 - DNA, 20 bp, Artificial Sequence
  Artificially Synthesized Primer Sequence
aaaatcttgcaaccattggc

SEQ ID NO: 12887 - DNA, 20 bp, Artificial Sequence
  Artificially Synthesized Primer Sequence
atttgcctcctgctcatctg

SEQ ID NO: 12888 - DNA, 20 bp, Artificial Sequence
  Artificially Synthesized Primer Sequence
gactgacctgttagtccggg

SEQ ID NO: 12889 - DNA, 22 bp, Artificial Sequence
  Artificially Synthesized Primer Sequence
tctttttctctctcccctcctt

SEQ ID NO: 12890 - DNA, 23 bp, Artificial Sequence
  Artificially Synthesized Primer Sequence
gagaaagagaagaaaatggggaa

SEQ ID NO: 12891 - DNA, 20 bp, Artificial Sequence
  Artificially Synthesized Primer Sequence
caaacaaatttgcatcaccg

SEQ ID NO: 12892 - DNA, 20 bp, Artificial Sequence
  Artificially Synthesized Primer Sequence
aaaggagcgagaggagaagg

SEQ ID NO: 12893 - DNA, 20 bp, Artificial Sequence
  Artificially Synthesized Primer Sequence
taggaaggcagtcaaatggg

SEQ ID NO: 12894 - DNA, 20 bp, Artificial Sequence
  Artificially Synthesized Primer Sequence
cgggtctttgcactggtaat

SEQ ID NO: 12895 - DNA, 21 bp, Artificial Sequence
  Artificially Synthesized Primer Sequence
ccttccagatatcaagcagca

SEQ ID NO: 12896 - DNA, 20 bp, Artificial Sequence
  Artificially Synthesized Primer Sequence
tggcgacgataaaagaaagg

SEQ ID NO: 12897 - DNA, 20 bp, Artificial Sequence
  Artificially Synthesized Primer Sequence
tttctgggggactgttgaag

SEQ ID NO: 12898 - DNA, 20 bp, Artificial Sequence
  Artificially Synthesized Primer Sequence
tatgacttgctccagatgcg

SEQ ID NO: 12899 - DNA, 20 bp, Artificial Sequence
  Artificially Synthesized Primer Sequence
ccccatctggaagtattgga

SEQ ID NO: 12900 - DNA, 20 bp, Artificial Sequence
  Artificially Synthesized Primer Sequence
ccgtgttctcgggtactcat

SEQ ID NO: 12901 - DNA, 20 bp, Artificial Sequence
  Artificially Synthesized Primer Sequence
tgagttctgggaaacccatc

SEQ ID NO: 12902 - DNA, 20 bp, Artificial Sequence
  Artificially Synthesized Primer Sequence
tggcttgtcaaatgaatgga

SEQ ID NO: 12903 - DNA, 20 bp, Artificial Sequence
  Artificially Synthesized Primer Sequence
tgagaatgcgttgtccaaaa

SEQ ID NO: 12904 - DNA, 20 bp, Artificial Sequence
  Artificially Synthesized Primer Sequence
tagtgcagccaccacacttc

SEQ ID NO: 12905 - DNA, 20 bp, Artificial Sequence
  Artificially Synthesized Primer Sequence
ttgtcccactgtgactggaa

SEQ ID NO: 12906 - DNA, 20 bp, Artificial Sequence
  Artificially Synthesized Primer Sequence
gtcctcctcctagcaaggct

SEQ ID NO: 12907 - DNA, 20 bp, Artificial Sequence
  Artificially Synthesized Primer Sequence
caggccggagatatgaatgt

SEQ ID NO: 12908 - DNA, 20 bp, Artificial Sequence
  Artificially Synthesized Primer Sequence
gcatcatggtgtatcaacgc

SEQ ID NO: 12909 - DNA, 20 bp, Artificial Sequence
  Artificially Synthesized Primer Sequence
gtatatcggtgagcctccca

SEQ ID NO: 12910 - DNA, 20 bp, Artificial Sequence
  Artificially Synthesized Primer Sequence
ccacgtccttggaaaacagt

SEQ ID NO: 12911 - DNA, 20 bp, Artificial Sequence
  Artificially Synthesized Primer Sequence
tccagcgcttattccatctc

SEQ ID NO: 12912 - DNA, 20 bp, Artificial Sequence
  Artificially Synthesized Primer Sequence
tctacaggttgctgcacagg

SEQ ID NO: 12913 - DNA, 20 bp, Artificial Sequence
  Artificially Synthesized Primer Sequence
agcttcgcttgagaggagtg

SEQ ID NO: 12914 - DNA, 20 bp, Artificial Sequence
  Artificially Synthesized Primer Sequence
gtgcaaggcaactgagtcaa

SEQ ID NO: 12915 - DNA, 20 bp, Artificial Sequence
  Artificially Synthesized Primer Sequence
agcttcgcttgagaggagtg

SEQ ID NO: 12916 - DNA, 20 bp, Artificial Sequence
  Artificially Synthesized Primer Sequence
caactgagtcaaagcgctca

SEQ ID NO: 12917 - DNA, 20 bp, Artificial Sequence
  Artificially Synthesized Primer Sequence
tcaccaagaaatcctcggac

SEQ ID NO: 12918 - DNA, 20 bp, Artificial Sequence
  Artificially Synthesized Primer Sequence
catttgaacgtcatcaacgg

SEQ ID NO: 12919 - DNA, 22 bp, Artificial Sequence
  Artificially Synthesized Primer Sequence
ttgtccgaaaagtacatccaga

SEQ ID NO: 12920 - DNA, 20 bp, Artificial Sequence
  Artificially Synthesized Primer Sequence
cattgatcaggctggtgcta

SEQ ID NO: 12921 - DNA, 20 bp, Artificial Sequence
  Artificially Synthesized Primer Sequence
gactgcaaggttcaaggagc

SEQ ID NO: 12922 - DNA, 20 bp, Artificial Sequence
  Artificially Synthesized Primer Sequence
gatgcccatcttctgcaact

SEQ ID NO: 12923 - DNA, 20 bp, Artificial Sequence
  Artificially Synthesized Primer Sequence
acagttccagcaacctggtc

SEQ ID NO: 12924 - DNA, 20 bp, Artificial Sequence
  Artificially Synthesized Primer Sequence
cgagttcgtcaaggcctact

SEQ ID NO: 12925 - DNA, 20 bp, Artificial Sequence
  Artificially Synthesized Primer Sequence
accccttcaacctggagact

SEQ ID NO: 12926 - DNA, 20 bp, Artificial Sequence
  Artificially Synthesized Primer Sequence
ttgtacagcacaaaacccca

SEQ ID NO: 12927 - DNA, 20 bp, Artificial Sequence
  Artificially Synthesized Primer Sequence
taccacggacagaaaggacc

SEQ ID NO: 12928 - DNA, 20 bp, Artificial Sequence
  Artificially Synthesized Primer Sequence
cctcacagtggcaatcaatg

SEQ ID NO: 12929 - DNA, 20 bp, Artificial Sequence
  Artificially Synthesized Primer Sequence
accagaccgaccacaagttc

SEQ ID NO: 12930 - DNA, 20 bp, Artificial Sequence
  Artificially Synthesized Primer Sequence
ccgagtttgccttcacatct

SEQ ID NO: 12931 - DNA, 20 bp, Artificial Sequence
  Artificially Synthesized Primer Sequence
ctaacagactgcgacaacgc

SEQ ID NO: 12932 - DNA, 20 bp, Artificial Sequence
  Artificially Synthesized Primer Sequence
gaagtcgctctgcaccatct

SEQ ID NO: 12933 - DNA, 20 bp, Artificial Sequence
  Artificially Synthesized Primer Sequence
gctctccaatctgtgcatga

SEQ ID NO: 12934 - DNA, 20 bp, Artificial Sequence
  Artificially Synthesized Primer Sequence
caatctggatcccacgttct

SEQ ID NO: 12935 - DNA, 20 bp, Artificial Sequence
  Artificially Synthesized Primer Sequence
acttcacgacaggcatttcc

SEQ ID NO: 12936 - DNA, 20 bp, Artificial Sequence
  Artificially Synthesized Primer Sequence
aagtgccaatggacctaacg

SEQ ID NO: 12937 - DNA, 20 bp, Artificial Sequence
  Artificially Synthesized Primer Sequence
cgttaaaaatcctgtgccgt

SEQ ID NO: 12938 - DNA, 20 bp, Artificial Sequence
  Artificially Synthesized Primer Sequence
ggcaacaacttggagaccat

SEQ ID NO: 12939 - DNA, 20 bp, Artificial Sequence
  Artificially Synthesized Primer Sequence
gacaacaaacaacgagcgag

SEQ ID NO: 12940 - DNA, 20 bp, Artificial Sequence
  Artificially Synthesized Primer Sequence
gtggagctgctgagatttcc

SEQ ID NO: 12941 - DNA, 20 bp, Artificial Sequence
  Artificially Synthesized Primer Sequence
aaaccacttgaccatcctgc

SEQ ID NO: 12942 - DNA, 20 bp, Artificial Sequence
  Artificially Synthesized Primer Sequence
agttccgtattgttgccagg

SEQ ID NO: 12943 - DNA, 20 bp, Artificial Sequence
  Artificially Synthesized Primer Sequence
aaaccacttgaccatcctgc

SEQ ID NO: 12944 - DNA, 20 bp, Artificial Sequence
  Artificially Synthesized Primer Sequence
ccgtattgttgccaggagtt

SEQ ID NO: 12945 - DNA, 10 bp, Artificial Sequence
  Artificially Synthesized Primer Sequence
  MISC_FEATURE (1)..(10): n stands for any base
nnnnnnnnnn

SEQ ID NO: 12946 - DNA, 10 bp, Artificial Sequence
  Artificially Synthesized Primer Sequence
  MISC_FEATURE (1)..(10): n stands for any base
nnnnnnnnnn

SEQ ID NO: 12947 - DNA, 20 bp, Artificial Sequence
  Artificially Synthesized Primer Sequence
tacagctgctgcagaaggaa

SEQ ID NO: 12948 - DNA, 20 bp, Artificial Sequence
  Artificially Synthesized Primer Sequence
taaccgatgaaactccaggc

SEQ ID NO: 12949 - DNA, 20 bp, Artificial Sequence
  Artificially Synthesized Primer Sequence
cgtacacctctctccttcgc

SEQ ID NO: 12950 - DNA, 20 bp, Artificial Sequence
  Artificially Synthesized Primer Sequence
gcattgggagttcagagagc

SEQ ID NO: 12951 - DNA, 20 bp, Artificial Sequence
  Artificially Synthesized Primer Sequence
cttgacgggcagataggaag

SEQ ID NO: 12952 - DNA, 20 bp, Artificial Sequence
  Artificially Synthesized Primer Sequence
tgtgttgttgggcaggtcta

SEQ ID NO: 12953 - DNA, 20 bp, Artificial Sequence
  Artificially Synthesized Primer Sequence
ttcagacaatggcaaagctg

SEQ ID NO: 12954 - DNA, 20 bp, Artificial Sequence
  Artificially Synthesized Primer Sequence
tgctcaagctcttcgagtga

SEQ ID NO: 12955 - DNA, 20 bp, Artificial Sequence
  Artificially Synthesized Primer Sequence
tccacccaacaaacagaaca

SEQ ID NO: 12956 - DNA, 20 bp, Artificial Sequence
  Artificially Synthesized Primer Sequence
tgactcggacaccaagtctg

SEQ ID NO: 12957 - DNA, 20 bp, Artificial Sequence
  Artificially Synthesized Primer Sequence
ggtgatccctacctgaagca

SEQ ID NO: 12958 - DNA, 20 bp, Artificial Sequence
  Artificially Synthesized Primer Sequence
agcagctacatccgcaagat

SEQ ID NO: 12959 - DNA, 20 bp, Artificial Sequence
  Artificially Synthesized Primer Sequence
agcagctacatccgcaagat

SEQ ID NO: 12960 - DNA, 20 bp, Artificial Sequence
  Artificially Synthesized Primer Sequence
ggtgatccctacctgaagca

SEQ ID NO: 12961 - DNA, 20 bp, Artificial Sequence
  Artificially Synthesized Primer Sequence
caaatttctcgaccagggaa

SEQ ID NO: 12962 - DNA, 20 bp, Artificial Sequence
  Artificially Synthesized Primer Sequence
cgcgttgataccaaaaacct

SEQ ID NO: 12963 - DNA, 20 bp, Artificial Sequence
  Artificially Synthesized Primer Sequence
gcatgtcagagattttcgca

SEQ ID NO: 12964 - DNA, 20 bp, Artificial Sequence
  Artificially Synthesized Primer Sequence
ctggttacttgggtgccaat

SEQ ID NO: 12965 - DNA, 20 bp, Artificial Sequence
  Artificially Synthesized Primer Sequence
aaacggttgaggacgatttg

SEQ ID NO: 12966 - DNA, 20 bp, Artificial Sequence
  Artificially Synthesized Primer Sequence
gttgagtctgcattctggca

SEQ ID NO: 12967 - DNA, 20 bp, Artificial Sequence
  Artificially Synthesized Primer Sequence
aacaggcacaaacgaacaca

SEQ ID NO: 12968 - DNA, 20 bp, Artificial Sequence
  Artificially Synthesized Primer Sequence
ttccgacttctgcactgcta

SEQ ID NO: 12969 - DNA, 20 bp, Artificial Sequence
  Artificially Synthesized Primer Sequence
cagcttgcaattcagcacat

SEQ ID NO: 12970 - DNA, 20 bp, Artificial Sequence
  Artificially Synthesized Primer Sequence
tgactagccagcagagggat

SEQ ID NO: 12971 - DNA, 20 bp, Artificial Sequence
  Artificially Synthesized Primer Sequence
aacgtgacagcagcagctta

SEQ ID NO: 12972 - DNA, 20 bp, Artificial Sequence
  Artificially Synthesized Primer Sequence
aacaacttgaagcgactggc

SEQ ID NO: 12973 - DNA, 20 bp, Artificial Sequence
  Artificially Synthesized Primer Sequence
cttccgtgaggcttgagttc

SEQ ID NO: 12974 - DNA, 20 bp, Artificial Sequence
  Artificially Synthesized Primer Sequence
acggatacaagaggacgtgg

SEQ ID NO: 12975 - DNA, 20 bp, Artificial Sequence
  Artificially Synthesized Primer Sequence
tgtcctcatgctgagacctg

SEQ ID NO: 12976 - DNA, 20 bp, Artificial Sequence
  Artificially Synthesized Primer Sequence
aaggctcgtgcgtcaatagt

SEQ ID NO: 12977 - DNA, 20 bp, Artificial Sequence
  Artificially Synthesized Primer Sequence
tagtacagctatggccccca

SEQ ID NO: 12978 - DNA, 20 bp, Artificial Sequence
  Artificially Synthesized Primer Sequence
agcatgttttctcgagccat

SEQ ID NO: 12979 - DNA, 21 bp, Artificial Sequence
  Artificially Synthesized Primer Sequence
cgacagcattcacatacaagc

SEQ ID NO: 12980 - DNA, 20 bp, Artificial Sequence
  Artificially Synthesized Primer Sequence
tagtacagctatggccccca

SEQ ID NO: 12981 - DNA, 20 bp, Artificial Sequence
  Artificially Synthesized Primer Sequence
acttcctcgggaagaagctc

SEQ ID NO: 12982 - DNA, 20 bp, Artificial Sequence
  Artificially Synthesized Primer Sequence
tgattttccttgacccttgc

SEQ ID NO: 12983 - DNA, 20 bp, Artificial Sequence
  Artificially Synthesized Primer Sequence
ctgctggatgtgttgtcagg

SEQ ID NO: 12984 - DNA, 20 bp, Artificial Sequence
  Artificially Synthesized Primer Sequence
ggtttggtccaagaagctca

SEQ ID NO: 12985 - DNA, 20 bp, Artificial Sequence
  Artificially Synthesized Primer Sequence
ggtggtgatggcactctttt

SEQ ID NO: 12986 - DNA, 20 bp, Artificial Sequence
  Artificially Synthesized Primer Sequence
aggtctccccattgcttctt

SEQ ID NO: 12987 - DNA, 20 bp, Artificial Sequence
  Artificially Synthesized Primer Sequence
ctaacccatggagcagtggt

SEQ ID NO: 12988 - DNA, 20 bp, Artificial Sequence
  Artificially Synthesized Primer Sequence
ctgccaggaactttgaggag

SEQ ID NO: 12989 - DNA, 20 bp, Artificial Sequence
  Artificially Synthesized Primer Sequence
gttcgccaagctaaagcaac

SEQ ID NO: 12990 - DNA, 20 bp, Artificial Sequence
  Artificially Synthesized Primer Sequence
tcaatccatcagccatcaaa

SEQ ID NO: 12991 - DNA, 20 bp, Artificial Sequence
  Artificially Synthesized Primer Sequence
tcaatccatcagccatcaaa

SEQ ID NO: 12992 - DNA, 20 bp, Artificial Sequence
  Artificially Synthesized Primer Sequence
aagcaacaggaagcaaagga

SEQ ID NO: 12993 - DNA, 20 bp, Artificial Sequence
  Artificially Synthesized Primer Sequence
caaatcctgatgatccgctt

SEQ ID NO: 12994 - DNA, 20 bp, Artificial Sequence
  Artificially Synthesized Primer Sequence
ttgaacgaaccgggagttac

SEQ ID NO: 12995 - DNA, 20 bp, Artificial Sequence
  Artificially Synthesized Primer Sequence
catcacactcggtacaagcg

SEQ ID NO: 12996 - DNA, 20 bp, Artificial Sequence
  Artificially Synthesized Primer Sequence
cttgggaggatatgccttga

SEQ ID NO: 12997 - DNA, 20 bp, Artificial Sequence
  Artificially Synthesized Primer Sequence
tttgttgagcctgtctggtg

SEQ ID NO: 12998 - DNA, 20 bp, Artificial Sequence
  Artificially Synthesized Primer Sequence
gtggagtggatccgacaagt

SEQ ID NO: 12999 - DNA, 20 bp, Artificial Sequence
  Artificially Synthesized Primer Sequence
gtggagtggatccgacaagt

SEQ ID NO: 13000 - DNA, 20 bp, Artificial Sequence
  Artificially Synthesized Primer Sequence
tttgttgagcctgtctggtg

SEQ ID NO: 13001 - DNA, 20 bp, Artificial Sequence
  Artificially Synthesized Primer Sequence
aacccgtccacaaacagaag

SEQ ID NO: 13002 - DNA, 20 bp, Artificial Sequence
  Artificially Synthesized Primer Sequence
cttccactggcataggcaat

SEQ ID NO: 13003 - DNA, 20 bp, Artificial Sequence
  Artificially Synthesized Primer Sequence
tggttttgggatgtttggtt

SEQ ID NO: 13004 - DNA, 20 bp, Artificial Sequence
  Artificially Synthesized Primer Sequence
tcctggcttatgcaggagat

SEQ ID NO: 13005 - DNA, 20 bp, Artificial Sequence
  Artificially Synthesized Primer Sequence
cattaggcacgaggtacggt

SEQ ID NO: 13006 - DNA, 20 bp, Artificial Sequence
  Artificially Synthesized Primer Sequence
ccaccaacctcaccagaact

SEQ ID NO: 13007 - DNA, 20 bp, Artificial Sequence
  Artificially Synthesized Primer Sequence
gccctagggaggatgaagtc

SEQ ID NO: 13008 - DNA, 20 bp, Artificial Sequence
  Artificially Synthesized Primer Sequence
gtcactatgcccctcgtcat

SEQ ID NO: 13009 - DNA, 20 bp, Artificial Sequence
  Artificially Synthesized Primer Sequence
tttctttcttggtgtggggt

SEQ ID NO: 13010 - DNA, 20 bp, Artificial Sequence
  Artificially Synthesized Primer Sequence
aaacaagggggaaggaaaaa

SEQ ID NO: 13011 - DNA, 20 bp, Artificial Sequence
  Artificially Synthesized Primer Sequence
cggagattattgctggtgct

SEQ ID NO: 13012 - DNA, 20 bp, Artificial Sequence
  Artificially Synthesized Primer Sequence
tggttgctgcagtaagttgc

SEQ ID NO: 13013 - DNA, 20 bp, Artificial Sequence
  Artificially Synthesized Primer Sequence
ggcgaaattcaaaggaacaa

SEQ ID NO: 13014 - DNA, 20 bp, Artificial Sequence
  Artificially Synthesized Primer Sequence
agcattgacaaccttccacc

SEQ ID NO: 13015 - DNA, 21 bp, Artificial Sequence
  Artificially Synthesized Primer Sequence
caccagatcgagagacacaca

SEQ ID NO: 13016 - DNA, 20 bp, Artificial Sequence
  Artificially Synthesized Primer Sequence
catgcacgcgtagtgctagt

SEQ ID NO: 13017 - DNA, 20 bp, Artificial Sequence
  Artificially Synthesized Primer Sequence
aacacacacagagctgccac

SEQ ID NO: 13018 - DNA, 20 bp, Artificial Sequence
  Artificially Synthesized Primer Sequence
catagataccagggaggcca

SEQ ID NO: 13019 - DNA, 20 bp, Artificial Sequence
  Artificially Synthesized Primer Sequence
aacatgggcttcttatcgga

SEQ ID NO: 13020 - DNA, 20 bp, Artificial Sequence
  Artificially Synthesized Primer Sequence
tggcagggaaaaagcattac

SEQ ID NO: 13021 - DNA, 20 bp, Artificial Sequence
  Artificially Synthesized Primer Sequence
gcagacatggcaaaggaaat

SEQ ID NO: 13022 - DNA, 20 bp, Artificial Sequence
  Artificially Synthesized Primer Sequence
agtaaatgacgcatccccag

SEQ ID NO: 13023 - DNA, 20 bp, Artificial Sequence
  Artificially Synthesized Primer Sequence
aaaaatccctgccacacaac

SEQ ID NO: 13024 - DNA, 20 bp, Artificial Sequence
  Artificially Synthesized Primer Sequence
tagtaaccatctgcgagggg

SEQ ID NO: 13025 - DNA, 20 bp, Artificial Sequence
  Artificially Synthesized Primer Sequence
caacccctacatgtccaacc

SEQ ID NO: 13026 - DNA, 20 bp, Artificial Sequence
  Artificially Synthesized Primer Sequence
tgagagcagcaaaccaacac

SEQ ID NO: 13027 - DNA, 20 bp, Artificial Sequence
  Artificially Synthesized Primer Sequence
attccactcagccaaaccag

SEQ ID NO: 13028 - DNA, 20 bp, Artificial Sequence
  Artificially Synthesized Primer Sequence
ggttaagaaccgtcagccaa

SEQ ID NO: 13029 - DNA, 20 bp, Artificial Sequence
  Artificially Synthesized Primer Sequence
gagagagacagagagcccga

SEQ ID NO: 13030 - DNA, 20 bp, Artificial Sequence
  Artificially Synthesized Primer Sequence
gagaagaaaggggagggaga

SEQ ID NO: 13031 - DNA, 20 bp, Artificial Sequence
  Artificially Synthesized Primer Sequence
tctgactgcacccaacaaac

SEQ ID NO: 13032 - DNA, 20 bp, Artificial Sequence
  Artificially Synthesized Primer Sequence
tacggcccaggaatgtagtc

SEQ ID NO: 13033 - DNA, 20 bp, Artificial Sequence
  Artificially Synthesized Primer Sequence
ttgggaggtggtttcatcat

SEQ ID NO: 13034 - DNA, 20 bp, Artificial Sequence
  Artificially Synthesized Primer Sequence
aattgcggaggttcacaaac

SEQ ID NO: 13035 - DNA, 20 bp, Artificial Sequence
  Artificially Synthesized Primer Sequence
caatgagataggcacggtga

SEQ ID NO: 13036 - DNA, 20 bp, Artificial Sequence
  Artificially Synthesized Primer Sequence
gatcttcgtcagcgcaattt

SEQ ID NO: 13037 - DNA, 20 bp, Artificial Sequence
  Artificially Synthesized Primer Sequence
gcccgtctgtgaagaacatt

SEQ ID NO: 13038 - DNA, 20 bp, Artificial Sequence
  Artificially Synthesized Primer Sequence
atgccgccatcaataatctc

SEQ ID NO: 13039 - DNA, 20 bp, Artificial Sequence
  Artificially Synthesized Primer Sequence
cacagttgcgcttctggtta

SEQ ID NO: 13040 - DNA, 20 bp, Artificial Sequence
  Artificially Synthesized Primer Sequence
gttttgctgattcggttggt

SEQ ID NO: 13041 - DNA, 20 bp, Artificial Sequence
  Artificially Synthesized Primer Sequence
aggttgttgtcaatcccagc

SEQ ID NO: 13042 - DNA, 20 bp, Artificial Sequence
  Artificially Synthesized Primer Sequence
catgtttcctgcctcttggt

SEQ ID NO: 13043 - DNA, 20 bp, Artificial Sequence
  Artificially Synthesized Primer Sequence
caaaccgacgaactccattt

SEQ ID NO: 13044 - DNA, 20 bp, Artificial Sequence
  Artificially Synthesized Primer Sequence
aaattttcgaccgtggaatg

SEQ ID NO: 13045 - DNA, 20 bp, Artificial Sequence
  Artificially Synthesized Primer Sequence
gttcctcctgagcttcatcg

SEQ ID NO: 13046 - DNA, 20 bp, Artificial Sequence
  Artificially Synthesized Primer Sequence
tcccataaaccaataggcca

SEQ ID NO: 13047 - DNA, 21 bp, Artificial Sequence
  Artificially Synthesized Primer Sequence
ggattatatgcaggaaacccc

SEQ ID NO: 13048 - DNA, 20 bp, Artificial Sequence
  Artificially Synthesized Primer Sequence
gttcctcctgagcttcatcg

SEQ ID NO: 13049 - DNA, 20 bp, Artificial Sequence
  Artificially Synthesized Primer Sequence
atgccttctgggagaacctt

SEQ ID NO: 13050 - DNA, 20 bp, Artificial Sequence
  Artificially Synthesized Primer Sequence
ctctagcctgtgcatcacca

SEQ ID NO: 13051 - DNA, 20 bp, Artificial Sequence
  Artificially Synthesized Primer Sequence
tgttgtgcgtgtcttgtgaa

SEQ ID NO: 13052 - DNA, 20 bp, Artificial Sequence
  Artificially Synthesized Primer Sequence
agcatatcctgtggcacctc

SEQ ID NO: 13053 - DNA, 20 bp, Artificial Sequence
  Artificially Synthesized Primer Sequence
agggtccccaaccataattc

SEQ ID NO: 13054 - DNA, 20 bp, Artificial Sequence
  Artificially Synthesized Primer Sequence
ccacaatgttacggcagttg

SEQ ID NO: 13055 - DNA, 20 bp, Artificial Sequence
  Artificially Synthesized Primer Sequence
gctgttgtccgtgttgattg

SEQ ID NO: 13056 - DNA, 20 bp, Artificial Sequence
  Artificially Synthesized Primer Sequence
gctaaccgagaagagcgaca

SEQ ID NO: 13057 - DNA, 20 bp, Artificial Sequence
  Artificially Synthesized Primer Sequence
agcagagcggctgtttagag

SEQ ID NO: 13058 - DNA, 20 bp, Artificial Sequence
  Artificially Synthesized Primer Sequence
ttgacagcatcctcttcacg

SEQ ID NO: 13059 - DNA, 20 bp, Artificial Sequence
  Artificially Synthesized Primer Sequence
aaacttagcccactggagca

SEQ ID NO: 13060 - DNA, 21 bp, Artificial Sequence
  Artificially Synthesized Primer Sequence
gctgaagaagctgtcaggaga

SEQ ID NO: 13061 - DNA, 20 bp, Artificial Sequence
  Artificially Synthesized Primer Sequence
tgtctcttgacaagcatccg

SEQ ID NO: 13062 - DNA, 20 bp, Artificial Sequence
  Artificially Synthesized Primer Sequence
ccatgcaagggctacaaaat

SEQ ID NO: 13063 - DNA, 20 bp, Artificial Sequence
  Artificially Synthesized Primer Sequence
caggctgcactcaacaaaaa

SEQ ID NO: 13064 - DNA, 20 bp, Artificial Sequence
  Artificially Synthesized Primer Sequence
gtaaccttggagggaaagcc

SEQ ID NO: 13065 - DNA, 20 bp, Artificial Sequence
  Artificially Synthesized Primer Sequence
gatcaatggacatggtgcag

SEQ ID NO: 13066 - DNA, 20 bp, Artificial Sequence
  Artificially Synthesized Primer Sequence
gattaagggccacaaaacga

SEQ ID NO: 13067 - DNA, 20 bp, Artificial Sequence
  Artificially Synthesized Primer Sequence
tcaatccaaggttctccagg

SEQ ID NO: 13068 - DNA, 20 bp, Artificial Sequence
  Artificially Synthesized Primer Sequence
ggttaatgcagtccaggcat

SEQ ID NO: 13069 - DNA, 20 bp, Artificial Sequence
  Artificially Synthesized Primer Sequence
agtgtggttggaattgctcc

SEQ ID NO: 13070 - DNA, 20 bp, Artificial Sequence
  Artificially Synthesized Primer Sequence
tctccattcgcttcagtgtg

SEQ ID NO: 13071 - DNA, 20 bp, Artificial Sequence
  Artificially Synthesized Primer Sequence
agatcaagctgcggtcaact

SEQ ID NO: 13072 - DNA, 20 bp, Artificial Sequence
  Artificially Synthesized Primer Sequence
ctccgtctccacaaggtgat

SEQ ID NO: 13073 - DNA, 20 bp, Artificial Sequence
  Artificially Synthesized Primer Sequence
ttgagcttgtccctcgtctt

SEQ ID NO: 13074 - DNA, 20 bp, Artificial Sequence
  Artificially Synthesized Primer Sequence
ttctgcttcgctgatgattg

SEQ ID NO: 13075 - DNA, 20 bp, Artificial Sequence
  Artificially Synthesized Primer Sequence
agcatgatcattggacgaca

SEQ ID NO: 13076 - DNA, 20 bp, Artificial Sequence
  Artificially Synthesized Primer Sequence
caatcatcagcgaagcagaa

SEQ ID NO: 13077 - DNA, 20 bp, Artificial Sequence
  Artificially Synthesized Primer Sequence
tcaaggattttgctgctgtg

SEQ ID NO: 13078 - DNA, 20 bp, Artificial Sequence
  Artificially Synthesized Primer Sequence
taccgatagccggactcaac

SEQ ID NO: 13079 - DNA, 20 bp, Artificial Sequence
  Artificially Synthesized Primer Sequence
gttatgcctctttgacggga

SEQ ID NO: 13080 - DNA, 20 bp, Artificial Sequence
  Artificially Synthesized Primer Sequence
gacggatatccagtttccca

SEQ ID NO: 13081 - DNA, 20 bp, Artificial Sequence
  Artificially Synthesized Primer Sequence
cacgctgaagaatctccctc

SEQ ID NO: 13082 - DNA, 20 bp, Artificial Sequence
  Artificially Synthesized Primer Sequence
tcttaggccactggacaacc

SEQ ID NO: 13083 - DNA, 20 bp, Artificial Sequence
  Artificially Synthesized Primer Sequence
cactggatcccagcaaaaat

SEQ ID NO: 13084 - DNA, 20 bp, Artificial Sequence
  Artificially Synthesized Primer Sequence
tctgactcctgatggtgctg

SEQ ID NO: 13085 - DNA, 20 bp, Artificial Sequence
  Artificially Synthesized Primer Sequence
agatgcaggcctttaagcaa

SEQ ID NO: 13086 - DNA, 20 bp, Artificial Sequence
  Artificially Synthesized Primer Sequence
gcatggttgaacacatcctg

SEQ ID NO: 13087 - DNA, 20 bp, Artificial Sequence
  Artificially Synthesized Primer Sequence
tgcctccaaggttgatcttc

SEQ ID NO: 13088 - DNA, 19 bp, Artificial Sequence
  Artificially Synthesized Primer Sequence
gccaggttaacatccccag

SEQ ID NO: 13089 - DNA, 20 bp, Artificial Sequence
  Artificially Synthesized Primer Sequence
agtgctgcatgctcattttg

SEQ ID NO: 13090 - DNA, 20 bp, Artificial Sequence
  Artificially Synthesized Primer Sequence
aagaactggggcaatctcct

SEQ ID NO: 13091 - DNA, 20 bp, Artificial Sequence
  Artificially Synthesized Primer Sequence
atatcatatctcaccgccgc

SEQ ID NO: 13092 - DNA, 20 bp, Artificial Sequence
  Artificially Synthesized Primer Sequence
agtgctgcatgctcattttg

SEQ ID NO: 13093 - DNA, 20 bp, Artificial Sequence
  Artificially Synthesized Primer Sequence
gactgccacatcccaaactt

SEQ ID NO: 13094 - DNA, 20 bp, Artificial Sequence
  Artificially Synthesized Primer Sequence
tcttgggaaacaaaggatcg

SEQ ID NO: 13095 - DNA, 20 bp, Artificial Sequence
  Artificially Synthesized Primer Sequence
caggcttacacaccgttcaa

SEQ ID NO: 13096 - DNA, 19 bp, Artificial Sequence
  Artificially Synthesized Primer Sequence
cttggatggacctttgggt

SEQ ID NO: 13097 - DNA, 20 bp, Artificial Sequence
  Artificially Synthesized Primer Sequence
gtgtgcgctgttctcaaaaa

SEQ ID NO: 13098 - DNA, 20 bp, Artificial Sequence
  Artificially Synthesized Primer Sequence
gcagcaacctatgggtcatt

SEQ ID NO: 13099 - DNA, 20 bp, Artificial Sequence
  Artificially Synthesized Primer Sequence
cgatttatatagcgggtcgg

SEQ ID NO: 13100 - DNA, 20 bp, Artificial Sequence
  Artificially Synthesized Primer Sequence
atccctctgatgcagacacc

SEQ ID NO: 13101 - DNA, 20 bp, Artificial Sequence
  Artificially Synthesized Primer Sequence
cgcttcagatagaggccaac

SEQ ID NO: 13102 - DNA, 20 bp, Artificial Sequence
  Artificially Synthesized Primer Sequence
gtttcttgttgtcggggaaa

SEQ ID NO: 13103 - DNA, 20 bp, Artificial Sequence
  Artificially Synthesized Primer Sequence
gtttcttgttgtcggggaaa

SEQ ID NO: 13104 - DNA, 20 bp, Artificial Sequence
  Artificially Synthesized Primer Sequence
cgcttcagatagaggccaac

SEQ ID NO: 13105 - DNA, 20 bp, Artificial Sequence
  Artificially Synthesized Primer Sequence
agtgcaggctaaccctcaga

SEQ ID NO: 13106 - DNA, 20 bp, Artificial Sequence
  Artificially Synthesized Primer Sequence
cggaagtatcaatctcccca

SEQ ID NO: 13107 - DNA, 20 bp, Artificial Sequence
  Artificially Synthesized Primer Sequence
ctgtgagtgcgggagtatca

SEQ ID NO: 13108 - DNA, 20 bp, Artificial Sequence
  Artificially Synthesized Primer Sequence
agtgcaggctaaccctcaga

SEQ ID NO: 13109 - DNA, 20 bp, Artificial Sequence
  Artificially Synthesized Primer Sequence
ccaacttgtctggccaaaat

SEQ ID NO: 13110 - DNA, 20 bp, Artificial Sequence
  Artificially Synthesized Primer Sequence
gctgcttgtcccaggtgtat

SEQ ID NO: 13111 - DNA, 20 bp, Artificial Sequence
  Artificially Synthesized Primer Sequence
atagaagccgggttacatcg

SEQ ID NO: 13112 - DNA, 21 bp, Artificial Sequence
  Artificially Synthesized Primer Sequence
tcgttccttcatctgtcacct

SEQ ID NO: 13113 - DNA, 20 bp, Artificial Sequence
  Artificially Synthesized Primer Sequence
gcatcgctacctactctggc

SEQ ID NO: 13114 - DNA, 20 bp, Artificial Sequence
  Artificially Synthesized Primer Sequence
tattttcctccccaccacaa

SEQ ID NO: 13115 - DNA, 20 bp, Artificial Sequence
  Artificially Synthesized Primer Sequence
agatttgaggggagaatggg

SEQ ID NO: 13116 - DNA, 20 bp, Artificial Sequence
  Artificially Synthesized Primer Sequence
caagctgtcatccgagttca

SEQ ID NO: 13117 - DNA, 20 bp, Artificial Sequence
  Artificially Synthesized Primer Sequence
aacaagttctgcgtctccgt

SEQ ID NO: 13118 - DNA, 20 bp, Artificial Sequence
  Artificially Synthesized Primer Sequence
tccactagggacaaaaggga

SEQ ID NO: 13119 - DNA, 20 bp, Artificial Sequence
  Artificially Synthesized Primer Sequence
agaaaaagaagggcgtggtt

SEQ ID NO: 13120 - DNA, 19 bp, Artificial Sequence
  Artificially Synthesized Primer Sequence
agttcctgctcgagtcgct

SEQ ID NO: 13121 - DNA, 20 bp, Artificial Sequence
  Artificially Synthesized Primer Sequence
gctcgtccaaaacccaatta

SEQ ID NO: 13122 - DNA, 20 bp, Artificial Sequence
  Artificially Synthesized Primer Sequence
tgcacaagattccacagctc

SEQ ID NO: 13123 - DNA, 20 bp, Artificial Sequence
  Artificially Synthesized Primer Sequence
gtaccattagctgccccaaa

SEQ ID NO: 13124 - DNA, 20 bp, Artificial Sequence
  Artificially Synthesized Primer Sequence
ggcatgctcttcgagttttc

SEQ ID NO: 13125 - DNA, 20 bp, Artificial Sequence
  Artificially Synthesized Primer Sequence
acaaccactttgcctgttcc

SEQ ID NO: 13126 - DNA, 20 bp, Artificial Sequence
  Artificially Synthesized Primer Sequence
ttcgaggtaggcaatctgct

SEQ ID NO: 13127 - DNA, 20 bp, Artificial Sequence
  Artificially Synthesized Primer Sequence
ttacagcggaaaagaatggg

SEQ ID NO: 13128 - DNA, 20 bp, Artificial Sequence
  Artificially Synthesized Primer Sequence
cttagctatggccgcagaac

SEQ ID NO: 13129 - DNA, 20 bp, Artificial Sequence
  Artificially Synthesized Primer Sequence
aggcgtctccttctcctagc

SEQ ID NO: 13130 - DNA, 20 bp, Artificial Sequence
  Artificially Synthesized Primer Sequence
tggatgcggacaaacagata

SEQ ID NO: 13131 - DNA, 21 bp, Artificial Sequence
  Artificially Synthesized Primer Sequence
cgtgtatagcaatagggagcg

SEQ ID NO: 13132 - DNA, 19 bp, Artificial Sequence
  Artificially Synthesized Primer Sequence
catgatccaccggcattac

SEQ ID NO: 13133 - DNA, 20 bp, Artificial Sequence
  Artificially Synthesized Primer Sequence
tgctgatcatggagaagtgc

SEQ ID NO: 13134 - DNA, 20 bp, Artificial Sequence
  Artificially Synthesized Primer Sequence
gcctcgatgacaccagaaat

SEQ ID NO: 13135 - DNA, 20 bp, Artificial Sequence
  Artificially Synthesized Primer Sequence
actttagccttgctccccat

SEQ ID NO: 13136 - DNA, 20 bp, Artificial Sequence
  Artificially Synthesized Primer Sequence
atgcatttgctcaagaggct

SEQ ID NO: 13137 - DNA, 20 bp, Artificial Sequence
  Artificially Synthesized Primer Sequence
atgctccagcagagtccagt

SEQ ID NO: 13138 - DNA, 20 bp, Artificial Sequence
  Artificially Synthesized Primer Sequence
aagtcgcttcacatcgcttt

SEQ ID NO: 13139 - DNA, 20 bp, Artificial Sequence
  Artificially Synthesized Primer Sequence
tgcttctatttgcagccctt

SEQ ID NO: 13140 - DNA, 20 bp, Artificial Sequence
  Artificially Synthesized Primer Sequence
atgctccagcagagtccagt

SEQ ID NO: 13141 - DNA, 20 bp, Artificial Sequence
  Artificially Synthesized Primer Sequence
tttcccatggaccatagctc

SEQ ID NO: 13142 - DNA, 20 bp, Artificial Sequence
  Artificially Synthesized Primer Sequence
aaggaagggttaatggggtg

SEQ ID NO: 13143 - DNA, 21 bp, Artificial Sequence
  Artificially Synthesized Primer Sequence
catgaatgccgaaacttctgt

SEQ ID NO: 13144 - DNA, 20 bp, Artificial Sequence
  Artificially Synthesized Primer Sequence
atttgtgcaaaacctcctcg

SEQ ID NO: 13145 - DNA, 20 bp, Artificial Sequence
  Artificially Synthesized Primer Sequence
agctcatggtgtgctttgtg

SEQ ID NO: 13146 - DNA, 20 bp, Artificial Sequence
  Artificially Synthesized Primer Sequence
cagcacggctcaagtgaata

SEQ ID NO: 13147 - DNA, 20 bp, Artificial Sequence
  Artificially Synthesized Primer Sequence
cccagttttccactagcagc

SEQ ID NO: 13148 - DNA, 20 bp, Artificial Sequence
  Artificially Synthesized Primer Sequence
gagatgttcttctccgcagg

SEQ ID NO: 13149 - DNA, 20 bp, Artificial Sequence
  Artificially Synthesized Primer Sequence
ctgtggtcgatttctgctca

SEQ ID NO: 13150 - DNA, 20 bp, Artificial Sequence
  Artificially Synthesized Primer Sequence
actgaagcgctttgtggact

SEQ ID NO: 13151 - DNA, 20 bp, Artificial Sequence
  Artificially Synthesized Primer Sequence
ttacaatctgcagagcagcg

SEQ ID NO: 13152 - DNA, 20 bp, Artificial Sequence
  Artificially Synthesized Primer Sequence
atgagatcgactgggactcg

SEQ ID NO: 13153 - DNA, 20 bp, Artificial Sequence
  Artificially Synthesized Primer Sequence
ggcgcttcagtcaaaatagg

SEQ ID NO: 13154 - DNA, 20 bp, Artificial Sequence
  Artificially Synthesized Primer Sequence
aagcatgcatggctagttcc

SEQ ID NO: 13155 - DNA, 20 bp, Artificial Sequence
  Artificially Synthesized Primer Sequence
aaagaaggggctagctctgg

SEQ ID NO: 13156 - DNA, 20 bp, Artificial Sequence
  Artificially Synthesized Primer Sequence
agttcgggtgatattgcagc

SEQ ID NO: 13157 - DNA, 20 bp, Artificial Sequence
  Artificially Synthesized Primer Sequence
gttcttgtaacccgccaaaa

SEQ ID NO: 13158 - DNA, 20 bp, Artificial Sequence
  Artificially Synthesized Primer Sequence
tcattgatgtgaggacgcat

SEQ ID NO: 13159 - DNA, 20 bp, Artificial Sequence
  Artificially Synthesized Primer Sequence
aaaaggcctagagcatgggt

SEQ ID NO: 13160 - DNA, 20 bp, Artificial Sequence
  Artificially Synthesized Primer Sequence
acatttggtcgctaggttgc

SEQ ID NO: 13161 - DNA, 20 bp, Artificial Sequence
  Artificially Synthesized Primer Sequence
cactgctggagctgatgaag

SEQ ID NO: 13162 - DNA, 20 bp, Artificial Sequence
  Artificially Synthesized Primer Sequence
aacatggccagaacacacaa

SEQ ID NO: 13163 - DNA, 20 bp, Artificial Sequence
  Artificially Synthesized Primer Sequence
aacatggccagaacacacaa

SEQ ID NO: 13164 - DNA, 20 bp, Artificial Sequence
  Artificially Synthesized Primer Sequence
cgaggtcgtcaagatggact

SEQ ID NO: 13165 - DNA, 20 bp, Artificial Sequence
  Artificially Synthesized Primer Sequence
ctgtgaagagaagcccaacc

SEQ ID NO: 13166 - DNA, 20 bp, Artificial Sequence
  Artificially Synthesized Primer Sequence
tccgtccggaaatacttgtc

SEQ ID NO: 13167 - DNA, 22 bp, Artificial Sequence
  Artificially Synthesized Primer Sequence
tgtgtacaaaaatacttgcccg

SEQ ID NO: 13168 - DNA, 20 bp, Artificial Sequence
  Artificially Synthesized Primer Sequence
gagtgcaggatcaagggaga

SEQ ID NO: 13169 - DNA, 20 bp, Artificial Sequence
  Artificially Synthesized Primer Sequence
caggggaaataacccctcat

SEQ ID NO: 13170 - DNA, 20 bp, Artificial Sequence
  Artificially Synthesized Primer Sequence
ggttcaaacgcgtgaaatct

SEQ ID NO: 13171 - DNA, 20 bp, Artificial Sequence
  Artificially Synthesized Primer Sequence
tcgactggaacagagcatgt

SEQ ID NO: 13172 - DNA, 22 bp, Artificial Sequence
  Artificially Synthesized Primer Sequence
ggcgtagatacataggagagcg

SEQ ID NO: 13173 - DNA, 20 bp, Artificial Sequence
  Artificially Synthesized Primer Sequence
aaccatgttgaggtgaagcc

SEQ ID NO: 13174 - DNA, 20 bp, Artificial Sequence
  Artificially Synthesized Primer Sequence
acagcacacgattatgcgag

SEQ ID NO: 13175 - DNA, 20 bp, Artificial Sequence
  Artificially Synthesized Primer Sequence
agcacagcacacgattatgc

SEQ ID NO: 13176 - DNA, 20 bp, Artificial Sequence
  Artificially Synthesized Primer Sequence
gacgaggacatgttcgaggt

SEQ ID NO: 13177 - DNA, 20 bp, Artificial Sequence
  Artificially Synthesized Primer Sequence
ccgttgtgacaatgaaccag

SEQ ID NO: 13178 - DNA, 20 bp, Artificial Sequence
  Artificially Synthesized Primer Sequence
tcctgcttctttccctcgta

SEQ ID NO: 13179 - DNA, 20 bp, Artificial Sequence
  Artificially Synthesized Primer Sequence
cctacagaaatggggcttca

SEQ ID NO: 13180 - DNA, 20 bp, Artificial Sequence
  Artificially Synthesized Primer Sequence
ccgttcttgatctccttggt

SEQ ID NO: 13181 - DNA, 20 bp, Artificial Sequence
  Artificially Synthesized Primer Sequence
cgaggagtcaggtgaaggag

SEQ ID NO: 13182 - DNA, 20 bp, Artificial Sequence
  Artificially Synthesized Primer Sequence
gttgtattccccaagaggca

SEQ ID NO: 13183 - DNA, 20 bp, Artificial Sequence
  Artificially Synthesized Primer Sequence
tagtgcctcgaagcttctcc

SEQ ID NO: 13184 - DNA, 20 bp, Artificial Sequence
  Artificially Synthesized Primer Sequence
cgagcttggaccttcttcaa

SEQ ID NO: 13185 - DNA, 20 bp, Artificial Sequence
  Artificially Synthesized Primer Sequence
tgttggggagaaacaccttt

SEQ ID NO: 13186 - DNA, 20 bp, Artificial Sequence
  Artificially Synthesized Primer Sequence
cgccgctagagagaaagaaa

SEQ ID NO: 13187 - DNA, 20 bp, Artificial Sequence
  Artificially Synthesized Primer Sequence
gcaaccgtagtccttgtggt

SEQ ID NO: 13188 - DNA, 20 bp, Artificial Sequence
  Artificially Synthesized Primer Sequence
gtgtggcctttcaggtgatt

SEQ ID NO: 13189 - DNA, 20 bp, Artificial Sequence
  Artificially Synthesized Primer Sequence
tccctggctattttgtttgg

SEQ ID NO: 13190 - DNA, 20 bp, Artificial Sequence
  Artificially Synthesized Primer Sequence
cagcaacatctttggcttca

SEQ ID NO: 13191 - DNA, 20 bp, Artificial Sequence
  Artificially Synthesized Primer Sequence
tacaccgcggtttcacaata

SEQ ID NO: 13192 - DNA, 20 bp, Artificial Sequence
  Artificially Synthesized Primer Sequence
tggtgacgagactgttccag

SEQ ID NO: 13193 - DNA, 20 bp, Artificial Sequence
  Artificially Synthesized Primer Sequence
aggtacggcaagagctacga

SEQ ID NO: 13194 - DNA, 20 bp, Artificial Sequence
  Artificially Synthesized Primer Sequence
agtgctcatgcgcatagttg

SEQ ID NO: 13195 - DNA, 20 bp, Artificial Sequence
  Artificially Synthesized Primer Sequence
tcccggaaataaaatgtcgt

SEQ ID NO: 13196 - DNA, 20 bp, Artificial Sequence
  Artificially Synthesized Primer Sequence
aagatggaaatgggcaagaa

SEQ ID NO: 13197 - DNA, 20 bp, Artificial Sequence
  Artificially Synthesized Primer Sequence
atgagtacatccgcagggag

SEQ ID NO: 13198 - DNA, 20 bp, Artificial Sequence
  Artificially Synthesized Primer Sequence
aggaaccggtcgaacttctt

SEQ ID NO: 13199 - DNA, 20 bp, Artificial Sequence
  Artificially Synthesized Primer Sequence
cacccttccttacacatccc

SEQ ID NO: 13200 - DNA, 20 bp, Artificial Sequence
  Artificially Synthesized Primer Sequence
ggttcctcgacagcagactc

SEQ ID NO: 13201 - DNA, 20 bp, Artificial Sequence
  Artificially Synthesized Primer Sequence
caccaagaagaacgacagca

SEQ ID NO: 13202 - DNA, 20 bp, Artificial Sequence
  Artificially Synthesized Primer Sequence
gcttcagcccttcaacactc

SEQ ID NO: 13203 - DNA, 20 bp, Artificial Sequence
  Artificially Synthesized Primer Sequence
ccgaagtccgtacacaggtt

SEQ ID NO: 13204 - DNA, 20 bp, Artificial Sequence
  Artificially Synthesized Primer Sequence
tattcccagaatggagctgg

SEQ ID NO: 13205 - DNA, 20 bp, Artificial Sequence
  Artificially Synthesized Primer Sequence
ctagcagtttgcttcagggc

SEQ ID NO: 13206 - DNA, 20 bp, Artificial Sequence
  Artificially Synthesized Primer Sequence
cattcccacagggttaatgg

SEQ ID NO: 13207 - DNA, 20 bp, Artificial Sequence
  Artificially Synthesized Primer Sequence
gggttttgttaccgcacatc

SEQ ID NO: 13208 - DNA, 20 bp, Artificial Sequence
  Artificially Synthesized Primer Sequence
aaggacgtgatggacatggt

SEQ ID NO: 13209 - DNA, 20 bp, Artificial Sequence
  Artificially Synthesized Primer Sequence
agccgctacatgaaggagaa

SEQ ID NO: 13210 - DNA, 20 bp, Artificial Sequence
  Artificially Synthesized Primer Sequence
ctctcgcatcttggttgtca

SEQ ID NO: 13211 - DNA, 20 bp, Artificial Sequence
  Artificially Synthesized Primer Sequence
tagtaacatccacgctcccc

SEQ ID NO: 13212 - DNA, 20 bp, Artificial Sequence
  Artificially Synthesized Primer Sequence
gtcaacggattgctccagat

SEQ ID NO: 13213 - DNA, 20 bp, Artificial Sequence
  Artificially Synthesized Primer Sequence
caggaagggattgagcagag

SEQ ID NO: 13214 - DNA, 20 bp, Artificial Sequence
  Artificially Synthesized Primer Sequence
ccggagtgtaaaacccaaga

SEQ ID NO: 13215 - DNA, 18 bp, Artificial Sequence
  Artificially Synthesized Primer Sequence
gtccaattccccaccaca

SEQ ID NO: 13216 - DNA, 20 bp, Artificial Sequence
  Artificially Synthesized Primer Sequence
gcagctccttgacaagctct

SEQ ID NO: 13217 - DNA, 20 bp, Artificial Sequence
  Artificially Synthesized Primer Sequence
aattcctcgagcactgttgg

SEQ ID NO: 13218 - DNA, 20 bp, Artificial Sequence
  Artificially Synthesized Primer Sequence
tgcacctgcatgtcgtactt

SEQ ID NO: 13219 - DNA, 20 bp, Artificial Sequence
  Artificially Synthesized Primer Sequence
gccgattaattcacccacac

SEQ ID NO: 13220 - DNA, 20 bp, Artificial Sequence
  Artificially Synthesized Primer Sequence
gcgcatggagttcaaatacc

SEQ ID NO: 13221 - DNA, 20 bp, Artificial Sequence
  Artificially Synthesized Primer Sequence
gccaaggtcaattttcctga

SEQ ID NO: 13222 - DNA, 20 bp, Artificial Sequence
  Artificially Synthesized Primer Sequence
gtcttgtgcaccatttccct

SEQ ID NO: 13223 - DNA, 20 bp, Artificial Sequence
  Artificially Synthesized Primer Sequence
atcaggcatatgacccaagg

SEQ ID NO: 13224 - DNA, 20 bp, Artificial Sequence
  Artificially Synthesized Primer Sequence
agggaaatggtgcacaagac

SEQ ID NO: 13225 - DNA, 20 bp, Artificial Sequence
  Artificially Synthesized Primer Sequence
atcggttgcctatccaagtg

SEQ ID NO: 13226 - DNA, 20 bp, Artificial Sequence
  Artificially Synthesized Primer Sequence
tgttacggtatggtttcgca

SEQ ID NO: 13227 - DNA, 20 bp, Artificial Sequence
  Artificially Synthesized Primer Sequence
actacaaaagccttccccgt

SEQ ID NO: 13228 - DNA, 20 bp, Artificial Sequence
  Artificially Synthesized Primer Sequence
tgcgaaaccataccgtaaca

SEQ ID NO: 13229 - DNA, 20 bp, Artificial Sequence
  Artificially Synthesized Primer Sequence
ggctctctgtccttgtggag

SEQ ID NO: 13230 - DNA, 20 bp, Artificial Sequence
  Artificially Synthesized Primer Sequence
cccctctagacgaggaaacc

SEQ ID NO: 13231 - DNA, 20 bp, Artificial Sequence
  Artificially Synthesized Primer Sequence
tgacaagttctgaacggtgc

SEQ ID NO: 13232 - DNA, 20 bp, Artificial Sequence
  Artificially Synthesized Primer Sequence
caggggtgatcaagactcgt

SEQ ID NO: 13233 - DNA, 20 bp, Artificial Sequence
  Artificially Synthesized Primer Sequence
gctgagggagctcaagaaga

SEQ ID NO: 13234 - DNA, 20 bp, Artificial Sequence
  Artificially Synthesized Primer Sequence
gtacacgagatgagcaggca

SEQ ID NO: 13235 - DNA, 20 bp, Artificial Sequence
  Artificially Synthesized Primer Sequence
ggggctcaaaacctctaacc

SEQ ID NO: 13236 - DNA, 20 bp, Artificial Sequence
  Artificially Synthesized Primer Sequence
tagtgacacagcaacctggg

SEQ ID NO: 13237 - DNA, 20 bp, Artificial Sequence
  Artificially Synthesized Primer Sequence
atctctcccccattcagtcc

SEQ ID NO: 13238 - DNA, 20 bp, Artificial Sequence
  Artificially Synthesized Primer Sequence
agcgataagtaaccgagcca

SEQ ID NO: 13239 - DNA, 20 bp, Artificial Sequence
  Artificially Synthesized Primer Sequence
agcgataagtaaccgagcca

SEQ ID NO: 13240 - DNA, 20 bp, Artificial Sequence
  Artificially Synthesized Primer Sequence
ggaggacgacaagaactgga

SEQ ID NO: 13241 - DNA, 10 bp, Artificial Sequence
  Artificially Synthesized Primer Sequence
  MISC_FEATURE (1)..(10): n stands for any base
nnnnnnnnnn

SEQ ID NO: 13242 - DNA, 10 bp, Artificial Sequence
  Artificially Synthesized Primer Sequence
  MISC_FEATURE (1)..(10): n stands for any base
nnnnnnnnnn

SEQ ID NO: 13243 - DNA, 20 bp, Artificial Sequence
  Artificially Synthesized Primer Sequence
tgattgttacgttgcctgga

SEQ ID NO: 13244 - DNA, 20 bp, Artificial Sequence
  Artificially Synthesized Primer Sequence
catgccacataatgcaaagg

SEQ ID NO: 13245 - DNA, 20 bp, Artificial Sequence
  Artificially Synthesized Primer Sequence
ctccacacacgaggactcaa

SEQ ID NO: 13246 - DNA, 20 bp, Artificial Sequence
  Artificially Synthesized Primer Sequence
gtccgggtcttcataggaca

SEQ ID NO: 13247 - DNA, 20 bp, Artificial Sequence
  Artificially Synthesized Primer Sequence
cgaaagcacaccattcttca

SEQ ID NO: 13248 - DNA, 20 bp, Artificial Sequence
  Artificially Synthesized Primer Sequence
aatgagcaatcaatcccgag

SEQ ID NO: 13249 - DNA, 20 bp, Artificial Sequence
  Artificially Synthesized Primer Sequence
ggccagtgtatgtcggaact

SEQ ID NO: 13250 - DNA, 20 bp, Artificial Sequence
  Artificially Synthesized Primer Sequence
ccagctctaaaccccagtca

SEQ ID NO: 13251 - DNA, 20 bp, Artificial Sequence
  Artificially Synthesized Primer Sequence
cttgagaacccttaacgcga

SEQ ID NO: 13252 - DNA, 20 bp, Artificial Sequence
  Artificially Synthesized Primer Sequence
accaacttcaccgtcacctc

SEQ ID NO: 13253 - DNA, 20 bp, Artificial Sequence
  Artificially Synthesized Primer Sequence
tcatcacaggttccaagcaa

SEQ ID NO: 13254 - DNA, 20 bp, Artificial Sequence
  Artificially Synthesized Primer Sequence
gtaagctgtcgcgttcttcc

SEQ ID NO: 13255 - DNA, 20 bp, Artificial Sequence
  Artificially Synthesized Primer Sequence
aacgctggcaaagttattgg

SEQ ID NO: 13256 - DNA, 20 bp, Artificial Sequence
  Artificially Synthesized Primer Sequence
caaaccgtggaaggcttaaa

SEQ ID NO: 13257 - DNA, 20 bp, Artificial Sequence
  Artificially Synthesized Primer Sequence
aagagcttgacggtcgaaaa

SEQ ID NO: 13258 - DNA, 20 bp, Artificial Sequence
  Artificially Synthesized Primer Sequence
catggccaaaacattcctct

SEQ ID NO: 13259 - DNA, 20 bp, Artificial Sequence
  Artificially Synthesized Primer Sequence
cagcaaggaagaaaccttgg

SEQ ID NO: 13260 - DNA, 20 bp, Artificial Sequence
  Artificially Synthesized Primer Sequence
gagatggaccgcatcttgag

SEQ ID NO: 13261 - DNA, 20 bp, Artificial Sequence
  Artificially Synthesized Primer Sequence
cggttgcatctgagagttga

SEQ ID NO: 13262 - DNA, 20 bp, Artificial Sequence
  Artificially Synthesized Primer Sequence
tgctaagttgatcaccagcg

SEQ ID NO: 13263 - DNA, 21 bp, Artificial Sequence
  Artificially Synthesized Primer Sequence
ttcagggtgtcgatgaatctc

SEQ ID NO: 13264 - DNA, 20 bp, Artificial Sequence
  Artificially Synthesized Primer Sequence
cactctgatggcaacctcct

SEQ ID NO: 13265 - DNA, 20 bp, Artificial Sequence
  Artificially Synthesized Primer Sequence
aaatagtcctgtggcggatg

SEQ ID NO: 13266 - DNA, 20 bp, Artificial Sequence
  Artificially Synthesized Primer Sequence
ctgcaggaactcttcccttg

SEQ ID NO: 13267 - DNA, 20 bp, Artificial Sequence
  Artificially Synthesized Primer Sequence
gcggtgctttgctctttcta

SEQ ID NO: 13268 - DNA, 19 bp, Artificial Sequence
  Artificially Synthesized Primer Sequence
ctgcagctgtttgccaagt

SEQ ID NO: 13269 - DNA, 20 bp, Artificial Sequence
  Artificially Synthesized Primer Sequence
atcttcttccgagccactca

SEQ ID NO: 13270 - DNA, 20 bp, Artificial Sequence
  Artificially Synthesized Primer Sequence
aattaacgtcacgcgtttcc

SEQ ID NO: 13271 - DNA, 21 bp, Artificial Sequence
  Artificially Synthesized Primer Sequence
gctgctacacttgcataggga

SEQ ID NO: 13272 - DNA, 20 bp, Artificial Sequence
  Artificially Synthesized Primer Sequence
acatcgccggagaactagaa

SEQ ID NO: 13273 - DNA, 20 bp, Artificial Sequence
  Artificially Synthesized Primer Sequence
cgagtacgaagaggaggacg

SEQ ID NO: 13274 - DNA, 20 bp, Artificial Sequence
  Artificially Synthesized Primer Sequence
ggtggatgaccactcgtacc

SEQ ID NO: 13275 - DNA, 20 bp, Artificial Sequence
  Artificially Synthesized Primer Sequence
acccgacctgtgtaagctgt

SEQ ID NO: 13276 - DNA, 20 bp, Artificial Sequence
  Artificially Synthesized Primer Sequence
tctgctgaggacagggaact

SEQ ID NO: 13277 - DNA, 20 bp, Artificial Sequence
  Artificially Synthesized Primer Sequence
catgagccgtatgaacatgg

SEQ ID NO: 13278 - DNA, 20 bp, Artificial Sequence
  Artificially Synthesized Primer Sequence
tctgcgacgctgcaatatac

SEQ ID NO: 13279 - DNA, 20 bp, Artificial Sequence
  Artificially Synthesized Primer Sequence
cgacatacacggtccaaatg

SEQ ID NO: 13280 - DNA, 20 bp, Artificial Sequence
  Artificially Synthesized Primer Sequence
gtatattgcagcgtcgcaga

SEQ ID NO: 13281 - DNA, 20 bp, Artificial Sequence
  Artificially Synthesized Primer Sequence
ggctccaacggctactacaa

SEQ ID NO: 13282 - DNA, 20 bp, Artificial Sequence
  Artificially Synthesized Primer Sequence
gcgaggaagttgttggtgtt

SEQ ID NO: 13283 - DNA, 20 bp, Artificial Sequence
  Artificially Synthesized Primer Sequence
cgaccacaccatattttgga

SEQ ID NO: 13284 - DNA, 20 bp, Artificial Sequence
  Artificially Synthesized Primer Sequence
aggaaggtgccaaggttctc

SEQ ID NO: 13285 - DNA, 20 bp, Artificial Sequence
  Artificially Synthesized Primer Sequence
taatgtgtaccgggtgagca

SEQ ID NO: 13286 - DNA, 20 bp, Artificial Sequence
  Artificially Synthesized Primer Sequence
acatgtactatcggctcggc

SEQ ID NO: 13287 - DNA, 20 bp, Artificial Sequence
  Artificially Synthesized Primer Sequence
gccagcgtcttatcttttgg

SEQ ID NO: 13288 - DNA, 20 bp, Artificial Sequence
  Artificially Synthesized Primer Sequence
tcctgtacttggtgtcgctg

SEQ ID NO: 13289 - DNA, 20 bp, Artificial Sequence
  Artificially Synthesized Primer Sequence
ggcaatttacgctcttgctc

SEQ ID NO: 13290 - DNA, 20 bp, Artificial Sequence
  Artificially Synthesized Primer Sequence
agatgaggggagccgttatt

SEQ ID NO: 13291 - DNA, 20 bp, Artificial Sequence
  Artificially Synthesized Primer Sequence
ttaaccgggacagaatggaa

SEQ ID NO: 13292 - DNA, 20 bp, Artificial Sequence
  Artificially Synthesized Primer Sequence
ggcaatttacgctcttgctc

SEQ ID NO: 13293 - DNA, 20 bp, Artificial Sequence
  Artificially Synthesized Primer Sequence
tgttctcttggacgcaactg

SEQ ID NO: 13294 - DNA, 20 bp, Artificial Sequence
  Artificially Synthesized Primer Sequence
aacctcgaagctcacgtcat

SEQ ID NO: 13295 - DNA, 20 bp, Artificial Sequence
  Artificially Synthesized Primer Sequence
aacctcgaagctcacgtcat

SEQ ID NO: 13296 - DNA, 20 bp, Artificial Sequence
  Artificially Synthesized Primer Sequence
ggtcgcaatgattcaacctt

SEQ ID NO: 13297 - DNA, 20 bp, Artificial Sequence
  Artificially Synthesized Primer Sequence
cgtctcgtgaggtcagatca

SEQ ID NO: 13298 - DNA, 20 bp, Artificial Sequence
  Artificially Synthesized Primer Sequence
tgtatgagcagccatcttgc

SEQ ID NO: 13299 - DNA, 20 bp, Artificial Sequence
  Artificially Synthesized Primer Sequence
tgcacaagaacagtgcatca

SEQ ID NO: 13300 - DNA, 20 bp, Artificial Sequence
  Artificially Synthesized Primer Sequence
ttgaggagcttctggcattt

SEQ ID NO: 13301 - DNA, 20 bp, Artificial Sequence
  Artificially Synthesized Primer Sequence
cggtggatgcggtagagtat

SEQ ID NO: 13302 - DNA, 20 bp, Artificial Sequence
  Artificially Synthesized Primer Sequence
ttgggtcctaaaaacgcttg

SEQ ID NO: 13303 - DNA, 20 bp, Artificial Sequence
  Artificially Synthesized Primer Sequence
catttcctgcgtcatccttt

SEQ ID NO: 13304 - DNA, 20 bp, Artificial Sequence
  Artificially Synthesized Primer Sequence
gctggatttttcctggttca

SEQ ID NO: 13305 - DNA, 20 bp, Artificial Sequence
  Artificially Synthesized Primer Sequence
tgcactggagaatgagatgc

SEQ ID NO: 13306 - DNA, 20 bp, Artificial Sequence
  Artificially Synthesized Primer Sequence
aaatggatcatgcgaaggtc

SEQ ID NO: 13307 - DNA, 20 bp, Artificial Sequence
  Artificially Synthesized Primer Sequence
aaatggatcatgcgaaggtc

SEQ ID NO: 13308 - DNA, 20 bp, Artificial Sequence
  Artificially Synthesized Primer Sequence
tcaaggaaatgcttgaggct

SEQ ID NO: 13309 - DNA, 20 bp, Artificial Sequence
  Artificially Synthesized Primer Sequence
ttcagacacgcactcaaagg

SEQ ID NO: 13310 - DNA, 20 bp, Artificial Sequence
  Artificially Synthesized Primer Sequence
tcggaagaggcaagtcaagt

SEQ ID NO: 13311 - DNA, 20 bp, Artificial Sequence
  Artificially Synthesized Primer Sequence
gggcgttgaccttatcagaa

SEQ ID NO: 13312 - DNA, 20 bp, Artificial Sequence
  Artificially Synthesized Primer Sequence
gcttatgaacgcgtgtagca

SEQ ID NO: 13313 - DNA, 20 bp, Artificial Sequence
  Artificially Synthesized Primer Sequence
agcaaatctggacggaggta

SEQ ID NO: 13314 - DNA, 20 bp, Artificial Sequence
  Artificially Synthesized Primer Sequence
acagcttgtgctcccctaga

SEQ ID NO: 13315 - DNA, 20 bp, Artificial Sequence
  Artificially Synthesized Primer Sequence
aaagtcaaccaacccagtgc

SEQ ID NO: 13316 - DNA, 20 bp, Artificial Sequence
  Artificially Synthesized Primer Sequence
cgggatcagaagaaattgga

SEQ ID NO: 13317 - DNA, 10 bp, Artificial Sequence
  Artificially Synthesized Primer Sequence
  MISC_FEATURE (1)..(10): n stands for any base
nnnnnnnnnn

SEQ ID NO: 13318 - DNA, 10 bp, Artificial Sequence
  Artificially Synthesized Primer Sequence
  MISC_FEATURE (1)..(10): n stands for any base
nnnnnnnnnn

SEQ ID NO: 13319 - DNA, 20 bp, Artificial Sequence
  Artificially Synthesized Primer Sequence
gaaccaggccttcatcagag

SEQ ID NO: 13320 - DNA, 20 bp, Artificial Sequence
  Artificially Synthesized Primer Sequence
tccaccatcatcgtcgagta

SEQ ID NO: 13321 - DNA, 20 bp, Artificial Sequence
  Artificially Synthesized Primer Sequence
gttcatggtggttgcttgtg

SEQ ID NO: 13322 - DNA, 20 bp, Artificial Sequence
  Artificially Synthesized Primer Sequence
aaggaagtagggggcaaaga

SEQ ID NO: 13323 - DNA, 20 bp, Artificial Sequence
  Artificially Synthesized Primer Sequence
cgcatagcaactggattgaa

SEQ ID NO: 13324 - DNA, 20 bp, Artificial Sequence
  Artificially Synthesized Primer Sequence
ctgggtctcacttgggaaga

SEQ ID NO: 13325 - DNA, 20 bp, Artificial Sequence
  Artificially Synthesized Primer Sequence
atccccacttatgatggcaa

SEQ ID NO: 13326 - DNA, 20 bp, Artificial Sequence
  Artificially Synthesized Primer Sequence
ggctccggaaagaatgtgta

SEQ ID NO: 13327 - DNA, 20 bp, Artificial Sequence
  Artificially Synthesized Primer Sequence
cccctactcgtgcgtgtatt

SEQ ID NO: 13328 - DNA, 20 bp, Artificial Sequence
  Artificially Synthesized Primer Sequence
ccgatttctcctcctctgtg

SEQ ID NO: 13329 - DNA, 20 bp, Artificial Sequence
  Artificially Synthesized Primer Sequence
agcctcgacaccagcactat

SEQ ID NO: 13330 - DNA, 20 bp, Artificial Sequence
  Artificially Synthesized Primer Sequence
gtaaggcgaaaatctcagcg

SEQ ID NO: 13331 - DNA, 20 bp, Artificial Sequence
  Artificially Synthesized Primer Sequence
gtaaggcgaaaatctcagcg

SEQ ID NO: 13332 - DNA, 20 bp, Artificial Sequence
  Artificially Synthesized Primer Sequence
agcctcgacaccagcactat

SEQ ID NO: 13333 - DNA, 20 bp, Artificial Sequence
  Artificially Synthesized Primer Sequence
tagggatcttttgcccacac

SEQ ID NO: 13334 - DNA, 20 bp, Artificial Sequence
  Artificially Synthesized Primer Sequence
gatcctgtgcccctgagata

SEQ ID NO: 13335 - DNA, 20 bp, Artificial Sequence
  Artificially Synthesized Primer Sequence
tacatgggggagaaacttcg

SEQ ID NO: 13336 - DNA, 20 bp, Artificial Sequence
  Artificially Synthesized Primer Sequence
gctgtcaaaagacctaccgc

SEQ ID NO: 13337 - DNA, 20 bp, Artificial Sequence
  Artificially Synthesized Primer Sequence
tccggtataggctgtggaac

SEQ ID NO: 13338 - DNA, 20 bp, Artificial Sequence
  Artificially Synthesized Primer Sequence
gagaagagcaatggaggtgc

SEQ ID NO: 13339 - DNA, 20 bp, Artificial Sequence
  Artificially Synthesized Primer Sequence
gttctcagatgcaggcatga

SEQ ID NO: 13340 - DNA, 20 bp, Artificial Sequence
  Artificially Synthesized Primer Sequence
ttgctgtttgattcacgagc

SEQ ID NO: 13341 - DNA, 20 bp, Artificial Sequence
  Artificially Synthesized Primer Sequence
gagaacaaggagcttggtgc

SEQ ID NO: 13342 - DNA, 20 bp, Artificial Sequence
  Artificially Synthesized Primer Sequence
ccatgtaaaaatggggaacg

SEQ ID NO: 13343 - DNA, 20 bp, Artificial Sequence
  Artificially Synthesized Primer Sequence
tcgttgacattggtctcagc

SEQ ID NO: 13344 - DNA, 20 bp, Artificial Sequence
  Artificially Synthesized Primer Sequence
gtctggcaagtttggttggt

SEQ ID NO: 13345 - DNA, 20 bp, Artificial Sequence
  Artificially Synthesized Primer Sequence
gaccttcaagaggttctgcg

SEQ ID NO: 13346 - DNA, 20 bp, Artificial Sequence
  Artificially Synthesized Primer Sequence
cttggatgcctctctcttgg

SEQ ID NO: 13347 - DNA, 20 bp, Artificial Sequence
  Artificially Synthesized Primer Sequence
ccggttcaacgaaatgaatc

SEQ ID NO: 13348 - DNA, 20 bp, Artificial Sequence
  Artificially Synthesized Primer Sequence
aaaccatccattcaagcagg

SEQ ID NO: 13349 - DNA, 20 bp, Artificial Sequence
  Artificially Synthesized Primer Sequence
aggtcttgatccgtacaccg

SEQ ID NO: 13350 - DNA, 20 bp, Artificial Sequence
  Artificially Synthesized Primer Sequence
cagcatgaggtcaaagtgga

SEQ ID NO: 13351 - DNA, 20 bp, Artificial Sequence
  Artificially Synthesized Primer Sequence
tacaaattcgggaggagtgg

SEQ ID NO: 13352 - DNA, 20 bp, Artificial Sequence
  Artificially Synthesized Primer Sequence
gctcatggagaagatggagg

SEQ ID NO: 13353 - DNA, 20 bp, Artificial Sequence
  Artificially Synthesized Primer Sequence
tctaccggtcctttcgattg

SEQ ID NO: 13354 - DNA, 20 bp, Artificial Sequence
  Artificially Synthesized Primer Sequence
ctcgtcaaacagcaactcca

SEQ ID NO: 13355 - DNA, 21 bp, Artificial Sequence
  Artificially Synthesized Primer Sequence
ggtgtgctcgcattaaggtaa

SEQ ID NO: 13356 - DNA, 21 bp, Artificial Sequence
  Artificially Synthesized Primer Sequence
agaagagaagagagaagcccg

SEQ ID NO: 13357 - DNA, 20 bp, Artificial Sequence
  Artificially Synthesized Primer Sequence
aatgaccttgttgccagacc

SEQ ID NO: 13358 - DNA, 20 bp, Artificial Sequence
  Artificially Synthesized Primer Sequence
atcgattcgagaaatgggtg

SEQ ID NO: 13359 - DNA, 20 bp, Artificial Sequence
  Artificially Synthesized Primer Sequence
tgtcagagcaacaaccttcg

SEQ ID NO: 13360 - DNA, 20 bp, Artificial Sequence
  Artificially Synthesized Primer Sequence
gaccttgttgccagaccatt

SEQ ID NO: 13361 - DNA, 20 bp, Artificial Sequence
  Artificially Synthesized Primer Sequence
gcttgagttcaaggctgtcc

SEQ ID NO: 13362 - DNA, 20 bp, Artificial Sequence
  Artificially Synthesized Primer Sequence
tcgtcagctcatcaccactc

SEQ ID NO: 13363 - DNA, 20 bp, Artificial Sequence
  Artificially Synthesized Primer Sequence
aaccgaactgttccacgagt

SEQ ID NO: 13364 - DNA, 20 bp, Artificial Sequence
  Artificially Synthesized Primer Sequence
gtgaaggacctggtgatgct

SEQ ID NO: 13365 - DNA, 20 bp, Artificial Sequence
  Artificially Synthesized Primer Sequence
gacttggaatgcagatccgt

SEQ ID NO: 13366 - DNA, 20 bp, Artificial Sequence
  Artificially Synthesized Primer Sequence
taacatcccacctttcaggc

SEQ ID NO: 13367 - DNA, 20 bp, Artificial Sequence
  Artificially Synthesized Primer Sequence
aagtgctgtttggaattggg

SEQ ID NO: 13368 - DNA, 20 bp, Artificial Sequence
  Artificially Synthesized Primer Sequence
ttccagagaaggcaccattt

SEQ ID NO: 13369 - DNA, 20 bp, Artificial Sequence
  Artificially Synthesized Primer Sequence
atgtcttcacactccgtccc

SEQ ID NO: 13370 - DNA, 20 bp, Artificial Sequence
  Artificially Synthesized Primer Sequence
ccattgttgctttggttcct

SEQ ID NO: 13371 - DNA, 20 bp, Artificial Sequence
  Artificially Synthesized Primer Sequence
tttcggccaaggttaatcag

SEQ ID NO: 13372 - DNA, 20 bp, Artificial Sequence
  Artificially Synthesized Primer Sequence
tgaggataaggccatggaag

SEQ ID NO: 13373 - DNA, 20 bp, Artificial Sequence
  Artificially Synthesized Primer Sequence
ctgttggcctactggctctc

SEQ ID NO: 13374 - DNA, 20 bp, Artificial Sequence
  Artificially Synthesized Primer Sequence
gcaagagcctccatgaactc

SEQ ID NO: 13375 - DNA, 20 bp, Artificial Sequence
  Artificially Synthesized Primer Sequence
gttccgcgagtaccacaaat

SEQ ID NO: 13376 - DNA, 20 bp, Artificial Sequence
  Artificially Synthesized Primer Sequence
attgatgaggacgatgaggc

SEQ ID NO: 13377 - DNA, 20 bp, Artificial Sequence
  Artificially Synthesized Primer Sequence
caaccgatgagtcccagttt

SEQ ID NO: 13378 - DNA, 20 bp, Artificial Sequence
  Artificially Synthesized Primer Sequence
ctccatgttgtcctcgtcct

SEQ ID NO: 13379 - DNA, 20 bp, Artificial Sequence
  Artificially Synthesized Primer Sequence
cgattactcaacgccctgat

SEQ ID NO: 13380 - DNA, 20 bp, Artificial Sequence
  Artificially Synthesized Primer Sequence
acagctttggcgttgttctt

SEQ ID NO: 13381 - DNA, 20 bp, Artificial Sequence
  Artificially Synthesized Primer Sequence
ggggagctgtcccttatctc

SEQ ID NO: 13382 - DNA, 20 bp, Artificial Sequence
  Artificially Synthesized Primer Sequence
caggtgctctcttgtcctcc

SEQ ID NO: 13383 - DNA, 20 bp, Artificial Sequence
  Artificially Synthesized Primer Sequence
aagcattcccgaagcagtaa

SEQ ID NO: 13384 - DNA, 20 bp, Artificial Sequence
  Artificially Synthesized Primer Sequence
acccagatcaaaatgttcgc

SEQ ID NO: 13385 - DNA, 20 bp, Artificial Sequence
  Artificially Synthesized Primer Sequence
catcgccactagttgcttca

SEQ ID NO: 13386 - DNA, 20 bp, Artificial Sequence
  Artificially Synthesized Primer Sequence
ccttaggtccatttgctcca

SEQ ID NO: 13387 - DNA, 20 bp, Artificial Sequence
  Artificially Synthesized Primer Sequence
caacatttgcatttgcatcc

SEQ ID NO: 13388 - DNA, 20 bp, Artificial Sequence
  Artificially Synthesized Primer Sequence
ctgctggcaatcatgaagag

SEQ ID NO: 13389 - DNA, 20 bp, Artificial Sequence
  Artificially Synthesized Primer Sequence
gaagactgagcacaaagccc

SEQ ID NO: 13390 - DNA, 20 bp, Artificial Sequence
  Artificially Synthesized Primer Sequence
cttccacttggccacgtaat

SEQ ID NO: 13391 - DNA, 20 bp, Artificial Sequence
  Artificially Synthesized Primer Sequence
cgcaacagcaacactgaaat

SEQ ID NO: 13392 - DNA, 20 bp, Artificial Sequence
  Artificially Synthesized Primer Sequence
attacgtggccaagtggaag

SEQ ID NO: 13393 - DNA, 20 bp, Artificial Sequence
  Artificially Synthesized Primer Sequence
tcgagatcaaccccaaagac

SEQ ID NO: 13394 - DNA, 20 bp, Artificial Sequence
  Artificially Synthesized Primer Sequence
ccatgtcacgtatgctgtcc

SEQ ID NO: 13395 - DNA, 20 bp, Artificial Sequence
  Artificially Synthesized Primer Sequence
tgtgatcgtctccctcagtg

SEQ ID NO: 13396 - DNA, 20 bp, Artificial Sequence
  Artificially Synthesized Primer Sequence
ggcgtggtaactctgaatcc

SEQ ID NO: 13397 - DNA, 20 bp, Artificial Sequence
  Artificially Synthesized Primer Sequence
ccggcggttactttcattta

SEQ ID NO: 13398 - DNA, 20 bp, Artificial Sequence
  Artificially Synthesized Primer Sequence
gagacaacactgaggtgcga

SEQ ID NO: 13399 - DNA, 20 bp, Artificial Sequence
  Artificially Synthesized Primer Sequence
catcttgccatcctcgtgta

SEQ ID NO: 13400 - DNA, 20 bp, Artificial Sequence
  Artificially Synthesized Primer Sequence
gcagcaagaaaaaggacgac

SEQ ID NO: 13401 - DNA, 20 bp, Artificial Sequence
  Artificially Synthesized Primer Sequence
ggtcagggaaacccatacct

SEQ ID NO: 13402 - DNA, 20 bp, Artificial Sequence
  Artificially Synthesized Primer Sequence
taatggccacagccatgata

SEQ ID NO: 13403 - DNA, 21 bp, Artificial Sequence
  Artificially Synthesized Primer Sequence
ggagtatttggcaagcacaga

SEQ ID NO: 13404 - DNA, 21 bp, Artificial Sequence
  Artificially Synthesized Primer Sequence
agacggacagagactgaatgg

SEQ ID NO: 13405 - DNA, 20 bp, Artificial Sequence
  Artificially Synthesized Primer Sequence
tctgggtaaacccaaagacg

SEQ ID NO: 13406 - DNA, 20 bp, Artificial Sequence
  Artificially Synthesized Primer Sequence
atgtgccacagcatgtcatt

SEQ ID NO: 13407 - DNA, 20 bp, Artificial Sequence
  Artificially Synthesized Primer Sequence
actgccgctcttgactcatt

SEQ ID NO: 13408 - DNA, 20 bp, Artificial Sequence
  Artificially Synthesized Primer Sequence
gcacatagtcgatgtccgtg

SEQ ID NO: 13409 - DNA, 20 bp, Artificial Sequence
  Artificially Synthesized Primer Sequence
ttggttgatggtgcaaaaga

SEQ ID NO: 13410 - DNA, 20 bp, Artificial Sequence
  Artificially Synthesized Primer Sequence
acggaaggggaggtaagaaa

SEQ ID NO: 13411 - DNA, 20 bp, Artificial Sequence
  Artificially Synthesized Primer Sequence
atagcgaacaaagcggacac

SEQ ID NO: 13412 - DNA, 20 bp, Artificial Sequence
  Artificially Synthesized Primer Sequence
tggttggtcggtcgtttact

SEQ ID NO: 13413 - DNA, 20 bp, Artificial Sequence
  Artificially Synthesized Primer Sequence
tagctgatccgaggggtatg

SEQ ID NO: 13414 - DNA, 20 bp, Artificial Sequence
  Artificially Synthesized Primer Sequence
gggtttggatacccccatag

SEQ ID NO: 13415 - DNA, 21 bp, Artificial Sequence
  Artificially Synthesized Primer Sequence
tgttcagttcgaatcctcctc

SEQ ID NO: 13416 - DNA, 20 bp, Artificial Sequence
  Artificially Synthesized Primer Sequence
cgtcaggctagcaccatctt

SEQ ID NO: 13417 - DNA, 20 bp, Artificial Sequence
  Artificially Synthesized Primer Sequence
atctgcatgttccaggaagg

SEQ ID NO: 13418 - DNA, 20 bp, Artificial Sequence
  Artificially Synthesized Primer Sequence
aaaaatcaaccgcactgtcc

SEQ ID NO: 13419 - DNA, 20 bp, Artificial Sequence
  Artificially Synthesized Primer Sequence
gacagtagttcaggcggcat

SEQ ID NO: 13420 - DNA, 20 bp, Artificial Sequence
  Artificially Synthesized Primer Sequence
agagaagaaacccagcacca

SEQ ID NO: 13421 - DNA, 20 bp, Artificial Sequence
  Artificially Synthesized Primer Sequence
atgggattctgctggaagtg

SEQ ID NO: 13422 - DNA, 20 bp, Artificial Sequence
  Artificially Synthesized Primer Sequence
accgtaaaggcaagatggtg

SEQ ID NO: 13423 - DNA, 20 bp, Artificial Sequence
  Artificially Synthesized Primer Sequence
ttacaggtgatgggatgggt

SEQ ID NO: 13424 - DNA, 20 bp, Artificial Sequence
  Artificially Synthesized Primer Sequence
accgtcacaagagcagaggt

SEQ ID NO: 13425 - DNA, 20 bp, Artificial Sequence
  Artificially Synthesized Primer Sequence
gcctactggacgaagcaaac

SEQ ID NO: 13426 - DNA, 20 bp, Artificial Sequence
  Artificially Synthesized Primer Sequence
gaaaacgtatgactggcgct

SEQ ID NO: 13427 - DNA, 20 bp, Artificial Sequence
  Artificially Synthesized Primer Sequence
ttttgtgtcggttcagatgc

SEQ ID NO: 13428 - DNA, 20 bp, Artificial Sequence
  Artificially Synthesized Primer Sequence
cctccaagaacaagaaagcg

SEQ ID NO: 13429 - DNA, 20 bp, Artificial Sequence
  Artificially Synthesized Primer Sequence
gaacaacttccaccgcattt

SEQ ID NO: 13430 - DNA, 20 bp, Artificial Sequence
  Artificially Synthesized Primer Sequence
tcaaccgcagttacatcgag

SEQ ID NO: 13431 - DNA, 20 bp, Artificial Sequence
  Artificially Synthesized Primer Sequence
tcagtgtgtctccgcttgtc

SEQ ID NO: 13432 - DNA, 20 bp, Artificial Sequence
  Artificially Synthesized Primer Sequence
ggaaatgggtcggtaggaat

SEQ ID NO: 13433 - DNA, 20 bp, Artificial Sequence
  Artificially Synthesized Primer Sequence
gcagcctatcaaggtcttcg

SEQ ID NO: 13434 - DNA, 20 bp, Artificial Sequence
  Artificially Synthesized Primer Sequence
ttttccagaaaaacaacggg

SEQ ID NO: 13435 - DNA, 20 bp, Artificial Sequence
  Artificially Synthesized Primer Sequence
gctgcgtgcgtaataattca

SEQ ID NO: 13436 - DNA, 20 bp, Artificial Sequence
  Artificially Synthesized Primer Sequence
aggattgctggagctgatgt

SEQ ID NO: 13437 - DNA, 20 bp, Artificial Sequence
  Artificially Synthesized Primer Sequence
ctctggtcgaagcagaaacc

SEQ ID NO: 13438 - DNA, 20 bp, Artificial Sequence
  Artificially Synthesized Primer Sequence
tcacaagttgccaagagcac

SEQ ID NO: 13439 - DNA, 20 bp, Artificial Sequence
  Artificially Synthesized Primer Sequence
aaaacaatacagccgagcgt

SEQ ID NO: 13440 - DNA, 20 bp, Artificial Sequence
  Artificially Synthesized Primer Sequence
tggaggatgttttccctctg

SEQ ID NO: 13441 - DNA, 20 bp, Artificial Sequence
  Artificially Synthesized Primer Sequence
gatctaggcgatgcaaaagc

SEQ ID NO: 13442 - DNA, 20 bp, Artificial Sequence
  Artificially Synthesized Primer Sequence
ttttcttggccttgccatac

SEQ ID NO: 13443 - DNA, 20 bp, Artificial Sequence
  Artificially Synthesized Primer Sequence
atcgacccgagtctgcatag

SEQ ID NO: 13444 - DNA, 20 bp, Artificial Sequence
  Artificially Synthesized Primer Sequence
tcgacgcagcactaggaata

SEQ ID NO: 13445 - DNA, 20 bp, Artificial Sequence
  Artificially Synthesized Primer Sequence
tagaatcagggcaagggatg

SEQ ID NO: 13446 - DNA, 20 bp, Artificial Sequence
  Artificially Synthesized Primer Sequence
acagcagggagctatcctca

SEQ ID NO: 13447 - DNA, 20 bp, Artificial Sequence
  Artificially Synthesized Primer Sequence
ctagaatggcaatttcccga

SEQ ID NO: 13448 - DNA, 20 bp, Artificial Sequence
  Artificially Synthesized Primer Sequence
accactcaatcggagtaccg

SEQ ID NO: 13449 - DNA, 20 bp, Artificial Sequence
  Artificially Synthesized Primer Sequence
tggttttggtctttccgaag

SEQ ID NO: 13450 - DNA, 20 bp, Artificial Sequence
  Artificially Synthesized Primer Sequence
tcgaaagacgtggttatccc

SEQ ID NO: 13451 - DNA, 20 bp, Artificial Sequence
  Artificially Synthesized Primer Sequence
cacgacgacggtatttcctt

SEQ ID NO: 13452 - DNA, 20 bp, Artificial Sequence
  Artificially Synthesized Primer Sequence
atttcagatgacgtggtccc

SEQ ID NO: 13453 - DNA, 20 bp, Artificial Sequence
  Artificially Synthesized Primer Sequence
agtgggtgagaaacaatgcc

SEQ ID NO: 13454 - DNA, 20 bp, Artificial Sequence
  Artificially Synthesized Primer Sequence
ggttgttgctatgatgggct

SEQ ID NO: 13455 - DNA, 20 bp, Artificial Sequence
  Artificially Synthesized Primer Sequence
ccacgagaacaacatagggc

SEQ ID NO: 13456 - DNA, 20 bp, Artificial Sequence
  Artificially Synthesized Primer Sequence
tcctggtggtaacatgcaga

SEQ ID NO: 13457 - DNA, 20 bp, Artificial Sequence
  Artificially Synthesized Primer Sequence
ttcgtcgagcactactaccg

SEQ ID NO: 13458 - DNA, 20 bp, Artificial Sequence
  Artificially Synthesized Primer Sequence
tcaagtggaacatctgcgag

SEQ ID NO: 13459 - DNA, 20 bp, Artificial Sequence
  Artificially Synthesized Primer Sequence
ggacgcacgacctcttgtat

SEQ ID NO: 13460 - DNA, 20 bp, Artificial Sequence
  Artificially Synthesized Primer Sequence
cggcatgctagtcttcgtct

SEQ ID NO: 13461 - DNA, 20 bp, Artificial Sequence
  Artificially Synthesized Primer Sequence
cgtaaatggtcaggaggcat

SEQ ID NO: 13462 - DNA, 20 bp, Artificial Sequence
  Artificially Synthesized Primer Sequence
cgagatccgtaggtgggtaa

SEQ ID NO: 13463 - DNA, 20 bp, Artificial Sequence
  Artificially Synthesized Primer Sequence
tgcgaatgggaaaactaacc

SEQ ID NO: 13464 - DNA, 20 bp, Artificial Sequence
  Artificially Synthesized Primer Sequence
gacagacgctagggacttcg

SEQ ID NO: 13465 - DNA, 20 bp, Artificial Sequence
  Artificially Synthesized Primer Sequence
ggctgatccctctggtgata

SEQ ID NO: 13466 - DNA, 20 bp, Artificial Sequence
  Artificially Synthesized Primer Sequence
caatcatcctcccaggctta

SEQ ID NO: 13467 - DNA, 20 bp, Artificial Sequence
  Artificially Synthesized Primer Sequence
atcctactgcccaagcaaaa

SEQ ID NO: 13468 - DNA, 20 bp, Artificial Sequence
  Artificially Synthesized Primer Sequence
caggattacatcgaggcgac

SEQ ID NO: 13469 - DNA, 20 bp, Artificial Sequence
  Artificially Synthesized Primer Sequence
ttcaaaatcagaggggttgg

SEQ ID NO: 13470 - DNA, 20 bp, Artificial Sequence
  Artificially Synthesized Primer Sequence
cgctcttcaagctgctcttt

SEQ ID NO: 13471 - DNA, 20 bp, Artificial Sequence
  Artificially Synthesized Primer Sequence
gctcccacagcaaatagctc

SEQ ID NO: 13472 - DNA, 20 bp, Artificial Sequence
  Artificially Synthesized Primer Sequence
taagaacaagaacaccccgc

SEQ ID NO: 13473 - DNA, 20 bp, Artificial Sequence
  Artificially Synthesized Primer Sequence
gatagagcgtggtggtccat

SEQ ID NO: 13474 - DNA, 20 bp, Artificial Sequence
  Artificially Synthesized Primer Sequence
ttatccagtgcgtcaactgc

SEQ ID NO: 13475 - DNA, 20 bp, Artificial Sequence
  Artificially Synthesized Primer Sequence
aacaggcgagagctaccaaa

SEQ ID NO: 13476 - DNA, 20 bp, Artificial Sequence
  Artificially Synthesized Primer Sequence
agatggtggagcaaacaagg

SEQ ID NO: 13477 - DNA, 20 bp, Artificial Sequence
  Artificially Synthesized Primer Sequence
gacgcttccctttcatggta

SEQ ID NO: 13478 - DNA, 20 bp, Artificial Sequence
  Artificially Synthesized Primer Sequence
tttttctttggggtcccttc

SEQ ID NO: 13479 - DNA, 20 bp, Artificial Sequence
  Artificially Synthesized Primer Sequence
ctgaggtaaatggcaaggga

SEQ ID NO: 13480 - DNA, 20 bp, Artificial Sequence
  Artificially Synthesized Primer Sequence
aggagtggctcgagaagatg

SEQ ID NO: 13481 - DNA, 20 bp, Artificial Sequence
  Artificially Synthesized Primer Sequence
aggtgctcgagcttcattgt

SEQ ID NO: 13482 - DNA, 20 bp, Artificial Sequence
  Artificially Synthesized Primer Sequence
caacatggcccttcttcatt

SEQ ID NO: 13483 - DNA, 20 bp, Artificial Sequence
  Artificially Synthesized Primer Sequence
gcttcagatctccaacaggc

SEQ ID NO: 13484 - DNA, 20 bp, Artificial Sequence
  Artificially Synthesized Primer Sequence
tcctaggttggttgaggctg

SEQ ID NO: 13485 - DNA, 20 bp, Artificial Sequence
  Artificially Synthesized Primer Sequence
tgcaactgcaaacccatcta

SEQ ID NO: 13486 - DNA, 20 bp, Artificial Sequence
  Artificially Synthesized Primer Sequence
ttgcaacatattcgagcagg

SEQ ID NO: 13487 - DNA, 20 bp, Artificial Sequence
  Artificially Synthesized Primer Sequence
cagatggcaggcaatacaga

SEQ ID NO: 13488 - DNA, 20 bp, Artificial Sequence
  Artificially Synthesized Primer Sequence
atagcttaactgccgccgta

SEQ ID NO: 13489 - DNA, 20 bp, Artificial Sequence
  Artificially Synthesized Primer Sequence
aggaagaggagaaagggctg

SEQ ID NO: 13490 - DNA, 20 bp, Artificial Sequence
  Artificially Synthesized Primer Sequence
acgttgtaccacctcaaggc

SEQ ID NO: 13491 - DNA, 20 bp, Artificial Sequence
  Artificially Synthesized Primer Sequence
tgagatggaccccaaagtgt

SEQ ID NO: 13492 - DNA, 20 bp, Artificial Sequence
  Artificially Synthesized Primer Sequence
ccatcaatcgcttccagatt

SEQ ID NO: 13493 - DNA, 20 bp, Artificial Sequence
  Artificially Synthesized Primer Sequence
ggaaagctttttgaggggac

SEQ ID NO: 13494 - DNA, 20 bp, Artificial Sequence
  Artificially Synthesized Primer Sequence
acatttccttccatgcgttc

SEQ ID NO: 13495 - DNA, 20 bp, Artificial Sequence
  Artificially Synthesized Primer Sequence
acatttccttccatgcgttc

SEQ ID NO: 13496 - DNA, 20 bp, Artificial Sequence
  Artificially Synthesized Primer Sequence
ggaaagctttttgaggggac

SEQ ID NO: 13497 - DNA, 20 bp, Artificial Sequence
  Artificially Synthesized Primer Sequence
agcatcctttgagccagtgt

SEQ ID NO: 13498 - DNA, 20 bp, Artificial Sequence
  Artificially Synthesized Primer Sequence
aagagcggagaaaaagggag

SEQ ID NO: 13499 - DNA, 20 bp, Artificial Sequence
  Artificially Synthesized Primer Sequence
aacactggctcaaaggatgc

SEQ ID NO: 13500 - DNA, 20 bp, Artificial Sequence
  Artificially Synthesized Primer Sequence
cttccacatcgtagccaagc

SEQ ID NO: 13501 - DNA, 20 bp, Artificial Sequence
  Artificially Synthesized Primer Sequence
gggagaattgaaggcatgaa

SEQ ID NO: 13502 - DNA, 20 bp, Artificial Sequence
  Artificially Synthesized Primer Sequence
ccaggaagtgcttggagaag

SEQ ID NO: 13503 - DNA, 20 bp, Artificial Sequence
  Artificially Synthesized Primer Sequence
gtacagcagtgcacaaggga

SEQ ID NO: 13504 - DNA, 20 bp, Artificial Sequence
  Artificially Synthesized Primer Sequence
agcacttcctggcaccatac

SEQ ID NO: 13505 - DNA, 20 bp, Artificial Sequence
  Artificially Synthesized Primer Sequence
cagtgagtcccttgctcctc

SEQ ID NO: 13506 - DNA, 20 bp, Artificial Sequence
  Artificially Synthesized Primer Sequence
ctggactgcctctccatctc

SEQ ID NO: 13507 - DNA, 20 bp, Artificial Sequence
  Artificially Synthesized Primer Sequence
aaacacgggccaataaacaa

SEQ ID NO: 13508 - DNA, 20 bp, Artificial Sequence
  Artificially Synthesized Primer Sequence
tgatggtgccaaatcagatg

SEQ ID NO: 13509 - DNA, 20 bp, Artificial Sequence
  Artificially Synthesized Primer Sequence
ctgccaaagaatcaacagca

SEQ ID NO: 13510 - DNA, 20 bp, Artificial Sequence
  Artificially Synthesized Primer Sequence
tctcaacaatgcccaacaaa

SEQ ID NO: 13511 - DNA, 20 bp, Artificial Sequence
  Artificially Synthesized Primer Sequence
ctgccaaagaatcaacagca

SEQ ID NO: 13512 - DNA, 20 bp, Artificial Sequence
  Artificially Synthesized Primer Sequence
tatcgcgcctctcattatcc

SEQ ID NO: 13513 - DNA, 20 bp, Artificial Sequence
  Artificially Synthesized Primer Sequence
gatcgggaacatttccactg

SEQ ID NO: 13514 - DNA, 20 bp, Artificial Sequence
  Artificially Synthesized Primer Sequence
cttttgatcaacggggttgt

SEQ ID NO: 13515 - DNA, 20 bp, Artificial Sequence
  Artificially Synthesized Primer Sequence
tcatcgcacttgcgagttta

SEQ ID NO: 13516 - DNA, 20 bp, Artificial Sequence
  Artificially Synthesized Primer Sequence
gatcgggaacatttccactg

SEQ ID NO: 13517 - DNA, 20 bp, Artificial Sequence
  Artificially Synthesized Primer Sequence
tcgttcgccatcattttgta

SEQ ID NO: 13518 - DNA, 20 bp, Artificial Sequence
  Artificially Synthesized Primer Sequence
aagccttgccaaaatagggt

SEQ ID NO: 13519 - DNA, 20 bp, Artificial Sequence
  Artificially Synthesized Primer Sequence
gcttgaaatgcaggatgctc

SEQ ID NO: 13520 - DNA, 18 bp, Artificial Sequence
  Artificially Synthesized Primer Sequence
ttcatggcacaatggacg

SEQ ID NO: 13521 - DNA, 20 bp, Artificial Sequence
  Artificially Synthesized Primer Sequence
gtgcttgaaaagggggtaca

SEQ ID NO: 13522 - DNA, 20 bp, Artificial Sequence
  Artificially Synthesized Primer Sequence
gggctgccattatttctcaa

SEQ ID NO: 13523 - DNA, 20 bp, Artificial Sequence
  Artificially Synthesized Primer Sequence
gtctcgaggttgtggggtta

SEQ ID NO: 13524 - DNA, 20 bp, Artificial Sequence
  Artificially Synthesized Primer Sequence
cggtggatgttggagacttt

SEQ ID NO: 13525 - DNA, 20 bp, Artificial Sequence
  Artificially Synthesized Primer Sequence
gccataggagacaggaacca

SEQ ID NO: 13526 - DNA, 20 bp, Artificial Sequence
  Artificially Synthesized Primer Sequence
aactccataggggaattggg

SEQ ID NO: 13527 - DNA, 20 bp, Artificial Sequence
  Artificially Synthesized Primer Sequence
aggtcatgcagctctgttcc

SEQ ID NO: 13528 - DNA, 20 bp, Artificial Sequence
  Artificially Synthesized Primer Sequence
tgcgggagacctacttcaac

SEQ ID NO: 13529 - DNA, 20 bp, Artificial Sequence
  Artificially Synthesized Primer Sequence
gtgtactgggggcctactga

SEQ ID NO: 13530 - DNA, 20 bp, Artificial Sequence
  Artificially Synthesized Primer Sequence
ctctacccacgtgaaggctc

SEQ ID NO: 13531 - DNA, 20 bp, Artificial Sequence
  Artificially Synthesized Primer Sequence
cttcctcctctggtgtgcat

SEQ ID NO: 13532 - DNA, 20 bp, Artificial Sequence
  Artificially Synthesized Primer Sequence
acggagtacgctcacaacct

SEQ ID NO: 13533 - DNA, 20 bp, Artificial Sequence
  Artificially Synthesized Primer Sequence
atcagagtgcccaacattcc

SEQ ID NO: 13534 - DNA, 20 bp, Artificial Sequence
  Artificially Synthesized Primer Sequence
atgtcgtagttgccaaaccc

SEQ ID NO: 13535 - DNA, 20 bp, Artificial Sequence
  Artificially Synthesized Primer Sequence
ttatccacaggtctgcacca

SEQ ID NO: 13536 - DNA, 20 bp, Artificial Sequence
  Artificially Synthesized Primer Sequence
gcacttgcttcaaaatgggt

SEQ ID NO: 13537 - DNA, 20 bp, Artificial Sequence
  Artificially Synthesized Primer Sequence
taccaggatgagctgctgtg

SEQ ID NO: 13538 - DNA, 20 bp, Artificial Sequence
  Artificially Synthesized Primer Sequence
ggtgcgacgaaagctaaaag

SEQ ID NO: 13539 - DNA, 20 bp, Artificial Sequence
  Artificially Synthesized Primer Sequence
agcgcaagctttcttcactc

SEQ ID NO: 13540 - DNA, 20 bp, Artificial Sequence
  Artificially Synthesized Primer Sequence
gtctagcccgaaccctaacc

SEQ ID NO: 13541 - DNA, 20 bp, Artificial Sequence
  Artificially Synthesized Primer Sequence
aagcttgctagtcggcatgt

SEQ ID NO: 13542 - DNA, 20 bp, Artificial Sequence
  Artificially Synthesized Primer Sequence
atccactccatgagtctggg

SEQ ID NO: 13543 - DNA, 20 bp, Artificial Sequence
  Artificially Synthesized Primer Sequence
gtttacttgtcgccagctcc

SEQ ID NO: 13544 - DNA, 20 bp, Artificial Sequence
  Artificially Synthesized Primer Sequence
tgcctgagttgtgatatggc

SEQ ID NO: 13545 - DNA, 20 bp, Artificial Sequence
  Artificially Synthesized Primer Sequence
ttttggtggcatgcgtataa

SEQ ID NO: 13546 - DNA, 20 bp, Artificial Sequence
  Artificially Synthesized Primer Sequence
gcacacgcgtttaattctga

SEQ ID NO: 13547 - DNA, 20 bp, Artificial Sequence
  Artificially Synthesized Primer Sequence
tatgcagcagctgatcaagg

SEQ ID NO: 13548 - DNA, 20 bp, Artificial Sequence
  Artificially Synthesized Primer Sequence
gctgccagctaggctgatac

SEQ ID NO: 13549 - DNA, 20 bp, Artificial Sequence
  Artificially Synthesized Primer Sequence
tgacttgctagaactccgca

SEQ ID NO: 13550 - DNA, 20 bp, Artificial Sequence
  Artificially Synthesized Primer Sequence
ctttgcttcagaaacggagg

SEQ ID NO: 13551 - DNA, 20 bp, Artificial Sequence
  Artificially Synthesized Primer Sequence
ttgcaggtactccgggtaat

SEQ ID NO: 13552 - DNA, 20 bp, Artificial Sequence
  Artificially Synthesized Primer Sequence
ttgtgcgatcggttcctact

SEQ ID NO: 13553 - DNA, 20 bp, Artificial Sequence
  Artificially Synthesized Primer Sequence
catcgaagcatacaggcaga

SEQ ID NO: 13554 - DNA, 20 bp, Artificial Sequence
  Artificially Synthesized Primer Sequence
gctgatgatggctgcataga

SEQ ID NO: 13555 - DNA, 20 bp, Artificial Sequence
  Artificially Synthesized Primer Sequence
caagtagcgccataacccat

SEQ ID NO: 13556 - DNA, 20 bp, Artificial Sequence
  Artificially Synthesized Primer Sequence
catcgaagcatacaggcaga

SEQ ID NO: 13557 - DNA, 20 bp, Artificial Sequence
  Artificially Synthesized Primer Sequence
tcgacagcagaatggttgag

SEQ ID NO: 13558 - DNA, 20 bp, Artificial Sequence
  Artificially Synthesized Primer Sequence
gcagggttcttcagcttcac

SEQ ID NO: 13559 - DNA, 20 bp, Artificial Sequence
  Artificially Synthesized Primer Sequence
tttttcccttgacgcctatg

SEQ ID NO: 13560 - DNA, 20 bp, Artificial Sequence
  Artificially Synthesized Primer Sequence
cgacagcagaatggttgaga

SEQ ID NO: 13561 - DNA, 20 bp, Artificial Sequence
  Artificially Synthesized Primer Sequence
cactccactctgaaccacga

SEQ ID NO: 13562 - DNA, 20 bp, Artificial Sequence
  Artificially Synthesized Primer Sequence
ggttgaatccgaagcaaaaa

SEQ ID NO: 13563 - DNA, 20 bp, Artificial Sequence
  Artificially Synthesized Primer Sequence
cgtgaactcagcttccatca

SEQ ID NO: 13564 - DNA, 20 bp, Artificial Sequence
  Artificially Synthesized Primer Sequence
ggcaaggcgtgaagtctatc

SEQ ID NO: 13565 - DNA, 20 bp, Artificial Sequence
  Artificially Synthesized Primer Sequence
cagaactccagtgtcgcaaa

SEQ ID NO: 13566 - DNA, 20 bp, Artificial Sequence
  Artificially Synthesized Primer Sequence
caccttcttctcgaagcacc

SEQ ID NO: 13567 - DNA, 20 bp, Artificial Sequence
  Artificially Synthesized Primer Sequence
cattttgctgaggcagtgaa

SEQ ID NO: 13568 - DNA, 20 bp, Artificial Sequence
  Artificially Synthesized Primer Sequence
ggtgcttcgagaagaaggtg

SEQ ID NO: 13569 - DNA, 20 bp, Artificial Sequence
  Artificially Synthesized Primer Sequence
ctggcgacagacaatctgaa

SEQ ID NO: 13570 - DNA, 20 bp, Artificial Sequence
  Artificially Synthesized Primer Sequence
ttcccaaggacagcagaatc

SEQ ID NO: 13571 - DNA, 20 bp, Artificial Sequence
  Artificially Synthesized Primer Sequence
aaccacaggcacacattcaa

SEQ ID NO: 13572 - DNA, 20 bp, Artificial Sequence
  Artificially Synthesized Primer Sequence
aggatacaacccaagcatcg

SEQ ID NO: 13573 - DNA, 20 bp, Artificial Sequence
  Artificially Synthesized Primer Sequence
aaagaggggcccaaagacta

SEQ ID NO: 13574 - DNA, 20 bp, Artificial Sequence
  Artificially Synthesized Primer Sequence
cgtcaggatctcgtacagca

SEQ ID NO: 13575 - DNA, 20 bp, Artificial Sequence
  Artificially Synthesized Primer Sequence
gagcctccaaagaagaggga

SEQ ID NO: 13576 - DNA, 20 bp, Artificial Sequence
  Artificially Synthesized Primer Sequence
gtgagtactcctccaaggcg

SEQ ID NO: 13577 - DNA, 10 bp, Artificial Sequence
  Artificially Synthesized Primer Sequence
  MISC_FEATURE (1)..(10): n stands for any base
nnnnnnnnnn

SEQ ID NO: 13578 - DNA, 10 bp, Artificial Sequence
  Artificially Synthesized Primer Sequence
  MISC_FEATURE (1)..(10): n stands for any base
nnnnnnnnnn

SEQ ID NO: 13579 - DNA, 20 bp, Artificial Sequence
  Artificially Synthesized Primer Sequence
cataaaattaggcgggggat

SEQ ID NO: 13580 - DNA, 20 bp, Artificial Sequence
  Artificially Synthesized Primer Sequence
gaggcgtttctgctcaactc

SEQ ID NO: 13581 - DNA, 20 bp, Artificial Sequence
  Artificially Synthesized Primer Sequence
cgagcctttctcctcttcct

SEQ ID NO: 13582 - DNA, 20 bp, Artificial Sequence
  Artificially Synthesized Primer Sequence
atctggaaatggagcgtgac

SEQ ID NO: 13583 - DNA, 20 bp, Artificial Sequence
  Artificially Synthesized Primer Sequence
aatgtagggttccacaagcg

SEQ ID NO: 13584 - DNA, 20 bp, Artificial Sequence
  Artificially Synthesized Primer Sequence
gctgctgcagagaggaaact

SEQ ID NO: 13585 - DNA, 20 bp, Artificial Sequence
  Artificially Synthesized Primer Sequence
gtacctccagagcttcacgg

SEQ ID NO: 13586 - DNA, 20 bp, Artificial Sequence
  Artificially Synthesized Primer Sequence
tatggggaaaagcacaggac

SEQ ID NO: 13587 - DNA, 20 bp, Artificial Sequence
  Artificially Synthesized Primer Sequence
tatggggaaaagcacaggac

SEQ ID NO: 13588 - DNA, 20 bp, Artificial Sequence
  Artificially Synthesized Primer Sequence
gtacctccagagcttcacgg

SEQ ID NO: 13589 - DNA, 20 bp, Artificial Sequence
  Artificially Synthesized Primer Sequence
tgtacaacaaagcaggctgg

SEQ ID NO: 13590 - DNA, 20 bp, Artificial Sequence
  Artificially Synthesized Primer Sequence
tcgaggcccataacaatctc

SEQ ID NO: 13591 - DNA, 20 bp, Artificial Sequence
  Artificially Synthesized Primer Sequence
atcgcaagacaggcaaaaac

SEQ ID NO: 13592 - DNA, 20 bp, Artificial Sequence
  Artificially Synthesized Primer Sequence
acctgatcgacagccttgtt

SEQ ID NO: 13593 - DNA, 20 bp, Artificial Sequence
  Artificially Synthesized Primer Sequence
aattcctcgagcactgttgg

SEQ ID NO: 13594 - DNA, 19 bp, Artificial Sequence
  Artificially Synthesized Primer Sequence
ggttcttggcgaaggtctc

SEQ ID NO: 13595 - DNA, 20 bp, Artificial Sequence
  Artificially Synthesized Primer Sequence
agcggaagaagaaagatgcc

SEQ ID NO: 13596 - DNA, 18 bp, Artificial Sequence
  Artificially Synthesized Primer Sequence
cgtcaacaacaacgcctg

SEQ ID NO: 13597 - DNA, 20 bp, Artificial Sequence
  Artificially Synthesized Primer Sequence
ggcgagtcgagatgatgagt

SEQ ID NO: 13598 - DNA, 20 bp, Artificial Sequence
  Artificially Synthesized Primer Sequence
agggtgcaatcatacggaag

SEQ ID NO: 13599 - DNA, 20 bp, Artificial Sequence
  Artificially Synthesized Primer Sequence
gcggaagaagaaagatgcct

SEQ ID NO: 13600 - DNA, 20 bp, Artificial Sequence
  Artificially Synthesized Primer Sequence
tgaaggagatcaagaacggc

SEQ ID NO: 13601 - DNA, 20 bp, Artificial Sequence
  Artificially Synthesized Primer Sequence
cccagaatttccagcgaata

SEQ ID NO: 13602 - DNA, 20 bp, Artificial Sequence
  Artificially Synthesized Primer Sequence
ggtaacctcccccatatgct

SEQ ID NO: 13603 - DNA, 20 bp, Artificial Sequence
  Artificially Synthesized Primer Sequence
ccatatggctggaaccattc

SEQ ID NO: 13604 - DNA, 20 bp, Artificial Sequence
  Artificially Synthesized Primer Sequence
acagcaaactggtgcagaaa

SEQ ID NO: 13605 - DNA, 20 bp, Artificial Sequence
  Artificially Synthesized Primer Sequence
ggccgtcaaccagatttaga

SEQ ID NO: 13606 - DNA, 20 bp, Artificial Sequence
  Artificially Synthesized Primer Sequence
acatgcgaacttgttagggg

SEQ ID NO: 13607 - DNA, 20 bp, Artificial Sequence
  Artificially Synthesized Primer Sequence
gacagcaaacaacagcgaga

SEQ ID NO: 13608 - DNA, 20 bp, Artificial Sequence
  Artificially Synthesized Primer Sequence
cggagagagaagcgagaaga

SEQ ID NO: 13609 - DNA, 20 bp, Artificial Sequence
  Artificially Synthesized Primer Sequence
gtcgtcgccacttctttctc

SEQ ID NO: 13610 - DNA, 20 bp, Artificial Sequence
  Artificially Synthesized Primer Sequence
gttcccatccgtgatgtacc

SEQ ID NO: 13611 - DNA, 20 bp, Artificial Sequence
  Artificially Synthesized Primer Sequence
taatggagcctgcatcactg

SEQ ID NO: 13612 - DNA, 20 bp, Artificial Sequence
  Artificially Synthesized Primer Sequence
gtttgggttggcatgctact

SEQ ID NO: 13613 - DNA, 20 bp, Artificial Sequence
  Artificially Synthesized Primer Sequence
accccaagatctcggacttt

SEQ ID NO: 13614 - DNA, 20 bp, Artificial Sequence
  Artificially Synthesized Primer Sequence
gcgagacattgaacccattt

SEQ ID NO: 13615 - DNA, 20 bp, Artificial Sequence
  Artificially Synthesized Primer Sequence
tgtagacgttggctttgacg

SEQ ID NO: 13616 - DNA, 20 bp, Artificial Sequence
  Artificially Synthesized Primer Sequence
tgaaatcggatgtgttcagc

SEQ ID NO: 13617 - DNA, 20 bp, Artificial Sequence
  Artificially Synthesized Primer Sequence
ttcctttctactctgcccga

SEQ ID NO: 13618 - DNA, 20 bp, Artificial Sequence
  Artificially Synthesized Primer Sequence
gttgtctaccgcctgtccat

SEQ ID NO: 13619 - DNA, 20 bp, Artificial Sequence
  Artificially Synthesized Primer Sequence
gacttgcagggggtatttca

SEQ ID NO: 13620 - DNA, 20 bp, Artificial Sequence
  Artificially Synthesized Primer Sequence
tcttgatcaggactcccagg

SEQ ID NO: 13621 - DNA, 10 bp, Artificial Sequence
  Artificially Synthesized Primer Sequence
  MISC_FEATURE (1)..(10): n stands for any base
nnnnnnnnnn

SEQ ID NO: 13622 - DNA, 10 bp, Artificial Sequence
  Artificially Synthesized Primer Sequence
  MISC_FEATURE (1)..(10): n stands for any base
nnnnnnnnnn

SEQ ID NO: 13623 - DNA, 20 bp, Artificial Sequence
  Artificially Synthesized Primer Sequence
gcccaggcaacataaagtgt

SEQ ID NO: 13624 - DNA, 20 bp, Artificial Sequence
  Artificially Synthesized Primer Sequence
tgacgtggagctcaaaagtg

SEQ ID NO: 13625 - DNA, 20 bp, Artificial Sequence
  Artificially Synthesized Primer Sequence
cctgatggttacctctcgga

SEQ ID NO: 13626 - DNA, 20 bp, Artificial Sequence
  Artificially Synthesized Primer Sequence
tgctgcagtattccaaccag

SEQ ID NO: 13627 - DNA, 20 bp, Artificial Sequence
  Artificially Synthesized Primer Sequence
gagcaagatgcaatgccata

SEQ ID NO: 13628 - DNA, 20 bp, Artificial Sequence
  Artificially Synthesized Primer Sequence
gttgataatcgctggcaggt

SEQ ID NO: 13629 - DNA, 20 bp, Artificial Sequence
  Artificially Synthesized Primer Sequence
tgttcatgcaaaagggatga

SEQ ID NO: 13630 - DNA, 20 bp, Artificial Sequence
  Artificially Synthesized Primer Sequence
catcgtcagcgatcagaaaa

SEQ ID NO: 13631 - DNA, 20 bp, Artificial Sequence
  Artificially Synthesized Primer Sequence
atccgttggcaagacaagac

SEQ ID NO: 13632 - DNA, 20 bp, Artificial Sequence
  Artificially Synthesized Primer Sequence
gtgcctaccagcctcatcat

SEQ ID NO: 13633 - DNA, 20 bp, Artificial Sequence
  Artificially Synthesized Primer Sequence
gagaagcgagaagatgtcgg

SEQ ID NO: 13634 - DNA, 20 bp, Artificial Sequence
  Artificially Synthesized Primer Sequence
aacgagcagtcgaccctaga

SEQ ID NO: 13635 - DNA, 20 bp, Artificial Sequence
  Artificially Synthesized Primer Sequence
acgagcagtcgaccctagaa

SEQ ID NO: 13636 - DNA, 20 bp, Artificial Sequence
  Artificially Synthesized Primer Sequence
gagaagcgagaagatgtcgg

SEQ ID NO: 13637 - DNA, 20 bp, Artificial Sequence
  Artificially Synthesized Primer Sequence
acttctctcgccttcgtcat

SEQ ID NO: 13638 - DNA, 20 bp, Artificial Sequence
  Artificially Synthesized Primer Sequence
agcccccaggtagttgactc

SEQ ID NO: 13639 - DNA, 20 bp, Artificial Sequence
  Artificially Synthesized Primer Sequence
atggaaaacagtgacaggca

SEQ ID NO: 13640 - DNA, 20 bp, Artificial Sequence
  Artificially Synthesized Primer Sequence
ggatttcaacaagttggcgt

SEQ ID NO: 13641 - DNA, 20 bp, Artificial Sequence
  Artificially Synthesized Primer Sequence
tattgcagcaccttttgcag

SEQ ID NO: 13642 - DNA, 20 bp, Artificial Sequence
  Artificially Synthesized Primer Sequence
acgccaacttgttgaaatcc

SEQ ID NO: 13643 - DNA, 20 bp, Artificial Sequence
  Artificially Synthesized Primer Sequence
cgtatctggatgcccattct

SEQ ID NO: 13644 - DNA, 20 bp, Artificial Sequence
  Artificially Synthesized Primer Sequence
tgggaatcacaaacaccgta

SEQ ID NO: 13645 - DNA, 20 bp, Artificial Sequence
  Artificially Synthesized Primer Sequence
agtggtgtatggggaaccaa

SEQ ID NO: 13646 - DNA, 20 bp, Artificial Sequence
  Artificially Synthesized Primer Sequence
caagaagctgggtccttgag

SEQ ID NO: 13647 - DNA, 20 bp, Artificial Sequence
  Artificially Synthesized Primer Sequence
caaagcaccccaggtaagag

SEQ ID NO: 13648 - DNA, 20 bp, Artificial Sequence
  Artificially Synthesized Primer Sequence
gtggtgtatggggaaccaac

SEQ ID NO: 13649 - DNA, 20 bp, Artificial Sequence
  Artificially Synthesized Primer Sequence
caccaaggtcaacaatgcac

SEQ ID NO: 13650 - DNA, 20 bp, Artificial Sequence
  Artificially Synthesized Primer Sequence
atcaccatgaacttgcacca

SEQ ID NO: 13651 - DNA, 20 bp, Artificial Sequence
  Artificially Synthesized Primer Sequence
acttgcacaccccagctaat

SEQ ID NO: 13652 - DNA, 20 bp, Artificial Sequence
  Artificially Synthesized Primer Sequence
tgcacagctactgatttggc

SEQ ID NO: 13653 - DNA, 20 bp, Artificial Sequence
  Artificially Synthesized Primer Sequence
attgagcgggtctggtacac

SEQ ID NO: 13654 - DNA, 20 bp, Artificial Sequence
  Artificially Synthesized Primer Sequence
taaagacgcggaggaagaga

SEQ ID NO: 13655 - DNA, 20 bp, Artificial Sequence
  Artificially Synthesized Primer Sequence
gtgtaccagacccgctcaat

SEQ ID NO: 13656 - DNA, 20 bp, Artificial Sequence
  Artificially Synthesized Primer Sequence
gacgacgatgacgaagatga

SEQ ID NO: 13657 - DNA, 20 bp, Artificial Sequence
  Artificially Synthesized Primer Sequence
gccaatatcctcgcattgtt

SEQ ID NO: 13658 - DNA, 20 bp, Artificial Sequence
  Artificially Synthesized Primer Sequence
ctacaagccctcttgatcgc

SEQ ID NO: 13659 - DNA, 20 bp, Artificial Sequence
  Artificially Synthesized Primer Sequence
gaaattttacgtccctggca

SEQ ID NO: 13660 - DNA, 20 bp, Artificial Sequence
  Artificially Synthesized Primer Sequence
caaaaaggttgccaacttcc

SEQ ID NO: 13661 - DNA, 20 bp, Artificial Sequence
  Artificially Synthesized Primer Sequence
tgtgcagcgaggactacaac

SEQ ID NO: 13662 - DNA, 20 bp, Artificial Sequence
  Artificially Synthesized Primer Sequence
atcacttgccaccacaacaa

SEQ ID NO: 13663 - DNA, 21 bp, Artificial Sequence
  Artificially Synthesized Primer Sequence
ccctcgatactcccaagattt

SEQ ID NO: 13664 - DNA, 20 bp, Artificial Sequence
  Artificially Synthesized Primer Sequence
gcctccttctccttcttcgt

SEQ ID NO: 13665 - DNA, 20 bp, Artificial Sequence
  Artificially Synthesized Primer Sequence
cttcctcgagatcctgttcg

SEQ ID NO: 13666 - DNA, 20 bp, Artificial Sequence
  Artificially Synthesized Primer Sequence
ccatatggaaacacacagcg

SEQ ID NO: 13667 - DNA, 20 bp, Artificial Sequence
  Artificially Synthesized Primer Sequence
attacatgacggggaaacca

SEQ ID NO: 13668 - DNA, 20 bp, Artificial Sequence
  Artificially Synthesized Primer Sequence
caccttcctcgagatcctgt

SEQ ID NO: 13669 - DNA, 20 bp, Artificial Sequence
  Artificially Synthesized Primer Sequence
atcctgtgagcgagatgctt

SEQ ID NO: 13670 - DNA, 20 bp, Artificial Sequence
  Artificially Synthesized Primer Sequence
gtccctgtgaaaggtggaaa

SEQ ID NO: 13671 - DNA, 20 bp, Artificial Sequence
  Artificially Synthesized Primer Sequence
tagtggtacacaaacgggca

SEQ ID NO: 13672 - DNA, 20 bp, Artificial Sequence
  Artificially Synthesized Primer Sequence
gtgggagtcgtactcgtggt

SEQ ID NO: 13673 - DNA, 20 bp, Artificial Sequence
  Artificially Synthesized Primer Sequence
cttcctcgagatcctgttcg

SEQ ID NO: 13674 - DNA, 20 bp, Artificial Sequence
  Artificially Synthesized Primer Sequence
ccatatggaaacacacagcg

SEQ ID NO: 13675 - DNA, 20 bp, Artificial Sequence
  Artificially Synthesized Primer Sequence
ccatatggaaacacacagcg

SEQ ID NO: 13676 - DNA, 20 bp, Artificial Sequence
  Artificially Synthesized Primer Sequence
agatcctgttcgccatcatc

SEQ ID NO: 13677 - DNA, 20 bp, Artificial Sequence
  Artificially Synthesized Primer Sequence
gaccgacgctggaagaagta

SEQ ID NO: 13678 - DNA, 20 bp, Artificial Sequence
  Artificially Synthesized Primer Sequence
caaagaacacagtgagcgga

SEQ ID NO: 13679 - DNA, 20 bp, Artificial Sequence
  Artificially Synthesized Primer Sequence
aaggggaatagacgatgcct

SEQ ID NO: 13680 - DNA, 20 bp, Artificial Sequence
  Artificially Synthesized Primer Sequence
gaccgacgctggaagaagta

SEQ ID NO: 13681 - DNA, 20 bp, Artificial Sequence
  Artificially Synthesized Primer Sequence
aattcctcgagcactgttgg

SEQ ID NO: 13682 - DNA, 20 bp, Artificial Sequence
  Artificially Synthesized Primer Sequence
agaagatgacagggacgtgg

SEQ ID NO: 13683 - DNA, 20 bp, Artificial Sequence
  Artificially Synthesized Primer Sequence
atggacatgagtttggcctc

SEQ ID NO: 13684 - DNA, 20 bp, Artificial Sequence
  Artificially Synthesized Primer Sequence
ggacaagttcgtggaggaga

SEQ ID NO: 13685 - DNA, 20 bp, Artificial Sequence
  Artificially Synthesized Primer Sequence
ggcaagtggacgactctagg

SEQ ID NO: 13686 - DNA, 20 bp, Artificial Sequence
  Artificially Synthesized Primer Sequence
ggaagcaacaggcagatagc

SEQ ID NO: 13687 - DNA, 20 bp, Artificial Sequence
  Artificially Synthesized Primer Sequence
cttacgcagcaatcttgtcg

SEQ ID NO: 13688 - DNA, 20 bp, Artificial Sequence
  Artificially Synthesized Primer Sequence
ttacaaccgagaaaccgacc

SEQ ID NO: 13689 - DNA, 20 bp, Artificial Sequence
  Artificially Synthesized Primer Sequence
cttcagcttgatgtctggca

SEQ ID NO: 13690 - DNA, 20 bp, Artificial Sequence
  Artificially Synthesized Primer Sequence
ggatcatccaccggatgtag

SEQ ID NO: 13691 - DNA, 20 bp, Artificial Sequence
  Artificially Synthesized Primer Sequence
atttcgttgggtgacgtttc

SEQ ID NO: 13692 - DNA, 20 bp, Artificial Sequence
  Artificially Synthesized Primer Sequence
cttgcaaaggattggtgctt

SEQ ID NO: 13693 - DNA, 20 bp, Artificial Sequence
  Artificially Synthesized Primer Sequence
aattcctcgagcactgttgg

SEQ ID NO: 13694 - DNA, 20 bp, Artificial Sequence
  Artificially Synthesized Primer Sequence
cctggttctcttcgcttctg

SEQ ID NO: 13695 - DNA, 20 bp, Artificial Sequence
  Artificially Synthesized Primer Sequence
ccattgatctggggaaagaa

SEQ ID NO: 13696 - DNA, 20 bp, Artificial Sequence
  Artificially Synthesized Primer Sequence
gattgtgattgcaaggaggg

SEQ ID NO: 13697 - DNA, 20 bp, Artificial Sequence
  Artificially Synthesized Primer Sequence
agcaaatgcccaaacctatg

SEQ ID NO: 13698 - DNA, 20 bp, Artificial Sequence
  Artificially Synthesized Primer Sequence
tcaattgtaagctgttggcg

SEQ ID NO: 13699 - DNA, 20 bp, Artificial Sequence
  Artificially Synthesized Primer Sequence
atgggtgcatggaaagaaaa

SEQ ID NO: 13700 - DNA, 20 bp, Artificial Sequence
  Artificially Synthesized Primer Sequence
aacctatgcccaaaccaatg

SEQ ID NO: 13701 - DNA, 20 bp, Artificial Sequence
  Artificially Synthesized Primer Sequence
gtcaagaagaagcggaaacg

SEQ ID NO: 13702 - DNA, 20 bp, Artificial Sequence
  Artificially Synthesized Primer Sequence
caaggaagcaaaattgggaa

SEQ ID NO: 13703 - DNA, 20 bp, Artificial Sequence
  Artificially Synthesized Primer Sequence
caaggaagcaaaattgggaa

SEQ ID NO: 13704 - DNA, 20 bp, Artificial Sequence
  Artificially Synthesized Primer Sequence
cgtcaagaagaagcggaaac

SEQ ID NO: 13705 - DNA, 20 bp, Artificial Sequence
  Artificially Synthesized Primer Sequence
accctatcctattgcccacc

SEQ ID NO: 13706 - DNA, 20 bp, Artificial Sequence
  Artificially Synthesized Primer Sequence
aggagtatggagagacgcga

SEQ ID NO: 13707 - DNA, 20 bp, Artificial Sequence
  Artificially Synthesized Primer Sequence
gcacatccggatcttctgtt

SEQ ID NO: 13708 - DNA, 20 bp, Artificial Sequence
  Artificially Synthesized Primer Sequence
ggcaacttcagtcggttgat

SEQ ID NO: 13709 - DNA, 20 bp, Artificial Sequence
  Artificially Synthesized Primer Sequence
cagcaccccgttcattactt

SEQ ID NO: 13710 - DNA, 20 bp, Artificial Sequence
  Artificially Synthesized Primer Sequence
ccatgcataccattttgcag

SEQ ID NO: 13711 - DNA, 20 bp, Artificial Sequence
  Artificially Synthesized Primer Sequence
tgcaagcaggcactagtcag

SEQ ID NO: 13712 - DNA, 20 bp, Artificial Sequence
  Artificially Synthesized Primer Sequence
atgcagcagcaaacactgtc

SEQ ID NO: 13713 - DNA, 20 bp, Artificial Sequence
  Artificially Synthesized Primer Sequence
gcgaaggagaaggaggatct

SEQ ID NO: 13714 - DNA, 20 bp, Artificial Sequence
  Artificially Synthesized Primer Sequence
aagaaaggaaggggtgagga

SEQ ID NO: 13715 - DNA, 20 bp, Artificial Sequence
  Artificially Synthesized Primer Sequence
tctccagtcgtgcagatcac

SEQ ID NO: 13716 - DNA, 20 bp, Artificial Sequence
  Artificially Synthesized Primer Sequence
tggacaagttccccgactac

SEQ ID NO: 13717 - DNA, 20 bp, Artificial Sequence
  Artificially Synthesized Primer Sequence
tctcctgatttgggatttgc

SEQ ID NO: 13718 - DNA, 20 bp, Artificial Sequence
  Artificially Synthesized Primer Sequence
gaagtcggagattttgctcg

SEQ ID NO: 13719 - DNA, 20 bp, Artificial Sequence
  Artificially Synthesized Primer Sequence
gaagtcggagattttgctcg

SEQ ID NO: 13720 - DNA, 20 bp, Artificial Sequence
  Artificially Synthesized Primer Sequence
tctcctgatttgggatttgc

SEQ ID NO: 13721 - DNA, 20 bp, Artificial Sequence
  Artificially Synthesized Primer Sequence
gcgtgattttgtttccgagt

SEQ ID NO: 13722 - DNA, 20 bp, Artificial Sequence
  Artificially Synthesized Primer Sequence
ggggaggataaggctggtag

SEQ ID NO: 13723 - DNA, 20 bp, Artificial Sequence
  Artificially Synthesized Primer Sequence
cctgactcgaccaccaatct

SEQ ID NO: 13724 - DNA, 20 bp, Artificial Sequence
  Artificially Synthesized Primer Sequence
ctgcaccggttgttcatcta

SEQ ID NO: 13725 - DNA, 20 bp, Artificial Sequence
  Artificially Synthesized Primer Sequence
agacaagaaagaggccgaca

SEQ ID NO: 13726 - DNA, 20 bp, Artificial Sequence
  Artificially Synthesized Primer Sequence
ctggcttctcgttttccttg

SEQ ID NO: 13727 - DNA, 20 bp, Artificial Sequence
  Artificially Synthesized Primer Sequence
accaagtttgttccccgttt

SEQ ID NO: 13728 - DNA, 20 bp, Artificial Sequence
  Artificially Synthesized Primer Sequence
gtggaagatgaaaagccagc

SEQ ID NO: 13729 - DNA, 20 bp, Artificial Sequence
  Artificially Synthesized Primer Sequence
agaaggggatgcaacacaac

SEQ ID NO: 13730 - DNA, 20 bp, Artificial Sequence
  Artificially Synthesized Primer Sequence
ttcgtcaagctccatgtcag

SEQ ID NO: 13731 - DNA, 20 bp, Artificial Sequence
  Artificially Synthesized Primer Sequence
ttcgaaaacacatggttgga

SEQ ID NO: 13732 - DNA, 20 bp, Artificial Sequence
  Artificially Synthesized Primer Sequence
tcaaggcaatcagtgacgag

SEQ ID NO: 13733 - DNA, 20 bp, Artificial Sequence
  Artificially Synthesized Primer Sequence
atctatggagggcatgttgc

SEQ ID NO: 13734 - DNA, 20 bp, Artificial Sequence
  Artificially Synthesized Primer Sequence
aaaggaacaggtccgttgtg

SEQ ID NO: 13735 - DNA, 20 bp, Artificial Sequence
  Artificially Synthesized Primer Sequence
aaaggaacaggtccgttgtg

SEQ ID NO: 13736 - DNA, 20 bp, Artificial Sequence
  Artificially Synthesized Primer Sequence
atctatggagggcatgttgc

SEQ ID NO: 13737 - DNA, 20 bp, Artificial Sequence
  Artificially Synthesized Primer Sequence
tccacaagacgatgctcaag

SEQ ID NO: 13738 - DNA, 20 bp, Artificial Sequence
  Artificially Synthesized Primer Sequence
tctgaccatgcctactgctg

SEQ ID NO: 13739 - DNA, 20 bp, Artificial Sequence
  Artificially Synthesized Primer Sequence
tgatgttgccaccaatcagt

SEQ ID NO: 13740 - DNA, 20 bp, Artificial Sequence
  Artificially Synthesized Primer Sequence
gaagtgtggactcattgcca

SEQ ID NO: 13741 - DNA, 20 bp, Artificial Sequence
  Artificially Synthesized Primer Sequence
atcaagccaggagaacatgg

SEQ ID NO: 13742 - DNA, 20 bp, Artificial Sequence
  Artificially Synthesized Primer Sequence
tggtgatctgcttctgcaac

SEQ ID NO: 13743 - DNA, 20 bp, Artificial Sequence
  Artificially Synthesized Primer Sequence
agtcatgctcaagcacatcg

SEQ ID NO: 13744 - DNA, 20 bp, Artificial Sequence
  Artificially Synthesized Primer Sequence
atcaagccaggagaacatgg

SEQ ID NO: 13745 - DNA, 20 bp, Artificial Sequence
  Artificially Synthesized Primer Sequence
agctttgttggcctactgga

SEQ ID NO: 13746 - DNA, 20 bp, Artificial Sequence
  Artificially Synthesized Primer Sequence
caggccgttaagcagaaaag

SEQ ID NO: 13747 - DNA, 20 bp, Artificial Sequence
  Artificially Synthesized Primer Sequence
atttggaaacaaggcaccag

SEQ ID NO: 13748 - DNA, 20 bp, Artificial Sequence
  Artificially Synthesized Primer Sequence
agaacaaccaagcacggaat

SEQ ID NO: 13749 - DNA, 20 bp, Artificial Sequence
  Artificially Synthesized Primer Sequence
caaagttgttgccttgggtt

SEQ ID NO: 13750 - DNA, 20 bp, Artificial Sequence
  Artificially Synthesized Primer Sequence
tagcgggaaaggagcatcta

SEQ ID NO: 13751 - DNA, 20 bp, Artificial Sequence
  Artificially Synthesized Primer Sequence
aaggacccaatcgacatgag

SEQ ID NO: 13752 - DNA, 20 bp, Artificial Sequence
  Artificially Synthesized Primer Sequence
gcatgctcttcccttttgag

SEQ ID NO: 13753 - DNA, 20 bp, Artificial Sequence
  Artificially Synthesized Primer Sequence
accacttgtgatccgaggtc

SEQ ID NO: 13754 - DNA, 20 bp, Artificial Sequence
  Artificially Synthesized Primer Sequence
tttgttcaccagcgtctttg

SEQ ID NO: 13755 - DNA, 20 bp, Artificial Sequence
  Artificially Synthesized Primer Sequence
acctcgctacaaggcaaaaa

SEQ ID NO: 13756 - DNA, 20 bp, Artificial Sequence
  Artificially Synthesized Primer Sequence
caaagacgctggtgaacaaa

SEQ ID NO: 13757 - DNA, 20 bp, Artificial Sequence
  Artificially Synthesized Primer Sequence
acatgcatttcagttgcgag

SEQ ID NO: 13758 - DNA, 20 bp, Artificial Sequence
  Artificially Synthesized Primer Sequence
gccaaattttcccttccttc

SEQ ID NO: 13759 - DNA, 20 bp, Artificial Sequence
  Artificially Synthesized Primer Sequence
gctaatgggcgcaaaactaa

SEQ ID NO: 13760 - DNA, 20 bp, Artificial Sequence
  Artificially Synthesized Primer Sequence
caatgaaatgggcaaggact

SEQ ID NO: 13761 - DNA, 20 bp, Artificial Sequence
  Artificially Synthesized Primer Sequence
gacaggtccctggagttgaa

SEQ ID NO: 13762 - DNA, 20 bp, Artificial Sequence
  Artificially Synthesized Primer Sequence
gctcgacgatcttctccttg

SEQ ID NO: 13763 - DNA, 20 bp, Artificial Sequence
  Artificially Synthesized Primer Sequence
ctgtaatgttcacccgggac

SEQ ID NO: 13764 - DNA, 20 bp, Artificial Sequence
  Artificially Synthesized Primer Sequence
aggtgcagctggtggactat

SEQ ID NO: 13765 - DNA, 20 bp, Artificial Sequence
  Artificially Synthesized Primer Sequence
ctcactggggctgttgactt

SEQ ID NO: 13766 - DNA, 20 bp, Artificial Sequence
  Artificially Synthesized Primer Sequence
ttgtctttcgccctatgctt

SEQ ID NO: 13767 - DNA, 20 bp, Artificial Sequence
  Artificially Synthesized Primer Sequence
tgtctttcgccctatgcttt

SEQ ID NO: 13768 - DNA, 20 bp, Artificial Sequence
  Artificially Synthesized Primer Sequence
ctcactggggctgttgactt

SEQ ID NO: 13769 - DNA, 20 bp, Artificial Sequence
  Artificially Synthesized Primer Sequence
tgaggtgattgctcgtcttg

SEQ ID NO: 13770 - DNA, 20 bp, Artificial Sequence
  Artificially Synthesized Primer Sequence
cccttaccaggttttgctga

SEQ ID NO: 13771 - DNA, 20 bp, Artificial Sequence
  Artificially Synthesized Primer Sequence
ccagactgacgatttgggat

SEQ ID NO: 13772 - DNA, 20 bp, Artificial Sequence
  Artificially Synthesized Primer Sequence
gtgaagcaattcatgcaagc

SEQ ID NO: 13773 - DNA, 20 bp, Artificial Sequence
  Artificially Synthesized Primer Sequence
gaaatttggagaggccatca

SEQ ID NO: 13774 - DNA, 20 bp, Artificial Sequence
  Artificially Synthesized Primer Sequence
catcgaatgcccctgtaagt

SEQ ID NO: 13775 - DNA, 20 bp, Artificial Sequence
  Artificially Synthesized Primer Sequence
gtccaaccgagatcaaccat

SEQ ID NO: 13776 - DNA, 20 bp, Artificial Sequence
  Artificially Synthesized Primer Sequence
atgaaaaccttgaggatgcg

SEQ ID NO: 13777 - DNA, 20 bp, Artificial Sequence
  Artificially Synthesized Primer Sequence
gacgaagctgaggaggaatg

SEQ ID NO: 13778 - DNA, 20 bp, Artificial Sequence
  Artificially Synthesized Primer Sequence
tttagggcaaaatggcgtag

SEQ ID NO: 13779 - DNA, 20 bp, Artificial Sequence
  Artificially Synthesized Primer Sequence
tgcaaattgcgtgagtcttc

SEQ ID NO: 13780 - DNA, 20 bp, Artificial Sequence
  Artificially Synthesized Primer Sequence
gacgaagctgaggaggaatg

SEQ ID NO: 13781 - DNA, 20 bp, Artificial Sequence
  Artificially Synthesized Primer Sequence
aggaggaggagaccgagaag

SEQ ID NO: 13782 - DNA, 20 bp, Artificial Sequence
  Artificially Synthesized Primer Sequence
ccctctactgccccatgtta

SEQ ID NO: 13783 - DNA, 20 bp, Artificial Sequence
  Artificially Synthesized Primer Sequence
aaaccacagcacactgcaag

SEQ ID NO: 13784 - DNA, 20 bp, Artificial Sequence
  Artificially Synthesized Primer Sequence
agaaggaggaggagaccgag

SEQ ID NO: 13785 - DNA, 20 bp, Artificial Sequence
  Artificially Synthesized Primer Sequence
cttgatggggaagatggaga

SEQ ID NO: 13786 - DNA, 20 bp, Artificial Sequence
  Artificially Synthesized Primer Sequence
gtgcaaattcggtggtttct

SEQ ID NO: 13787 - DNA, 20 bp, Artificial Sequence
  Artificially Synthesized Primer Sequence
aacacacctcctgagccatc

SEQ ID NO: 13788 - DNA, 20 bp, Artificial Sequence
  Artificially Synthesized Primer Sequence
cttgatggggaagatggaga

SEQ ID NO: 13789 - DNA, 20 bp, Artificial Sequence
  Artificially Synthesized Primer Sequence
cccaaaggctgcttctacac

SEQ ID NO: 13790 - DNA, 20 bp, Artificial Sequence
  Artificially Synthesized Primer Sequence
tctaagcaaatgggtacggg

SEQ ID NO: 13791 - DNA, 20 bp, Artificial Sequence
  Artificially Synthesized Primer Sequence
agaccaatcagcggcactac

SEQ ID NO: 13792 - DNA, 20 bp, Artificial Sequence
  Artificially Synthesized Primer Sequence
ctccgaagaccaccttgtgt

SEQ ID NO: 13793 - DNA, 20 bp, Artificial Sequence
  Artificially Synthesized Primer Sequence
aagatggcgcctgattattg

SEQ ID NO: 13794 - DNA, 20 bp, Artificial Sequence
  Artificially Synthesized Primer Sequence
atccctccgtccgagactat

SEQ ID NO: 13795 - DNA, 20 bp, Artificial Sequence
  Artificially Synthesized Primer Sequence
atagcccatgactggaatgc

SEQ ID NO: 13796 - DNA, 20 bp, Artificial Sequence
  Artificially Synthesized Primer Sequence
cgcaacccaaacctgtagat

SEQ ID NO: 13797 - DNA, 20 bp, Artificial Sequence
  Artificially Synthesized Primer Sequence
gtcagctgaagcaaaggacc

SEQ ID NO: 13798 - DNA, 20 bp, Artificial Sequence
  Artificially Synthesized Primer Sequence
cagggacttgtggatgtgtg

SEQ ID NO: 13799 - DNA, 20 bp, Artificial Sequence
  Artificially Synthesized Primer Sequence
ggaaggagcacagctaaacg

SEQ ID NO: 13800 - DNA, 20 bp, Artificial Sequence
  Artificially Synthesized Primer Sequence
gtcagctgaagcaaaggacc

SEQ ID NO: 13801 - DNA, 20 bp, Artificial Sequence
  Artificially Synthesized Primer Sequence
gatccagaacgtgtgcaaga

SEQ ID NO: 13802 - DNA, 20 bp, Artificial Sequence
  Artificially Synthesized Primer Sequence
acaaatcaaccacaaacgca

SEQ ID NO: 13803 - DNA, 20 bp, Artificial Sequence
  Artificially Synthesized Primer Sequence
ccatctcacccgactcactt

SEQ ID NO: 13804 - DNA, 20 bp, Artificial Sequence
  Artificially Synthesized Primer Sequence
ggcaagtacgactacgccat

SEQ ID NO: 13805 - DNA, 20 bp, Artificial Sequence
  Artificially Synthesized Primer Sequence
tccatatgaatggaaacgca

SEQ ID NO: 13806 - DNA, 20 bp, Artificial Sequence
  Artificially Synthesized Primer Sequence
gcagatcaaattgcctccat

SEQ ID NO: 13807 - DNA, 20 bp, Artificial Sequence
  Artificially Synthesized Primer Sequence
ctggttgcaaaagtgcaaag

SEQ ID NO: 13808 - DNA, 20 bp, Artificial Sequence
  Artificially Synthesized Primer Sequence
ggatcacttgaacagcagca

SEQ ID NO: 13809 - DNA, 20 bp, Artificial Sequence
  Artificially Synthesized Primer Sequence
tcttttcctctcccctccat

SEQ ID NO: 13810 - DNA, 20 bp, Artificial Sequence
  Artificially Synthesized Primer Sequence
cagcctcaaaccagctcttc

SEQ ID NO: 13811 - DNA, 20 bp, Artificial Sequence
  Artificially Synthesized Primer Sequence
tggaaaggaaactgaggtgg

SEQ ID NO: 13812 - DNA, 20 bp, Artificial Sequence
  Artificially Synthesized Primer Sequence
aggtcactgcaggaggagaa

SEQ ID NO: 13813 - DNA, 20 bp, Artificial Sequence
  Artificially Synthesized Primer Sequence
tgccattcgcacagtaagag

SEQ ID NO: 13814 - DNA, 20 bp, Artificial Sequence
  Artificially Synthesized Primer Sequence
agctcactttccccctcatt

SEQ ID NO: 13815 - DNA, 20 bp, Artificial Sequence
  Artificially Synthesized Primer Sequence
tgttggcgttatccagagtg

SEQ ID NO: 13816 - DNA, 20 bp, Artificial Sequence
  Artificially Synthesized Primer Sequence
tcgttgatgaaagggaggac

SEQ ID NO: 13817 - DNA, 20 bp, Artificial Sequence
  Artificially Synthesized Primer Sequence
aggatgaacaccaagccatc

SEQ ID NO: 13818 - DNA, 20 bp, Artificial Sequence
  Artificially Synthesized Primer Sequence
cttggccttctccttcctct

SEQ ID NO: 13819 - DNA, 20 bp, Artificial Sequence
  Artificially Synthesized Primer Sequence
gttgaggggaatcccaaagt

SEQ ID NO: 13820 - DNA, 20 bp, Artificial Sequence
  Artificially Synthesized Primer Sequence
ctggccccgatcaaatacta

SEQ ID NO: 13821 - DNA, 20 bp, Artificial Sequence
  Artificially Synthesized Primer Sequence
acccactcactcacccactc

SEQ ID NO: 13822 - DNA, 20 bp, Artificial Sequence
  Artificially Synthesized Primer Sequence
acccggtcacaactatcagc

SEQ ID NO: 13823 - DNA, 20 bp, Artificial Sequence
  Artificially Synthesized Primer Sequence
aggagagagatcaccaggca

SEQ ID NO: 13824 - DNA, 20 bp, Artificial Sequence
  Artificially Synthesized Primer Sequence
gctttgcttatgaacccacg

SEQ ID NO: 13825 - DNA, 20 bp, Artificial Sequence
  Artificially Synthesized Primer Sequence
ggagcagaggcaactttttg

SEQ ID NO: 13826 - DNA, 20 bp, Artificial Sequence
  Artificially Synthesized Primer Sequence
tccttcttgggaatgacctg

SEQ ID NO: 13827 - DNA, 20 bp, Artificial Sequence
  Artificially Synthesized Primer Sequence
tccatgttcccagctacaca

SEQ ID NO: 13828 - DNA, 20 bp, Artificial Sequence
  Artificially Synthesized Primer Sequence
aggaacacattggttctggc

SEQ ID NO: 13829 - DNA, 20 bp, Artificial Sequence
  Artificially Synthesized Primer Sequence
caattgcattggaagtggtg

SEQ ID NO: 13830 - DNA, 20 bp, Artificial Sequence
  Artificially Synthesized Primer Sequence
caagatgttgcttggcttca

SEQ ID NO: 13831 - DNA, 20 bp, Artificial Sequence
  Artificially Synthesized Primer Sequence
aagtcagccaatcaagcgat

SEQ ID NO: 13832 - DNA, 20 bp, Artificial Sequence
  Artificially Synthesized Primer Sequence
ccatgtcatatcctcgggac

SEQ ID NO: 13833 - DNA, 20 bp, Artificial Sequence
  Artificially Synthesized Primer Sequence
gtggatcgccatcatcttct

SEQ ID NO: 13834 - DNA, 20 bp, Artificial Sequence
  Artificially Synthesized Primer Sequence
gacattgagggggtcgacta

SEQ ID NO: 13835 - DNA, 20 bp, Artificial Sequence
  Artificially Synthesized Primer Sequence
caatgtgctcaggtaggcaa

SEQ ID NO: 13836 - DNA, 20 bp, Artificial Sequence
  Artificially Synthesized Primer Sequence
tcatgtttgctgtcatgggt

SEQ ID NO: 13837 - DNA, 20 bp, Artificial Sequence
  Artificially Synthesized Primer Sequence
aggacaattccatcaccgag

SEQ ID NO: 13838 - DNA, 20 bp, Artificial Sequence
  Artificially Synthesized Primer Sequence
atctatttcatggcaagcgg

SEQ ID NO: 13839 - DNA, 20 bp, Artificial Sequence
  Artificially Synthesized Primer Sequence
cttgcaactgtagcctgcat

SEQ ID NO: 13840 - DNA, 20 bp, Artificial Sequence
  Artificially Synthesized Primer Sequence
tgagctccacctgatgaaaa

SEQ ID NO: 13841 - DNA, 20 bp, Artificial Sequence
  Artificially Synthesized Primer Sequence
aattcctcgagcactgttgg

SEQ ID NO: 13842 - DNA, 20 bp, Artificial Sequence
  Artificially Synthesized Primer Sequence
cgatatgcagacagaagcga

SEQ ID NO: 13843 - DNA, 20 bp, Artificial Sequence
  Artificially Synthesized Primer Sequence
gaacgagaacaggccatcat

SEQ ID NO: 13844 - DNA, 20 bp, Artificial Sequence
  Artificially Synthesized Primer Sequence
atgttcgagctcaacttcgc

SEQ ID NO: 13845 - DNA, 20 bp, Artificial Sequence
  Artificially Synthesized Primer Sequence
ttatttcctctggcgctgac

SEQ ID NO: 13846 - DNA, 20 bp, Artificial Sequence
  Artificially Synthesized Primer Sequence
gtcgaggagcaggtcgtatg

SEQ ID NO: 13847 - DNA, 20 bp, Artificial Sequence
  Artificially Synthesized Primer Sequence
ttgtttcatcggaaccacaa

SEQ ID NO: 13848 - DNA, 19 bp, Artificial Sequence
  Artificially Synthesized Primer Sequence
cgtcaaggactgcctcaag

SEQ ID NO: 13849 - DNA, 20 bp, Artificial Sequence
  Artificially Synthesized Primer Sequence
ggagttttaccatccaggca

SEQ ID NO: 13850 - DNA, 20 bp, Artificial Sequence
  Artificially Synthesized Primer Sequence
gtatggatgcgccatagctt

SEQ ID NO: 13851 - DNA, 20 bp, Artificial Sequence
  Artificially Synthesized Primer Sequence
tgttgggtcttaggactgcc

SEQ ID NO: 13852 - DNA, 20 bp, Artificial Sequence
  Artificially Synthesized Primer Sequence
cactgctcgtgaagctatgg

SEQ ID NO: 13853 - DNA, 20 bp, Artificial Sequence
  Artificially Synthesized Primer Sequence
tccttggtatcgtttaccgc

SEQ ID NO: 13854 - DNA, 20 bp, Artificial Sequence
  Artificially Synthesized Primer Sequence
ctctgatctccacattcgca

SEQ ID NO: 13855 - DNA, 20 bp, Artificial Sequence
  Artificially Synthesized Primer Sequence
gcctcacagactcgaggttc

SEQ ID NO: 13856 - DNA, 20 bp, Artificial Sequence
  Artificially Synthesized Primer Sequence
gctggtttgaggcaagagag

SEQ ID NO: 13857 - DNA, 21 bp, Artificial Sequence
  Artificially Synthesized Primer Sequence
ctttgttcactttgggtgagc

SEQ ID NO: 13858 - DNA, 20 bp, Artificial Sequence
  Artificially Synthesized Primer Sequence
gaatcacgtgtctcttccgt

SEQ ID NO: 13859 - DNA, 20 bp, Artificial Sequence
  Artificially Synthesized Primer Sequence
ttacaggggttcactcgacc

SEQ ID NO: 13860 - DNA, 20 bp, Artificial Sequence
  Artificially Synthesized Primer Sequence
agtgggtggtgaccaagaag

SEQ ID NO: 13861 - DNA, 20 bp, Artificial Sequence
  Artificially Synthesized Primer Sequence
gaggactttgtgcttgagcc

SEQ ID NO: 13862 - DNA, 20 bp, Artificial Sequence
  Artificially Synthesized Primer Sequence
actgagagtcagccaggcat

SEQ ID NO: 13863 - DNA, 20 bp, Artificial Sequence
  Artificially Synthesized Primer Sequence
catttgacagacgagccaga

SEQ ID NO: 13864 - DNA, 20 bp, Artificial Sequence
  Artificially Synthesized Primer Sequence
gaggactttgtgcttgagcc

SEQ ID NO: 13865 - DNA, 20 bp, Artificial Sequence
  Artificially Synthesized Primer Sequence
ctctctgatcctcctgacgg

SEQ ID NO: 13866 - DNA, 20 bp, Artificial Sequence
  Artificially Synthesized Primer Sequence
attaagcagggcaccaaatg

SEQ ID NO: 13867 - DNA, 20 bp, Artificial Sequence
  Artificially Synthesized Primer Sequence
atcacttcaatccacccagc

SEQ ID NO: 13868 - DNA, 20 bp, Artificial Sequence
  Artificially Synthesized Primer Sequence
ctctctgatcctcctgacgg

SEQ ID NO: 13869 - DNA, 20 bp, Artificial Sequence
  Artificially Synthesized Primer Sequence
gcaggagtatctgcaaggga

SEQ ID NO: 13870 - DNA, 20 bp, Artificial Sequence
  Artificially Synthesized Primer Sequence
ggcgcagaaacgactctaac

SEQ ID NO: 13871 - DNA, 20 bp, Artificial Sequence
  Artificially Synthesized Primer Sequence
cgtccagcacagaacaaaga

SEQ ID NO: 13872 - DNA, 20 bp, Artificial Sequence
  Artificially Synthesized Primer Sequence
gaatccaatgtgggtggagt

SEQ ID NO: 13873 - DNA, 20 bp, Artificial Sequence
  Artificially Synthesized Primer Sequence
aggaggaggtggacgagatt

SEQ ID NO: 13874 - DNA, 20 bp, Artificial Sequence
  Artificially Synthesized Primer Sequence
ctggttcctttttgcagagc

SEQ ID NO: 13875 - DNA, 20 bp, Artificial Sequence
  Artificially Synthesized Primer Sequence
aaatcgcaacaaaatcagcc

SEQ ID NO: 13876 - DNA, 20 bp, Artificial Sequence
  Artificially Synthesized Primer Sequence
ggtgagcctgagcaggtaga

SEQ ID NO: 13877 - DNA, 20 bp, Artificial Sequence
  Artificially Synthesized Primer Sequence
gtctcccagagaacgactgc

SEQ ID NO: 13878 - DNA, 20 bp, Artificial Sequence
  Artificially Synthesized Primer Sequence
cctcgggacaacactttcat

SEQ ID NO: 13879 - DNA, 20 bp, Artificial Sequence
  Artificially Synthesized Primer Sequence
ttttgggaggtgtttcttgc

SEQ ID NO: 13880 - DNA, 20 bp, Artificial Sequence
  Artificially Synthesized Primer Sequence
gtctcccagagaacgactgc

SEQ ID NO: 13881 - DNA, 20 bp, Artificial Sequence
  Artificially Synthesized Primer Sequence
tggaccggcacaagtatgta

SEQ ID NO: 13882 - DNA, 20 bp, Artificial Sequence
  Artificially Synthesized Primer Sequence
accaagaatgttgagcgtcc

SEQ ID NO: 13883 - DNA, 20 bp, Artificial Sequence
  Artificially Synthesized Primer Sequence
gaacattggtttcattcgcc

SEQ ID NO: 13884 - DNA, 20 bp, Artificial Sequence
  Artificially Synthesized Primer Sequence
aggtgtggggacagcttatg

SEQ ID NO: 13885 - DNA, 20 bp, Artificial Sequence
  Artificially Synthesized Primer Sequence
tgcaaaagatcatcagcagc

SEQ ID NO: 13886 - DNA, 20 bp, Artificial Sequence
  Artificially Synthesized Primer Sequence
gaccgaaaggcacttgacat

SEQ ID NO: 13887 - DNA, 20 bp, Artificial Sequence
  Artificially Synthesized Primer Sequence
ccgaaggcacttgacatttt

SEQ ID NO: 13888 - DNA, 20 bp, Artificial Sequence
  Artificially Synthesized Primer Sequence
gcaaaagatcatcagcagca

SEQ ID NO: 13889 - DNA, 20 bp, Artificial Sequence
  Artificially Synthesized Primer Sequence
caggccactgctgtttacaa

SEQ ID NO: 13890 - DNA, 20 bp, Artificial Sequence
  Artificially Synthesized Primer Sequence
ctgcaaagagaatgcaccaa

SEQ ID NO: 13891 - DNA, 20 bp, Artificial Sequence
  Artificially Synthesized Primer Sequence
gcgatggtgggagatagatg

SEQ ID NO: 13892 - DNA, 20 bp, Artificial Sequence
  Artificially Synthesized Primer Sequence
gcggtagctgacaaaggttc

SEQ ID NO: 13893 - DNA, 20 bp, Artificial Sequence
  Artificially Synthesized Primer Sequence
atatggctacccgtcgtctg

SEQ ID NO: 13894 - DNA, 20 bp, Artificial Sequence
  Artificially Synthesized Primer Sequence
gaaatggtggctgaggtgat

SEQ ID NO: 13895 - DNA, 20 bp, Artificial Sequence
  Artificially Synthesized Primer Sequence
ttcgcacctaagcttgacct

SEQ ID NO: 13896 - DNA, 20 bp, Artificial Sequence
  Artificially Synthesized Primer Sequence
ctatggactcgctcaggctc

SEQ ID NO: 13897 - DNA, 20 bp, Artificial Sequence
  Artificially Synthesized Primer Sequence
tgacaccgctgaagagattg

SEQ ID NO: 13898 - DNA, 20 bp, Artificial Sequence
  Artificially Synthesized Primer Sequence
atagctatggcacgattggc

SEQ ID NO: 13899 - DNA, 20 bp, Artificial Sequence
  Artificially Synthesized Primer Sequence
atagctatggcacgattggc

SEQ ID NO: 13900 - DNA, 20 bp, Artificial Sequence
  Artificially Synthesized Primer Sequence
tgacaccgctgaagagattg

SEQ ID NO: 13901 - DNA, 20 bp, Artificial Sequence
  Artificially Synthesized Primer Sequence
accagatcaatgagcccaag

SEQ ID NO: 13902 - DNA, 20 bp, Artificial Sequence
  Artificially Synthesized Primer Sequence
acctgggaggtaagttggct

SEQ ID NO: 13903 - DNA, 20 bp, Artificial Sequence
  Artificially Synthesized Primer Sequence
gcaggagtcaaagtgcaaca

SEQ ID NO: 13904 - DNA, 20 bp, Artificial Sequence
  Artificially Synthesized Primer Sequence
tgtcaagtttgctgagctgg

SEQ ID NO: 13905 - DNA, 20 bp, Artificial Sequence
  Artificially Synthesized Primer Sequence
gtcaaaggagcaagcaaagg

SEQ ID NO: 13906 - DNA, 20 bp, Artificial Sequence
  Artificially Synthesized Primer Sequence
tttttatcagggtcggcaag

SEQ ID NO: 13907 - DNA, 20 bp, Artificial Sequence
  Artificially Synthesized Primer Sequence
caaattttgccttgccttgt

SEQ ID NO: 13908 - DNA, 20 bp, Artificial Sequence
  Artificially Synthesized Primer Sequence
gttgctgaaagtgggctagg

SEQ ID NO: 13909 - DNA, 20 bp, Artificial Sequence
  Artificially Synthesized Primer Sequence
gcggttcaacaaacaaggtt

SEQ ID NO: 13910 - DNA, 20 bp, Artificial Sequence
  Artificially Synthesized Primer Sequence
ccatttgccattctcctcat

SEQ ID NO: 13911 - DNA, 20 bp, Artificial Sequence
  Artificially Synthesized Primer Sequence
caacatcgtggtcattggac

SEQ ID NO: 13912 - DNA, 20 bp, Artificial Sequence
  Artificially Synthesized Primer Sequence
ccttggagatacctgcctca

SEQ ID NO: 13913 - DNA, 20 bp, Artificial Sequence
  Artificially Synthesized Primer Sequence
attctttgggaggaggcact

SEQ ID NO: 13914 - DNA, 20 bp, Artificial Sequence
  Artificially Synthesized Primer Sequence
ggaaatgagattcccagcaa

SEQ ID NO: 13915 - DNA, 20 bp, Artificial Sequence
  Artificially Synthesized Primer Sequence
ggggaaaccacaaactctca

SEQ ID NO: 13916 - DNA, 20 bp, Artificial Sequence
  Artificially Synthesized Primer Sequence
tgctcaacgtccagaacaag

SEQ ID NO: 13917 - DNA, 20 bp, Artificial Sequence
  Artificially Synthesized Primer Sequence
gtaacatcattgcccaggct

SEQ ID NO: 13918 - DNA, 20 bp, Artificial Sequence
  Artificially Synthesized Primer Sequence
gcacaaggatgagctgtgaa

SEQ ID NO: 13919 - DNA, 20 bp, Artificial Sequence
  Artificially Synthesized Primer Sequence
gcacaaagaatgagctgctg

SEQ ID NO: 13920 - DNA, 20 bp, Artificial Sequence
  Artificially Synthesized Primer Sequence
gacttcctggattcggacct

SEQ ID NO: 13921 - DNA, 20 bp, Artificial Sequence
  Artificially Synthesized Primer Sequence
ggtacaactttgcgagagcc

SEQ ID NO: 13922 - DNA, 20 bp, Artificial Sequence
  Artificially Synthesized Primer Sequence
tagcaggcctaaggaggtca

SEQ ID NO: 13923 - DNA, 20 bp, Artificial Sequence
  Artificially Synthesized Primer Sequence
cttcctgacaggttgaaggc

SEQ ID NO: 13924 - DNA, 20 bp, Artificial Sequence
  Artificially Synthesized Primer Sequence
tggtccagaaaggagtgacc

SEQ ID NO: 13925 - DNA, 20 bp, Artificial Sequence
  Artificially Synthesized Primer Sequence
atcacatcacaaacgaagcg

SEQ ID NO: 13926 - DNA, 20 bp, Artificial Sequence
  Artificially Synthesized Primer Sequence
ggtggagtatcgagaaggca

SEQ ID NO: 13927 - DNA, 20 bp, Artificial Sequence
  Artificially Synthesized Primer Sequence
gaaaattacacgatggcggt

SEQ ID NO: 13928 - DNA, 19 bp, Artificial Sequence
  Artificially Synthesized Primer Sequence
cggacagtgcgacaagatt

SEQ ID NO: 13929 - DNA, 20 bp, Artificial Sequence
  Artificially Synthesized Primer Sequence
gtaacacttttcgcgcatga

SEQ ID NO: 13930 - DNA, 20 bp, Artificial Sequence
  Artificially Synthesized Primer Sequence
gccattttccattgcaagtt

SEQ ID NO: 13931 - DNA, 20 bp, Artificial Sequence
  Artificially Synthesized Primer Sequence
acaagacatcgttagcgcct

SEQ ID NO: 13932 - DNA, 20 bp, Artificial Sequence
  Artificially Synthesized Primer Sequence
ttcgcccaactgatagatcc

SEQ ID NO: 13933 - DNA, 20 bp, Artificial Sequence
  Artificially Synthesized Primer Sequence
gccgaaaacataaggcaaaa

SEQ ID NO: 13934 - DNA, 20 bp, Artificial Sequence
  Artificially Synthesized Primer Sequence
aaagcctgtgtccaatgtcc

SEQ ID NO: 13935 - DNA, 20 bp, Artificial Sequence
  Artificially Synthesized Primer Sequence
gtgcacgggagaaacaaaat

SEQ ID NO: 13936 - DNA, 20 bp, Artificial Sequence
  Artificially Synthesized Primer Sequence
gcttatcgacaaagcggttc

SEQ ID NO: 13937 - DNA, 20 bp, Artificial Sequence
  Artificially Synthesized Primer Sequence
agggacttcgataaggaggg

SEQ ID NO: 13938 - DNA, 20 bp, Artificial Sequence
  Artificially Synthesized Primer Sequence
aaactgccaagatcagtgcc

SEQ ID NO: 13939 - DNA, 20 bp, Artificial Sequence
  Artificially Synthesized Primer Sequence
acaaaccagcgaggaatcaa

SEQ ID NO: 13940 - DNA, 20 bp, Artificial Sequence
  Artificially Synthesized Primer Sequence
atgggtcccagaaaaccttc

SEQ ID NO: 13941 - DNA, 20 bp, Artificial Sequence
  Artificially Synthesized Primer Sequence
gcaggtcttggtagctttgc

SEQ ID NO: 13942 - DNA, 20 bp, Artificial Sequence
  Artificially Synthesized Primer Sequence
tggcattggctactttttcc

SEQ ID NO: 13943 - DNA, 20 bp, Artificial Sequence
  Artificially Synthesized Primer Sequence
ggcttggtttcgtcagttct

SEQ ID NO: 13944 - DNA, 20 bp, Artificial Sequence
  Artificially Synthesized Primer Sequence
cgcagtcataatccgtgaca

SEQ ID NO: 13945 - DNA, 20 bp, Artificial Sequence
  Artificially Synthesized Primer Sequence
ccacggataaaaccatcacc

SEQ ID NO: 13946 - DNA, 20 bp, Artificial Sequence
  Artificially Synthesized Primer Sequence
aataaatgggtgtgggacga

SEQ ID NO: 13947 - DNA, 20 bp, Artificial Sequence
  Artificially Synthesized Primer Sequence
tctcctcttgacagtgctgc

SEQ ID NO: 13948 - DNA, 19 bp, Artificial Sequence
  Artificially Synthesized Primer Sequence
ggttgcagttgcaaagagc

SEQ ID NO: 13949 - DNA, 20 bp, Artificial Sequence
  Artificially Synthesized Primer Sequence
ccacggataaaaccatcacc

SEQ ID NO: 13950 - DNA, 20 bp, Artificial Sequence
  Artificially Synthesized Primer Sequence
tggtcagatagtgcgacagc

SEQ ID NO: 13951 - DNA, 20 bp, Artificial Sequence
  Artificially Synthesized Primer Sequence
acaccacagagctttgcctc

SEQ ID NO: 13952 - DNA, 20 bp, Artificial Sequence
  Artificially Synthesized Primer Sequence
ctaccaccagcttccctttg

SEQ ID NO: 13953 - DNA, 20 bp, Artificial Sequence
  Artificially Synthesized Primer Sequence
aaagagcccccaacaaagat

SEQ ID NO: 13954 - DNA, 20 bp, Artificial Sequence
  Artificially Synthesized Primer Sequence
ggaggcttcaagagacgttg

SEQ ID NO: 13955 - DNA, 20 bp, Artificial Sequence
  Artificially Synthesized Primer Sequence
ggaagacacggaaactggaa

SEQ ID NO: 13956 - DNA, 20 bp, Artificial Sequence
  Artificially Synthesized Primer Sequence
gatgactgctctgcagcttg

SEQ ID NO: 13957 - DNA, 20 bp, Artificial Sequence
  Artificially Synthesized Primer Sequence
cagaaggcaactccctgaag

SEQ ID NO: 13958 - DNA, 20 bp, Artificial Sequence
  Artificially Synthesized Primer Sequence
acagttatttgagggcacgg

SEQ ID NO: 13959 - DNA, 20 bp, Artificial Sequence
  Artificially Synthesized Primer Sequence
acagttatttgagggcacgg

SEQ ID NO: 13960 - DNA, 20 bp, Artificial Sequence
  Artificially Synthesized Primer Sequence
tactgagggttaagcgtggg

SEQ ID NO: 13961 - DNA, 20 bp, Artificial Sequence
  Artificially Synthesized Primer Sequence
gcagcatggacagaagatca

SEQ ID NO: 13962 - DNA, 20 bp, Artificial Sequence
  Artificially Synthesized Primer Sequence
tggatgtagagcttgccctt

SEQ ID NO: 13963 - DNA, 20 bp, Artificial Sequence
  Artificially Synthesized Primer Sequence
gatcacaacatcctgcctga

SEQ ID NO: 13964 - DNA, 20 bp, Artificial Sequence
  Artificially Synthesized Primer Sequence
cctgattcattcaaggcgat

SEQ ID NO: 13965 - DNA, 20 bp, Artificial Sequence
  Artificially Synthesized Primer Sequence
ggcaccaacagtctcagctt

SEQ ID NO: 13966 - DNA, 20 bp, Artificial Sequence
  Artificially Synthesized Primer Sequence
ccttgggcttgtaggtgttg

SEQ ID NO: 13967 - DNA, 20 bp, Artificial Sequence
  Artificially Synthesized Primer Sequence
atgcttcatttcacgcatca

SEQ ID NO: 13968 - DNA, 20 bp, Artificial Sequence
  Artificially Synthesized Primer Sequence
ttcaagcttttggatggagg

SEQ ID NO: 13969 - DNA, 20 bp, Artificial Sequence
  Artificially Synthesized Primer Sequence
aatcttcgtcctccagcaga

SEQ ID NO: 13970 - DNA, 20 bp, Artificial Sequence
  Artificially Synthesized Primer Sequence
atgtcgtaggccatcgtctc

SEQ ID NO: 13971 - DNA, 20 bp, Artificial Sequence
  Artificially Synthesized Primer Sequence
atgtcgtaggccatcgtctc

SEQ ID NO: 13972 - DNA, 20 bp, Artificial Sequence
  Artificially Synthesized Primer Sequence
aatcttcgtcctccagcaga

SEQ ID NO: 13973 - DNA, 20 bp, Artificial Sequence
  Artificially Synthesized Primer Sequence
tctccccatccaagaaacag

SEQ ID NO: 13974 - DNA, 20 bp, Artificial Sequence
  Artificially Synthesized Primer Sequence
agttcaccacttggcctttg

SEQ ID NO: 13975 - DNA, 20 bp, Artificial Sequence
  Artificially Synthesized Primer Sequence
aatcgagtggctcaacgaac

SEQ ID NO: 13976 - DNA, 20 bp, Artificial Sequence
  Artificially Synthesized Primer Sequence
tcgtgctcaagaacaccaac

SEQ ID NO: 13977 - DNA, 20 bp, Artificial Sequence
  Artificially Synthesized Primer Sequence
ggtgcctcatcacctgctat

SEQ ID NO: 13978 - DNA, 20 bp, Artificial Sequence
  Artificially Synthesized Primer Sequence
cgcacacatgatcacatcaa

SEQ ID NO: 13979 - DNA, 20 bp, Artificial Sequence
  Artificially Synthesized Primer Sequence
gggcgaaaaacaatcaattc

SEQ ID NO: 13980 - DNA, 20 bp, Artificial Sequence
  Artificially Synthesized Primer Sequence
ccgggtgcttatttacatgc

SEQ ID NO: 13981 - DNA, 20 bp, Artificial Sequence
  Artificially Synthesized Primer Sequence
ccgcacgacaacaacataac

SEQ ID NO: 13982 - DNA, 20 bp, Artificial Sequence
  Artificially Synthesized Primer Sequence
agcaaagccagaaatggaga

SEQ ID NO: 13983 - DNA, 20 bp, Artificial Sequence
  Artificially Synthesized Primer Sequence
agcaaagccagaaatggaga

SEQ ID NO: 13984 - DNA, 20 bp, Artificial Sequence
  Artificially Synthesized Primer Sequence
ctgaccctgcaattcacaga

SEQ ID NO: 13985 - DNA, 20 bp, Artificial Sequence
  Artificially Synthesized Primer Sequence
cgatactgggacgaggacat

SEQ ID NO: 13986 - DNA, 20 bp, Artificial Sequence
  Artificially Synthesized Primer Sequence
gattgagctgctatccgagc

SEQ ID NO: 13987 - DNA, 20 bp, Artificial Sequence
  Artificially Synthesized Primer Sequence
tccgtatgctctggttttcc

SEQ ID NO: 13988 - DNA, 20 bp, Artificial Sequence
  Artificially Synthesized Primer Sequence
agctcaatcaaaccgcaact

SEQ ID NO: 13989 - DNA, 20 bp, Artificial Sequence
  Artificially Synthesized Primer Sequence
caatgcctatggtggctttt

SEQ ID NO: 13990 - DNA, 20 bp, Artificial Sequence
  Artificially Synthesized Primer Sequence
gtcaggccggttgtactgat

SEQ ID NO: 13991 - DNA, 20 bp, Artificial Sequence
  Artificially Synthesized Primer Sequence
aagacaacacaccaccacca

SEQ ID NO: 13992 - DNA, 20 bp, Artificial Sequence
  Artificially Synthesized Primer Sequence
cggagaggaaaaatctgctg

SEQ ID NO: 13993 - DNA, 20 bp, Artificial Sequence
  Artificially Synthesized Primer Sequence
cctccacggtaccacagact

SEQ ID NO: 13994 - DNA, 20 bp, Artificial Sequence
  Artificially Synthesized Primer Sequence
tttcagtcgcacattcttgc

SEQ ID NO: 13995 - DNA, 20 bp, Artificial Sequence
  Artificially Synthesized Primer Sequence
agctgcaatccctacaaacg

SEQ ID NO: 13996 - DNA, 20 bp, Artificial Sequence
  Artificially Synthesized Primer Sequence
tgccaatgaactgggataca

SEQ ID NO: 13997 - DNA, 20 bp, Artificial Sequence
  Artificially Synthesized Primer Sequence
ccagcagaaggtgaagttcc

SEQ ID NO: 13998 - DNA, 20 bp, Artificial Sequence
  Artificially Synthesized Primer Sequence
aaactcgctccacattccac

SEQ ID NO: 13999 - DNA, 19 bp, Artificial Sequence
  Artificially Synthesized Primer Sequence
caaccaactttgggcattg

SEQ ID NO: 14000 - DNA, 20 bp, Artificial Sequence
  Artificially Synthesized Primer Sequence
agctaggcttcgcgttcata

SEQ ID NO: 14001 - DNA, 20 bp, Artificial Sequence
  Artificially Synthesized Primer Sequence
ggctgcacatcgtctactga

SEQ ID NO: 14002 - DNA, 20 bp, Artificial Sequence
  Artificially Synthesized Primer Sequence
tctgttggttgaacttcccc

SEQ ID NO: 14003 - DNA, 20 bp, Artificial Sequence
  Artificially Synthesized Primer Sequence
agatcattcggacgcgatac

SEQ ID NO: 14004 - DNA, 20 bp, Artificial Sequence
  Artificially Synthesized Primer Sequence
gaggtcacagcatgagagca

SEQ ID NO: 14005 - DNA, 20 bp, Artificial Sequence
  Artificially Synthesized Primer Sequence
gcggaaaaatcatcttggaa

SEQ ID NO: 14006 - DNA, 20 bp, Artificial Sequence
  Artificially Synthesized Primer Sequence
agagtctacggacggcagaa

SEQ ID NO: 14007 - DNA, 20 bp, Artificial Sequence
  Artificially Synthesized Primer Sequence
agagtctacggacggcagaa

SEQ ID NO: 14008 - DNA, 20 bp, Artificial Sequence
  Artificially Synthesized Primer Sequence
tggagctcttatggtgctga

SEQ ID NO: 14009 - DNA, 20 bp, Artificial Sequence
  Artificially Synthesized Primer Sequence
tcagcacaccaagactaccg

SEQ ID NO: 14010 - DNA, 20 bp, Artificial Sequence
  Artificially Synthesized Primer Sequence
cccatggcaaacaaactctt

SEQ ID NO: 14011 - DNA, 20 bp, Artificial Sequence
  Artificially Synthesized Primer Sequence
cccatggcaaacaaactctt

SEQ ID NO: 14012 - DNA, 20 bp, Artificial Sequence
  Artificially Synthesized Primer Sequence
gaaggactacaaggacggca

SEQ ID NO: 14013 - DNA, 20 bp, Artificial Sequence
  Artificially Synthesized Primer Sequence
cacgagggtcaaacctcaat

SEQ ID NO: 14014 - DNA, 20 bp, Artificial Sequence
  Artificially Synthesized Primer Sequence
tgcagtttaacccacaccaa

SEQ ID NO: 14015 - DNA, 20 bp, Artificial Sequence
  Artificially Synthesized Primer Sequence
ggtaccatcacagtcgcaga

SEQ ID NO: 14016 - DNA, 20 bp, Artificial Sequence
  Artificially Synthesized Primer Sequence
gtggttggacagcaaccttt

SEQ ID NO: 14017 - DNA, 20 bp, Artificial Sequence
  Artificially Synthesized Primer Sequence
agctggtgctgcttacaaca

SEQ ID NO: 14018 - DNA, 20 bp, Artificial Sequence
  Artificially Synthesized Primer Sequence
gagaatctgcttcacccagc

SEQ ID NO: 14019 - DNA, 20 bp, Artificial Sequence
  Artificially Synthesized Primer Sequence
gtacatatcacggcgtgcag

SEQ ID NO: 14020 - DNA, 20 bp, Artificial Sequence
  Artificially Synthesized Primer Sequence
agctggtgctgcttacaaca

SEQ ID NO: 14021 - DNA, 20 bp, Artificial Sequence
  Artificially Synthesized Primer Sequence
gccaaactggagataccgaa

SEQ ID NO: 14022 - DNA, 20 bp, Artificial Sequence
  Artificially Synthesized Primer Sequence
ttgtaaggcgatcaattccc

SEQ ID NO: 14023 - DNA, 21 bp, Artificial Sequence
  Artificially Synthesized Primer Sequence
caaacaaacatgcagcacact

SEQ ID NO: 14024 - DNA, 20 bp, Artificial Sequence
  Artificially Synthesized Primer Sequence
aaacattctgcactgccctc

SEQ ID NO: 14025 - DNA, 20 bp, Artificial Sequence
  Artificially Synthesized Primer Sequence
gcactcattagccgcttttc

SEQ ID NO: 14026 - DNA, 20 bp, Artificial Sequence
  Artificially Synthesized Primer Sequence
cgtttgatgtagatggggct

SEQ ID NO: 14027 - DNA, 20 bp, Artificial Sequence
  Artificially Synthesized Primer Sequence
ttgatcgagtcaaccactgc

SEQ ID NO: 14028 - DNA, 20 bp, Artificial Sequence
  Artificially Synthesized Primer Sequence
gaggtgttcgggctcaagta

SEQ ID NO: 14029 - DNA, 20 bp, Artificial Sequence
  Artificially Synthesized Primer Sequence
gttgccctcaagccaaataa

SEQ ID NO: 14030 - DNA, 20 bp, Artificial Sequence
  Artificially Synthesized Primer Sequence
ggaggtccatgaagcaaaaa

SEQ ID NO: 14031 - DNA, 20 bp, Artificial Sequence
  Artificially Synthesized Primer Sequence
gctgtagcattctgtggcaa

SEQ ID NO: 14032 - DNA, 20 bp, Artificial Sequence
  Artificially Synthesized Primer Sequence
ggccataatcatttcgatgg

SEQ ID NO: 14033 - DNA, 20 bp, Artificial Sequence
  Artificially Synthesized Primer Sequence
ctggcagagttctccctgtc

SEQ ID NO: 14034 - DNA, 20 bp, Artificial Sequence
  Artificially Synthesized Primer Sequence
agttcagggttcaaaggggt

SEQ ID NO: 14035 - DNA, 20 bp, Artificial Sequence
  Artificially Synthesized Primer Sequence
agttcagggttcaaaggggt

SEQ ID NO: 14036 - DNA, 20 bp, Artificial Sequence
  Artificially Synthesized Primer Sequence
gtctgaagaggaagccgatg

SEQ ID NO: 14037 - DNA, 20 bp, Artificial Sequence
  Artificially Synthesized Primer Sequence
tggcacatggtacaagcaat

SEQ ID NO: 14038 - DNA, 20 bp, Artificial Sequence
  Artificially Synthesized Primer Sequence
caggcatcattccaaacctt

SEQ ID NO: 14039 - DNA, 20 bp, Artificial Sequence
  Artificially Synthesized Primer Sequence
acatccctgtgtgcatgtgt

SEQ ID NO: 14040 - DNA, 20 bp, Artificial Sequence
  Artificially Synthesized Primer Sequence
cccccaagtagatcctccat

SEQ ID NO: 14041 - DNA, 20 bp, Artificial Sequence
  Artificially Synthesized Primer Sequence
gggttgctaaagagaagggg

SEQ ID NO: 14042 - DNA, 20 bp, Artificial Sequence
  Artificially Synthesized Primer Sequence
ccgggttgagtgtgttcttt

SEQ ID NO: 14043 - DNA, 20 bp, Artificial Sequence
  Artificially Synthesized Primer Sequence
acaacacatgggacgacaga

SEQ ID NO: 14044 - DNA, 20 bp, Artificial Sequence
  Artificially Synthesized Primer Sequence
tgataacgacccaaatgctg

SEQ ID NO: 14045 - DNA, 20 bp, Artificial Sequence
  Artificially Synthesized Primer Sequence
ttgtttccaaagggaggatg

SEQ ID NO: 14046 - DNA, 20 bp, Artificial Sequence
  Artificially Synthesized Primer Sequence
ttttgctccagttgtcatgc

SEQ ID NO: 14047 - DNA, 20 bp, Artificial Sequence
  Artificially Synthesized Primer Sequence
aaataatatgacgccgcgag

SEQ ID NO: 14048 - DNA, 20 bp, Artificial Sequence
  Artificially Synthesized Primer Sequence
caagagcaagacgcatcaag

SEQ ID NO: 14049 - DNA, 20 bp, Artificial Sequence
  Artificially Synthesized Primer Sequence
acctatggattcctcacccc

SEQ ID NO: 14050 - DNA, 20 bp, Artificial Sequence
  Artificially Synthesized Primer Sequence
gcttagacggcaaacagagg

SEQ ID NO: 14051 - DNA, 20 bp, Artificial Sequence
  Artificially Synthesized Primer Sequence
agatgtcggtgaactcctgg

SEQ ID NO: 14052 - DNA, 19 bp, Artificial Sequence
  Artificially Synthesized Primer Sequence
atcatcctcgccaagctct

SEQ ID NO: 14053 - DNA, 20 bp, Artificial Sequence
  Artificially Synthesized Primer Sequence
tcaactacctctcctcgcgt

SEQ ID NO: 14054 - DNA, 20 bp, Artificial Sequence
  Artificially Synthesized Primer Sequence
gaaatgaacaaaatgccgct

SEQ ID NO: 14055 - DNA, 20 bp, Artificial Sequence
  Artificially Synthesized Primer Sequence
cgtgtacacttccctcgttg

SEQ ID NO: 14056 - DNA, 20 bp, Artificial Sequence
  Artificially Synthesized Primer Sequence
gggtacctccagagggtgtt

SEQ ID NO: 14057 - DNA, 20 bp, Artificial Sequence
  Artificially Synthesized Primer Sequence
gcagaacgaattgctgttga

SEQ ID NO: 14058 - DNA, 20 bp, Artificial Sequence
  Artificially Synthesized Primer Sequence
cttgcaagagatgcggtgta

SEQ ID NO: 14059 - DNA, 20 bp, Artificial Sequence
  Artificially Synthesized Primer Sequence
cttcttatgcgattccaccg

SEQ ID NO: 14060 - DNA, 20 bp, Artificial Sequence
  Artificially Synthesized Primer Sequence
tcatcgaagttgcacaggac

SEQ ID NO: 14061 - DNA, 20 bp, Artificial Sequence
  Artificially Synthesized Primer Sequence
cgaccctgtcaacaacaatg

SEQ ID NO: 14062 - DNA, 20 bp, Artificial Sequence
  Artificially Synthesized Primer Sequence
aatgcgaaatgatcacacca

SEQ ID NO: 14063 - DNA, 20 bp, Artificial Sequence
  Artificially Synthesized Primer Sequence
ctgctcgtgtcttttcccat

SEQ ID NO: 14064 - DNA, 20 bp, Artificial Sequence
  Artificially Synthesized Primer Sequence
atcaatccgtggaagcatgt

SEQ ID NO: 14065 - DNA, 20 bp, Artificial Sequence
  Artificially Synthesized Primer Sequence
gatcccagatcttcagcgag

SEQ ID NO: 14066 - DNA, 20 bp, Artificial Sequence
  Artificially Synthesized Primer Sequence
gaacaaagttggtggcgaat

SEQ ID NO: 14067 - DNA, 20 bp, Artificial Sequence
  Artificially Synthesized Primer Sequence
cattgttgttgacagggtcg

SEQ ID NO: 14068 - DNA, 20 bp, Artificial Sequence
  Artificially Synthesized Primer Sequence
gatcccagatcttcagcgag

SEQ ID NO: 14069 - DNA, 20 bp, Artificial Sequence
  Artificially Synthesized Primer Sequence
tcaaggttaacaaggccacc

SEQ ID NO: 14070 - DNA, 20 bp, Artificial Sequence
  Artificially Synthesized Primer Sequence
gcatccaccatccacttctt

SEQ ID NO: 14071 - DNA, 20 bp, Artificial Sequence
  Artificially Synthesized Primer Sequence
atgtagtcctcacggttgcc

SEQ ID NO: 14072 - DNA, 20 bp, Artificial Sequence
  Artificially Synthesized Primer Sequence
cctcaaggttaacaaggcca

SEQ ID NO: 14073 - DNA, 20 bp, Artificial Sequence
  Artificially Synthesized Primer Sequence
gtggcattcctgtgaaggat

SEQ ID NO: 14074 - DNA, 20 bp, Artificial Sequence
  Artificially Synthesized Primer Sequence
aaaggttccagcagaagcaa

SEQ ID NO: 14075 - DNA, 20 bp, Artificial Sequence
  Artificially Synthesized Primer Sequence
atcgccagtcaacgatgttt

SEQ ID NO: 14076 - DNA, 20 bp, Artificial Sequence
  Artificially Synthesized Primer Sequence
tttagggcatttctgttggc

SEQ ID NO: 14077 - DNA, 20 bp, Artificial Sequence
  Artificially Synthesized Primer Sequence
cataaggcttccaggttcca

SEQ ID NO: 14078 - DNA, 20 bp, Artificial Sequence
  Artificially Synthesized Primer Sequence
ctgtgatgctccagccagta

SEQ ID NO: 14079 - DNA, 20 bp, Artificial Sequence
  Artificially Synthesized Primer Sequence
atggccaaaactgtgatgct

SEQ ID NO: 14080 - DNA, 20 bp, Artificial Sequence
  Artificially Synthesized Primer Sequence
cataaggcttccaggttcca

SEQ ID NO: 14081 - DNA, 20 bp, Artificial Sequence
  Artificially Synthesized Primer Sequence
acacaccccttttctttccc

SEQ ID NO: 14082 - DNA, 20 bp, Artificial Sequence
  Artificially Synthesized Primer Sequence
aggggagaggagacgtagga

SEQ ID NO: 14083 - DNA, 20 bp, Artificial Sequence
  Artificially Synthesized Primer Sequence
accgatctcgcaattacagg

SEQ ID NO: 14084 - DNA, 20 bp, Artificial Sequence
  Artificially Synthesized Primer Sequence
tgaagcacgggaggataaag

SEQ ID NO: 14085 - DNA, 20 bp, Artificial Sequence
  Artificially Synthesized Primer Sequence
ggcatcttggatgagggtta

SEQ ID NO: 14086 - DNA, 20 bp, Artificial Sequence
  Artificially Synthesized Primer Sequence
tctacaaccacaccgccata

SEQ ID NO: 14087 - DNA, 20 bp, Artificial Sequence
  Artificially Synthesized Primer Sequence
gccataaccgatgcgtaagt

SEQ ID NO: 14088 - DNA, 20 bp, Artificial Sequence
  Artificially Synthesized Primer Sequence
tcggtacaatgattgctgga

SEQ ID NO: 14089 - DNA, 20 bp, Artificial Sequence
  Artificially Synthesized Primer Sequence
taggccttgaggtccttcct

SEQ ID NO: 14090 - DNA, 20 bp, Artificial Sequence
  Artificially Synthesized Primer Sequence
gctcactcttaggcacccag

SEQ ID NO: 14091 - DNA, 20 bp, Artificial Sequence
  Artificially Synthesized Primer Sequence
ctcactgccctcaatcagtg

SEQ ID NO: 14092 - DNA, 20 bp, Artificial Sequence
  Artificially Synthesized Primer Sequence
taggccttgaggtccttcct

SEQ ID NO: 14093 - DNA, 20 bp, Artificial Sequence
  Artificially Synthesized Primer Sequence
cttgcccaatttgtcgattt

SEQ ID NO: 14094 - DNA, 20 bp, Artificial Sequence
  Artificially Synthesized Primer Sequence
ggttacaagccaagccacat

SEQ ID NO: 14095 - DNA, 20 bp, Artificial Sequence
  Artificially Synthesized Primer Sequence
ggaaaaggcatgacagagga

SEQ ID NO: 14096 - DNA, 20 bp, Artificial Sequence
  Artificially Synthesized Primer Sequence
gtgcttgcacaaaatgatcg

SEQ ID NO: 14097 - DNA, 20 bp, Artificial Sequence
  Artificially Synthesized Primer Sequence
cccaaggacaaggctatcaa

SEQ ID NO: 14098 - DNA, 20 bp, Artificial Sequence
  Artificially Synthesized Primer Sequence
aactagatcaatgcacgggg

SEQ ID NO: 14099 - DNA, 20 bp, Artificial Sequence
  Artificially Synthesized Primer Sequence
gcaaccacagacaaaccaaa

SEQ ID NO: 14100 - DNA, 20 bp, Artificial Sequence
  Artificially Synthesized Primer Sequence
catccatgctcacattgtcc

SEQ ID NO: 14101 - DNA, 20 bp, Artificial Sequence
  Artificially Synthesized Primer Sequence
ttgttggcctactggagtca

SEQ ID NO: 14102 - DNA, 20 bp, Artificial Sequence
  Artificially Synthesized Primer Sequence
acctcgtcgtacacccactc

SEQ ID NO: 14103 - DNA, 20 bp, Artificial Sequence
  Artificially Synthesized Primer Sequence
attatagccatggcgtccac

SEQ ID NO: 14104 - DNA, 20 bp, Artificial Sequence
  Artificially Synthesized Primer Sequence
ggtgtatagcgagcagtggg

SEQ ID NO: 14105 - DNA, 20 bp, Artificial Sequence
  Artificially Synthesized Primer Sequence
ggccattattctgcaaggaa

SEQ ID NO: 14106 - DNA, 20 bp, Artificial Sequence
  Artificially Synthesized Primer Sequence
gcctgattcacatgggttct

SEQ ID NO: 14107 - DNA, 20 bp, Artificial Sequence
  Artificially Synthesized Primer Sequence
cgggcattaaacggttacaa

SEQ ID NO: 14108 - DNA, 20 bp, Artificial Sequence
  Artificially Synthesized Primer Sequence
agaacccatgtgaatcaggc

SEQ ID NO: 14109 - DNA, 20 bp, Artificial Sequence
  Artificially Synthesized Primer Sequence
aattcctcgagcactgttgg

SEQ ID NO: 14110 - DNA, 20 bp, Artificial Sequence
  Artificially Synthesized Primer Sequence
aggtgcagagagaaaggcag

SEQ ID NO: 14111 - DNA, 20 bp, Artificial Sequence
  Artificially Synthesized Primer Sequence
atttctgctcagttgccgat

SEQ ID NO: 14112 - DNA, 20 bp, Artificial Sequence
  Artificially Synthesized Primer Sequence
gacttgtatccacctgcgct

SEQ ID NO: 14113 - DNA, 20 bp, Artificial Sequence
  Artificially Synthesized Primer Sequence
tcaaactcttcccacaaccc

SEQ ID NO: 14114 - DNA, 20 bp, Artificial Sequence
  Artificially Synthesized Primer Sequence
tgatggaaccctttcctctg

SEQ ID NO: 14115 - DNA, 20 bp, Artificial Sequence
  Artificially Synthesized Primer Sequence
ctgcaacattgtcagttcgg

SEQ ID NO: 14116 - DNA, 20 bp, Artificial Sequence
  Artificially Synthesized Primer Sequence
tagtagtcctgggtccgtgg

SEQ ID NO: 14117 - DNA, 20 bp, Artificial Sequence
  Artificially Synthesized Primer Sequence
cactggttgatgctgttgct

SEQ ID NO: 14118 - DNA, 20 bp, Artificial Sequence
  Artificially Synthesized Primer Sequence
gcagcaactctcaagttccc

SEQ ID NO: 14119 - DNA, 20 bp, Artificial Sequence
  Artificially Synthesized Primer Sequence
tggtgctctatgtgtcgctc

SEQ ID NO: 14120 - DNA, 20 bp, Artificial Sequence
  Artificially Synthesized Primer Sequence
cactggttgatgctgttgct

SEQ ID NO: 14121 - DNA, 20 bp, Artificial Sequence
  Artificially Synthesized Primer Sequence
aggtgtacgtcctcacccag

SEQ ID NO: 14122 - DNA, 20 bp, Artificial Sequence
  Artificially Synthesized Primer Sequence
ctgtcgtcaataggcaagca

SEQ ID NO: 14123 - DNA, 20 bp, Artificial Sequence
  Artificially Synthesized Primer Sequence
caccgagttcttcagcacaa

SEQ ID NO: 14124 - DNA, 20 bp, Artificial Sequence
  Artificially Synthesized Primer Sequence
ggggagaacacttcgattca

SEQ ID NO: 14125 - DNA, 20 bp, Artificial Sequence
  Artificially Synthesized Primer Sequence
atcggtggagtgatggtagc

SEQ ID NO: 14126 - DNA, 20 bp, Artificial Sequence
  Artificially Synthesized Primer Sequence
cggtggaaatggagaaagaa

SEQ ID NO: 14127 - DNA, 20 bp, Artificial Sequence
  Artificially Synthesized Primer Sequence
actgatgactcaaaaccggg

SEQ ID NO: 14128 - DNA, 20 bp, Artificial Sequence
  Artificially Synthesized Primer Sequence
cccaaccatcctctcaacag

SEQ ID NO: 14129 - DNA, 20 bp, Artificial Sequence
  Artificially Synthesized Primer Sequence
agaggcctgctatggggtat

SEQ ID NO: 14130 - DNA, 20 bp, Artificial Sequence
  Artificially Synthesized Primer Sequence
ggatagccatttgcctacga

SEQ ID NO: 14131 - DNA, 20 bp, Artificial Sequence
  Artificially Synthesized Primer Sequence
gccttggatcatctcatcgt

SEQ ID NO: 14132 - DNA, 20 bp, Artificial Sequence
  Artificially Synthesized Primer Sequence
gtaggcaaatggctatccga

SEQ ID NO: 14133 - DNA, 20 bp, Artificial Sequence
  Artificially Synthesized Primer Sequence
aaagtaccccacattctgcg

SEQ ID NO: 14134 - DNA, 20 bp, Artificial Sequence
  Artificially Synthesized Primer Sequence
ggatccaatcaaggaagcaa

SEQ ID NO: 14135 - DNA, 20 bp, Artificial Sequence
  Artificially Synthesized Primer Sequence
agatacggcgaaccacattc

SEQ ID NO: 14136 - DNA, 20 bp, Artificial Sequence
  Artificially Synthesized Primer Sequence
aactggtcgaaatgaggtgg

SEQ ID NO: 14137 - DNA, 20 bp, Artificial Sequence
  Artificially Synthesized Primer Sequence
gccatttcaccaaagacgat

SEQ ID NO: 14138 - DNA, 20 bp, Artificial Sequence
  Artificially Synthesized Primer Sequence
ctcatgtggttcagcaggaa

SEQ ID NO: 14139 - DNA, 20 bp, Artificial Sequence
  Artificially Synthesized Primer Sequence
ctggagtgaaccatgctgaa

SEQ ID NO: 14140 - DNA, 20 bp, Artificial Sequence
  Artificially Synthesized Primer Sequence
ttccatccccttacaactgc

SEQ ID NO: 14141 - DNA, 20 bp, Artificial Sequence
  Artificially Synthesized Primer Sequence
aggggtacggggtgaataac

SEQ ID NO: 14142 - DNA, 20 bp, Artificial Sequence
  Artificially Synthesized Primer Sequence
atccatcactggtcagaggg

SEQ ID NO: 14143 - DNA, 22 bp, Artificial Sequence
  Artificially Synthesized Primer Sequence
caggtccatgattgattgattg

SEQ ID NO: 14144 - DNA, 20 bp, Artificial Sequence
  Artificially Synthesized Primer Sequence
tgtgaatgcagatgcaaggt

SEQ ID NO: 14145 - DNA, 20 bp, Artificial Sequence
  Artificially Synthesized Primer Sequence
gagttcaccaagctcaagcc

SEQ ID NO: 14146 - DNA, 20 bp, Artificial Sequence
  Artificially Synthesized Primer Sequence
cagtctgccacctcctcttc

SEQ ID NO: 14147 - DNA, 20 bp, Artificial Sequence
  Artificially Synthesized Primer Sequence
gctagccatgcttcaaaagg

SEQ ID NO: 14148 - DNA, 20 bp, Artificial Sequence
  Artificially Synthesized Primer Sequence
agtgaagaggaggtggcaga

SEQ ID NO: 14149 - DNA, 20 bp, Artificial Sequence
  Artificially Synthesized Primer Sequence
ttatctttgacctcggtggc

SEQ ID NO: 14150 - DNA, 20 bp, Artificial Sequence
  Artificially Synthesized Primer Sequence
tccctcagacattctcccac

SEQ ID NO: 14151 - DNA, 20 bp, Artificial Sequence
  Artificially Synthesized Primer Sequence
ccagcaccctggtacatctt

SEQ ID NO: 14152 - DNA, 20 bp, Artificial Sequence
  Artificially Synthesized Primer Sequence
ccttcttggcaagtttgagc

SEQ ID NO: 14153 - DNA, 20 bp, Artificial Sequence
  Artificially Synthesized Primer Sequence
tcgcagtgtttgacttcgac

SEQ ID NO: 14154 - DNA, 20 bp, Artificial Sequence
  Artificially Synthesized Primer Sequence
gggatctttcgacacggtaa

SEQ ID NO: 14155 - DNA, 20 bp, Artificial Sequence
  Artificially Synthesized Primer Sequence
gggatctttcgacacggtaa

SEQ ID NO: 14156 - DNA, 20 bp, Artificial Sequence
  Artificially Synthesized Primer Sequence
tcgcagtgtttgacttcgac

SEQ ID NO: 14157 - DNA, 20 bp, Artificial Sequence
  Artificially Synthesized Primer Sequence
tgagtcatcgctccatcttg

SEQ ID NO: 14158 - DNA, 20 bp, Artificial Sequence
  Artificially Synthesized Primer Sequence
ctcctttctcctgacgcttg

SEQ ID NO: 14159 - DNA, 20 bp, Artificial Sequence
  Artificially Synthesized Primer Sequence
aagccatatgaggagcatgg

SEQ ID NO: 14160 - DNA, 20 bp, Artificial Sequence
  Artificially Synthesized Primer Sequence
aagcaacacaggaggtggtc

SEQ ID NO: 14161 - DNA, 20 bp, Artificial Sequence
  Artificially Synthesized Primer Sequence
attcgagggagcaagtttga

SEQ ID NO: 14162 - DNA, 20 bp, Artificial Sequence
  Artificially Synthesized Primer Sequence
gagagagaaaacagcacggg

SEQ ID NO: 14163 - DNA, 20 bp, Artificial Sequence
  Artificially Synthesized Primer Sequence
aggcatcaacggaaaatgac

SEQ ID NO: 14164 - DNA, 20 bp, Artificial Sequence
  Artificially Synthesized Primer Sequence
acgtcttccttcttttcgca

SEQ ID NO: 14165 - DNA, 20 bp, Artificial Sequence
  Artificially Synthesized Primer Sequence
gcattggtggaaaaggagaa

SEQ ID NO: 14166 - DNA, 20 bp, Artificial Sequence
  Artificially Synthesized Primer Sequence
aatgcttggtaaacgatggc

SEQ ID NO: 14167 - DNA, 20 bp, Artificial Sequence
  Artificially Synthesized Primer Sequence
tcattttcctacgtggagcc

SEQ ID NO: 14168 - DNA, 20 bp, Artificial Sequence
  Artificially Synthesized Primer Sequence
cagctgaatgttgggactca

SEQ ID NO: 14169 - DNA, 20 bp, Artificial Sequence
  Artificially Synthesized Primer Sequence
tgatagacctcgttttgggc

SEQ ID NO: 14170 - DNA, 20 bp, Artificial Sequence
  Artificially Synthesized Primer Sequence
gtctcgaggcttcttgcatc

SEQ ID NO: 14171 - DNA, 20 bp, Artificial Sequence
  Artificially Synthesized Primer Sequence
aacgacactatacgaccggc

SEQ ID NO: 14172 - DNA, 20 bp, Artificial Sequence
  Artificially Synthesized Primer Sequence
gcaagaagcctcgagacagt

SEQ ID NO: 14173 - DNA, 20 bp, Artificial Sequence
  Artificially Synthesized Primer Sequence
caattcggctcagcactaca

SEQ ID NO: 14174 - DNA, 20 bp, Artificial Sequence
  Artificially Synthesized Primer Sequence
tttttccaccttcacggttc

SEQ ID NO: 14175 - DNA, 20 bp, Artificial Sequence
  Artificially Synthesized Primer Sequence
acatgtcggagaagtccagg

SEQ ID NO: 14176 - DNA, 20 bp, Artificial Sequence
  Artificially Synthesized Primer Sequence
accaggaacagtgaaggtgg

SEQ ID NO: 14177 - DNA, 20 bp, Artificial Sequence
  Artificially Synthesized Primer Sequence
ttctgttggccaggattacc

SEQ ID NO: 14178 - DNA, 20 bp, Artificial Sequence
  Artificially Synthesized Primer Sequence
tacatgcctcatagagcccc

SEQ ID NO: 14179 - DNA, 20 bp, Artificial Sequence
  Artificially Synthesized Primer Sequence
atggggcaagcatctacaag

SEQ ID NO: 14180 - DNA, 20 bp, Artificial Sequence
  Artificially Synthesized Primer Sequence
ttcaagaccaaggagagcgt

SEQ ID NO: 14181 - DNA, 20 bp, Artificial Sequence
  Artificially Synthesized Primer Sequence
cctgggctggtctttctgta

SEQ ID NO: 14182 - DNA, 20 bp, Artificial Sequence
  Artificially Synthesized Primer Sequence
acaaagctctccttgccaaa

SEQ ID NO: 14183 - DNA, 20 bp, Artificial Sequence
  Artificially Synthesized Primer Sequence
aatccggtggtcttcaacag

SEQ ID NO: 14184 - DNA, 20 bp, Artificial Sequence
  Artificially Synthesized Primer Sequence
cggttcctttagcaaacctg

SEQ ID NO: 14185 - DNA, 20 bp, Artificial Sequence
  Artificially Synthesized Primer Sequence
cctggatatgaggcacgatt

SEQ ID NO: 14186 - DNA, 20 bp, Artificial Sequence
  Artificially Synthesized Primer Sequence
tgacccctggatgatggtat

SEQ ID NO: 14187 - DNA, 20 bp, Artificial Sequence
  Artificially Synthesized Primer Sequence
ccggatccatgctaaacttc

SEQ ID NO: 14188 - DNA, 20 bp, Artificial Sequence
  Artificially Synthesized Primer Sequence
gcaacaggcaaatcacactg

SEQ ID NO: 14189 - DNA, 20 bp, Artificial Sequence
  Artificially Synthesized Primer Sequence
tctccccctttcgtcttttt

SEQ ID NO: 14190 - DNA, 20 bp, Artificial Sequence
  Artificially Synthesized Primer Sequence
acggggaaatatagggatcg

SEQ ID NO: 14191 - DNA, 20 bp, Artificial Sequence
  Artificially Synthesized Primer Sequence
aagagtagggcgagagaggc

SEQ ID NO: 14192 - DNA, 20 bp, Artificial Sequence
  Artificially Synthesized Primer Sequence
aggaatgtacgacctcacgg

SEQ ID NO: 14193 - DNA, 20 bp, Artificial Sequence
  Artificially Synthesized Primer Sequence
tgttgcttctcgtggtcttg

SEQ ID NO: 14194 - DNA, 20 bp, Artificial Sequence
  Artificially Synthesized Primer Sequence
atggctaatcagggaacgtg

SEQ ID NO: 14195 - DNA, 20 bp, Artificial Sequence
  Artificially Synthesized Primer Sequence
agatcgacacacaagggagg

SEQ ID NO: 14196 - DNA, 20 bp, Artificial Sequence
  Artificially Synthesized Primer Sequence
gcgagaagatcaaaccgttc

SEQ ID NO: 14197 - DNA, 20 bp, Artificial Sequence
  Artificially Synthesized Primer Sequence
gaccttcacaagagccaagc

SEQ ID NO: 14198 - DNA, 20 bp, Artificial Sequence
  Artificially Synthesized Primer Sequence
aggcgtgctcaacatcttct

SEQ ID NO: 14199 - DNA, 20 bp, Artificial Sequence
  Artificially Synthesized Primer Sequence
tcgcttaattgcagcaacac

SEQ ID NO: 14200 - DNA, 20 bp, Artificial Sequence
  Artificially Synthesized Primer Sequence
agcagcggagaagaagtgaa

SEQ ID NO: 14201 - DNA, 20 bp, Artificial Sequence
  Artificially Synthesized Primer Sequence
gttggacacaccatgtgagc

SEQ ID NO: 14202 - DNA, 20 bp, Artificial Sequence
  Artificially Synthesized Primer Sequence
ccacagcacacgagaaaaga

SEQ ID NO: 14203 - DNA, 20 bp, Artificial Sequence
  Artificially Synthesized Primer Sequence
cgtccacacaatccaccata

SEQ ID NO: 14204 - DNA, 20 bp, Artificial Sequence
  Artificially Synthesized Primer Sequence
ctgttcgataaggggtggaa

SEQ ID NO: 14205 - DNA, 20 bp, Artificial Sequence
  Artificially Synthesized Primer Sequence
ggacagctacctgcaagagg

SEQ ID NO: 14206 - DNA, 20 bp, Artificial Sequence
  Artificially Synthesized Primer Sequence
ccatctgggtcacagttcct

SEQ ID NO: 14207 - DNA, 20 bp, Artificial Sequence
  Artificially Synthesized Primer Sequence
ttgacagaaaatagcgcagc

SEQ ID NO: 14208 - DNA, 20 bp, Artificial Sequence
  Artificially Synthesized Primer Sequence
gaatcagaagagagggcacg

SEQ ID NO: 14209 - DNA, 20 bp, Artificial Sequence
  Artificially Synthesized Primer Sequence
ggaatcaagggtttgacgaa

SEQ ID NO: 14210 - DNA, 20 bp, Artificial Sequence
  Artificially Synthesized Primer Sequence
actgtgcttctgcctcacct

SEQ ID NO: 14211 - DNA, 20 bp, Artificial Sequence
  Artificially Synthesized Primer Sequence
ctctagcaggaagcagcgtt

SEQ ID NO: 14212 - DNA, 20 bp, Artificial Sequence
  Artificially Synthesized Primer Sequence
gcgatagatattccccagca

SEQ ID NO: 14213 - DNA, 20 bp, Artificial Sequence
  Artificially Synthesized Primer Sequence
ccccacggggatagtatctt

SEQ ID NO: 14214 - DNA, 20 bp, Artificial Sequence
  Artificially Synthesized Primer Sequence
tgctaatgagtcatgcctgg

SEQ ID NO: 14215 - DNA, 20 bp, Artificial Sequence
  Artificially Synthesized Primer Sequence
tcagcacacaagaggcattc

SEQ ID NO: 14216 - DNA, 20 bp, Artificial Sequence
  Artificially Synthesized Primer Sequence
gtttttctgtaaccccgcaa

SEQ ID NO: 14217 - DNA, 20 bp, Artificial Sequence
  Artificially Synthesized Primer Sequence
aggcctagtaccccacgagt

SEQ ID NO: 14218 - DNA, 20 bp, Artificial Sequence
  Artificially Synthesized Primer Sequence
ttccagcataaattggcctc

SEQ ID NO: 14219 - DNA, 19 bp, Artificial Sequence
  Artificially Synthesized Primer Sequence
tcatctctgggcatgcagt

SEQ ID NO: 14220 - DNA, 20 bp, Artificial Sequence
  Artificially Synthesized Primer Sequence
gagtttcaggggcgatacaa

SEQ ID NO: 14221 - DNA, 20 bp, Artificial Sequence
  Artificially Synthesized Primer Sequence
ctccttcaaaggcacagagg

SEQ ID NO: 14222 - DNA, 20 bp, Artificial Sequence
  Artificially Synthesized Primer Sequence
ttccttctcattgtcagggg

SEQ ID NO: 14223 - DNA, 20 bp, Artificial Sequence
  Artificially Synthesized Primer Sequence
caatacagcgacggactcaa

SEQ ID NO: 14224 - DNA, 20 bp, Artificial Sequence
  Artificially Synthesized Primer Sequence
gtttgaggagatgcagaggc

SEQ ID NO: 14225 - DNA, 20 bp, Artificial Sequence
  Artificially Synthesized Primer Sequence
gtccatgactttagcgggaa

SEQ ID NO: 14226 - DNA, 20 bp, Artificial Sequence
  Artificially Synthesized Primer Sequence
ttaccagtgatgcacccaaa

SEQ ID NO: 14227 - DNA, 20 bp, Artificial Sequence
  Artificially Synthesized Primer Sequence
tttatcgccagcatgaacaa

SEQ ID NO: 14228 - DNA, 20 bp, Artificial Sequence
  Artificially Synthesized Primer Sequence
tttgggtgcatcactggtaa

SEQ ID NO: 14229 - DNA, 20 bp, Artificial Sequence
  Artificially Synthesized Primer Sequence
gcattccaaagagggaaaca

SEQ ID NO: 14230 - DNA, 20 bp, Artificial Sequence
  Artificially Synthesized Primer Sequence
aagcacgccagagtttgtct

SEQ ID NO: 14231 - DNA, 20 bp, Artificial Sequence
  Artificially Synthesized Primer Sequence
ccaaaaggtagcaaacaggc

SEQ ID NO: 14232 - DNA, 20 bp, Artificial Sequence
  Artificially Synthesized Primer Sequence
agcagtcgacgaggacaaat

SEQ ID NO: 14233 - DNA, 20 bp, Artificial Sequence
  Artificially Synthesized Primer Sequence
cagcgtgaaattcaaaagca

SEQ ID NO: 14234 - DNA, 20 bp, Artificial Sequence
  Artificially Synthesized Primer Sequence
cctgtcgcccttgtacatct

SEQ ID NO: 14235 - DNA, 20 bp, Artificial Sequence
  Artificially Synthesized Primer Sequence
ttcctcatccctcacctctc

SEQ ID NO: 14236 - DNA, 20 bp, Artificial Sequence
  Artificially Synthesized Primer Sequence
cctgtcgcccttgtacatct

SEQ ID NO: 14237 - DNA, 20 bp, Artificial Sequence
  Artificially Synthesized Primer Sequence
aacatgtttatcttcggcgg

SEQ ID NO: 14238 - DNA, 20 bp, Artificial Sequence
  Artificially Synthesized Primer Sequence
ccctttaaagcccagaggtc

SEQ ID NO: 14239 - DNA, 20 bp, Artificial Sequence
  Artificially Synthesized Primer Sequence
ttcctcgtcaattttgctca

SEQ ID NO: 14240 - DNA, 21 bp, Artificial Sequence
  Artificially Synthesized Primer Sequence
tgctgagggactatcaacgtc

SEQ ID NO: 14241 - DNA, 20 bp, Artificial Sequence
  Artificially Synthesized Primer Sequence
cctggcagagtccaagaaag

SEQ ID NO: 14242 - DNA, 20 bp, Artificial Sequence
  Artificially Synthesized Primer Sequence
cgaagaaccttctttgccag

SEQ ID NO: 14243 - DNA, 20 bp, Artificial Sequence
  Artificially Synthesized Primer Sequence
attcgatcaataggttgcgg

SEQ ID NO: 14244 - DNA, 20 bp, Artificial Sequence
  Artificially Synthesized Primer Sequence
aggcatgcttaagaagctcg

SEQ ID NO: 14245 - DNA, 20 bp, Artificial Sequence
  Artificially Synthesized Primer Sequence
ggagaagcttgcctatgtcg

SEQ ID NO: 14246 - DNA, 20 bp, Artificial Sequence
  Artificially Synthesized Primer Sequence
gccacgaccttgatcttcat

SEQ ID NO: 14247 - DNA, 20 bp, Artificial Sequence
  Artificially Synthesized Primer Sequence
acacgcaccggctaaatatc

SEQ ID NO: 14248 - DNA, 20 bp, Artificial Sequence
  Artificially Synthesized Primer Sequence
ctcagtggagggacaaccat

SEQ ID NO: 14249 - DNA, 20 bp, Artificial Sequence
  Artificially Synthesized Primer Sequence
aacatgtttatcttcggcgg

SEQ ID NO: 14250 - DNA, 20 bp, Artificial Sequence
  Artificially Synthesized Primer Sequence
ccctttaaagcccagaggtc

SEQ ID NO: 14251 - DNA, 20 bp, Artificial Sequence
  Artificially Synthesized Primer Sequence
agtctgtttgcttgcttgcc

SEQ ID NO: 14252 - DNA, 20 bp, Artificial Sequence
  Artificially Synthesized Primer Sequence
caggcacttcgtgatcattg

SEQ ID NO: 14253 - DNA, 20 bp, Artificial Sequence
  Artificially Synthesized Primer Sequence
agtgcaagacggcttctgat

SEQ ID NO: 14254 - DNA, 20 bp, Artificial Sequence
  Artificially Synthesized Primer Sequence
agtctcacggaaggagacga

SEQ ID NO: 14255 - DNA, 20 bp, Artificial Sequence
  Artificially Synthesized Primer Sequence
agcaagggcaagtagcaaaa

SEQ ID NO: 14256 - DNA, 20 bp, Artificial Sequence
  Artificially Synthesized Primer Sequence
gaatgcgcttggtggtatct

SEQ ID NO: 14257 - DNA, 20 bp, Artificial Sequence
  Artificially Synthesized Primer Sequence
gtttgagaacaccaagggga

SEQ ID NO: 14258 - DNA, 20 bp, Artificial Sequence
  Artificially Synthesized Primer Sequence
caacaagataaagcggccat

SEQ ID NO: 14259 - DNA, 20 bp, Artificial Sequence
  Artificially Synthesized Primer Sequence
ttcccatctgctcgctttat

SEQ ID NO: 14260 - DNA, 20 bp, Artificial Sequence
  Artificially Synthesized Primer Sequence
catggttgtgaagaacaccg

SEQ ID NO: 14261 - DNA, 20 bp, Artificial Sequence
  Artificially Synthesized Primer Sequence
ggagatgaaggtctccacca

SEQ ID NO: 14262 - DNA, 20 bp, Artificial Sequence
  Artificially Synthesized Primer Sequence
agacagggaagacagacgga

SEQ ID NO: 14263 - DNA, 20 bp, Artificial Sequence
  Artificially Synthesized Primer Sequence
atgcaccacgaaaccataca

SEQ ID NO: 14264 - DNA, 20 bp, Artificial Sequence
  Artificially Synthesized Primer Sequence
cctgacgattattgccgatt

SEQ ID NO: 14265 - DNA, 20 bp, Artificial Sequence
  Artificially Synthesized Primer Sequence
gtggaggccaagtacgtgat

SEQ ID NO: 14266 - DNA, 20 bp, Artificial Sequence
  Artificially Synthesized Primer Sequence
tgctcaatgaacagggtacg

SEQ ID NO: 14267 - DNA, 20 bp, Artificial Sequence
  Artificially Synthesized Primer Sequence
cagccacagagcacacaaat

SEQ ID NO: 14268 - DNA, 20 bp, Artificial Sequence
  Artificially Synthesized Primer Sequence
cgacatcaccggattctaca

SEQ ID NO: 14269 - DNA, 20 bp, Artificial Sequence
  Artificially Synthesized Primer Sequence
ttcccaaattttagcgaacg

SEQ ID NO: 14270 - DNA, 20 bp, Artificial Sequence
  Artificially Synthesized Primer Sequence
aaaggaaataagggcggaga

SEQ ID NO: 14271 - DNA, 20 bp, Artificial Sequence
  Artificially Synthesized Primer Sequence
cgctagtgaagtttctcggg

SEQ ID NO: 14272 - DNA, 20 bp, Artificial Sequence
  Artificially Synthesized Primer Sequence
atcggtatgagaatgaccgc

SEQ ID NO: 14273 - DNA, 20 bp, Artificial Sequence
  Artificially Synthesized Primer Sequence
tggaccgaggagagaaagaa

SEQ ID NO: 14274 - DNA, 20 bp, Artificial Sequence
  Artificially Synthesized Primer Sequence
ataacaatgcagaccagccc

SEQ ID NO: 14275 - DNA, 20 bp, Artificial Sequence
  Artificially Synthesized Primer Sequence
ggtttgaataaccgacaccg

SEQ ID NO: 14276 - DNA, 20 bp, Artificial Sequence
  Artificially Synthesized Primer Sequence
tggaccgaggagagaaagaa

SEQ ID NO: 14277 - DNA, 20 bp, Artificial Sequence
  Artificially Synthesized Primer Sequence
ggagcaacaatgccgtatct

SEQ ID NO: 14278 - DNA, 20 bp, Artificial Sequence
  Artificially Synthesized Primer Sequence
ttgatcaacatcggcttcaa

SEQ ID NO: 14279 - DNA, 20 bp, Artificial Sequence
  Artificially Synthesized Primer Sequence
tgcacataagcaaacacgct

SEQ ID NO: 14280 - DNA, 20 bp, Artificial Sequence
  Artificially Synthesized Primer Sequence
ggagcaacaatgccgtatct

SEQ ID NO: 14281 - DNA, 20 bp, Artificial Sequence
  Artificially Synthesized Primer Sequence
atatccgggaccaacaacaa

SEQ ID NO: 14282 - DNA, 20 bp, Artificial Sequence
  Artificially Synthesized Primer Sequence
acacaacatgattgctccca

SEQ ID NO: 14283 - DNA, 20 bp, Artificial Sequence
  Artificially Synthesized Primer Sequence
acacaacatgattgctccca

SEQ ID NO: 14284 - DNA, 20 bp, Artificial Sequence
  Artificially Synthesized Primer Sequence
tgccattgtatgtgaagcgt

SEQ ID NO: 14285 - DNA, 20 bp, Artificial Sequence
  Artificially Synthesized Primer Sequence
aatttcgtagtgctgtgggc

SEQ ID NO: 14286 - DNA, 20 bp, Artificial Sequence
  Artificially Synthesized Primer Sequence
aatgaccttcgccaccatac

SEQ ID NO: 14287 - DNA, 20 bp, Artificial Sequence
  Artificially Synthesized Primer Sequence
aatgaccttcgccaccatac

SEQ ID NO: 14288 - DNA, 20 bp, Artificial Sequence
  Artificially Synthesized Primer Sequence
aatttcgtagtgctgtgggc

SEQ ID NO: 14289 - DNA, 20 bp, Artificial Sequence
  Artificially Synthesized Primer Sequence
aacattgtatctgggagcgg

SEQ ID NO: 14290 - DNA, 20 bp, Artificial Sequence
  Artificially Synthesized Primer Sequence
gctgtgcaggtcagcattta

SEQ ID NO: 14291 - DNA, 20 bp, Artificial Sequence
  Artificially Synthesized Primer Sequence
gctgtgcaggtcagcattta

SEQ ID NO: 14292 - DNA, 20 bp, Artificial Sequence
  Artificially Synthesized Primer Sequence
aacattgtatctgggagcgg

SEQ ID NO: 14293 - DNA, 20 bp, Artificial Sequence
  Artificially Synthesized Primer Sequence
ccccagatcactctctctgg

SEQ ID NO: 14294 - DNA, 20 bp, Artificial Sequence
  Artificially Synthesized Primer Sequence
ccacttgcgcacattaaaga

SEQ ID NO: 14295 - DNA, 20 bp, Artificial Sequence
  Artificially Synthesized Primer Sequence
tttttgttgctgtctgctgc

SEQ ID NO: 14296 - DNA, 20 bp, Artificial Sequence
  Artificially Synthesized Primer Sequence
ttcttctgaccgacgactga

SEQ ID NO: 14297 - DNA, 20 bp, Artificial Sequence
  Artificially Synthesized Primer Sequence
aggaggaggagagcaaggag

SEQ ID NO: 14298 - DNA, 20 bp, Artificial Sequence
  Artificially Synthesized Primer Sequence
tcggattttctaatccagcg

SEQ ID NO: 14299 - DNA, 20 bp, Artificial Sequence
  Artificially Synthesized Primer Sequence
tttttaacaacaaaggggcg

SEQ ID NO: 14300 - DNA, 20 bp, Artificial Sequence
  Artificially Synthesized Primer Sequence
gcaaggggatgcctacctat

SEQ ID NO: 14301 - DNA, 20 bp, Artificial Sequence
  Artificially Synthesized Primer Sequence
ttgtcaatcaggcaattgga

SEQ ID NO: 14302 - DNA, 20 bp, Artificial Sequence
  Artificially Synthesized Primer Sequence
gtactctttgcaccgccttc

SEQ ID NO: 14303 - DNA, 20 bp, Artificial Sequence
  Artificially Synthesized Primer Sequence
cgcttagttagggtagggca

SEQ ID NO: 14304 - DNA, 21 bp, Artificial Sequence
  Artificially Synthesized Primer Sequence
tccaggactagacgggatatg

SEQ ID NO: 14305 - DNA, 20 bp, Artificial Sequence
  Artificially Synthesized Primer Sequence
gataagctggattgcgggta

SEQ ID NO: 14306 - DNA, 20 bp, Artificial Sequence
  Artificially Synthesized Primer Sequence
cttttaagaagggaaccggg

SEQ ID NO: 14307 - DNA, 20 bp, Artificial Sequence
  Artificially Synthesized Primer Sequence
aaaaaccagggacccaaaac

SEQ ID NO: 14308 - DNA, 20 bp, Artificial Sequence
  Artificially Synthesized Primer Sequence
tctgcctcaacttgtgttgc

SEQ ID NO: 14309 - DNA, 20 bp, Artificial Sequence
  Artificially Synthesized Primer Sequence
caacaagttccagcagacca

SEQ ID NO: 14310 - DNA, 20 bp, Artificial Sequence
  Artificially Synthesized Primer Sequence
ctcgtgcttgatgaggttga

SEQ ID NO: 14311 - DNA, 20 bp, Artificial Sequence
  Artificially Synthesized Primer Sequence
gtacccctctcaatcccctc

SEQ ID NO: 14312 - DNA, 20 bp, Artificial Sequence
  Artificially Synthesized Primer Sequence
atccagttcctcgacaccac

SEQ ID NO: 14313 - DNA, 20 bp, Artificial Sequence
  Artificially Synthesized Primer Sequence
ggtgcaattactggcgctat

SEQ ID NO: 14314 - DNA, 20 bp, Artificial Sequence
  Artificially Synthesized Primer Sequence
ctggaagaagaagcactgcc

SEQ ID NO: 14315 - DNA, 20 bp, Artificial Sequence
  Artificially Synthesized Primer Sequence
ctggaagaagaagcactgcc

SEQ ID NO: 14316 - DNA, 20 bp, Artificial Sequence
  Artificially Synthesized Primer Sequence
ggtgcaattactggcgctat

SEQ ID NO: 14317 - DNA, 20 bp, Artificial Sequence
  Artificially Synthesized Primer Sequence
gtccagagcaataagagcgg

SEQ ID NO: 14318 - DNA, 20 bp, Artificial Sequence
  Artificially Synthesized Primer Sequence
cctgcagggaaggtacacat

SEQ ID NO: 14319 - DNA, 20 bp, Artificial Sequence
  Artificially Synthesized Primer Sequence
gggaacttgacagcaacgat

SEQ ID NO: 14320 - DNA, 20 bp, Artificial Sequence
  Artificially Synthesized Primer Sequence
tggggctgaattgctttatc

SEQ ID NO: 14321 - DNA, 20 bp, Artificial Sequence
  Artificially Synthesized Primer Sequence
atgggcttctcaatccactg

SEQ ID NO: 14322 - DNA, 20 bp, Artificial Sequence
  Artificially Synthesized Primer Sequence
aggcctgatgtcagcaaact

SEQ ID NO: 14323 - DNA, 20 bp, Artificial Sequence
  Artificially Synthesized Primer Sequence
tgttggagaagtgatcagcg

SEQ ID NO: 14324 - DNA, 20 bp, Artificial Sequence
  Artificially Synthesized Primer Sequence
aagcagatcaaggaggacga

SEQ ID NO: 14325 - DNA, 20 bp, Artificial Sequence
  Artificially Synthesized Primer Sequence
tatccacgactctcgggaac

SEQ ID NO: 14326 - DNA, 20 bp, Artificial Sequence
  Artificially Synthesized Primer Sequence
atgtgccaccatgcagtaaa

SEQ ID NO: 14327 - DNA, 20 bp, Artificial Sequence
  Artificially Synthesized Primer Sequence
cttcatcgcaacttgtgtgg

SEQ ID NO: 14328 - DNA, 20 bp, Artificial Sequence
  Artificially Synthesized Primer Sequence
gaagtacacgaccgcattga

SEQ ID NO: 14329 - DNA, 20 bp, Artificial Sequence
  Artificially Synthesized Primer Sequence
agtttatccggtggcacttg

SEQ ID NO: 14330 - DNA, 20 bp, Artificial Sequence
  Artificially Synthesized Primer Sequence
ccagttgaatttcctggcat

SEQ ID NO: 14331 - DNA, 20 bp, Artificial Sequence
  Artificially Synthesized Primer Sequence
gttggtggcaacaagcacta

SEQ ID NO: 14332 - DNA, 20 bp, Artificial Sequence
  Artificially Synthesized Primer Sequence
agtttatccggtggcacttg

SEQ ID NO: 14333 - DNA, 20 bp, Artificial Sequence
  Artificially Synthesized Primer Sequence
tgagatgcagtgtcctccag

SEQ ID NO: 14334 - DNA, 20 bp, Artificial Sequence
  Artificially Synthesized Primer Sequence
atttgttccgtgagattcgc

SEQ ID NO: 14335 - DNA, 20 bp, Artificial Sequence
  Artificially Synthesized Primer Sequence
ccatgcaaagaaacgaggtt

SEQ ID NO: 14336 - DNA, 20 bp, Artificial Sequence
  Artificially Synthesized Primer Sequence
tcgaaccatagagggtgagg

SEQ ID NO: 14337 - DNA, 20 bp, Artificial Sequence
  Artificially Synthesized Primer Sequence
ggttggtcgacgttgagatt

SEQ ID NO: 14338 - DNA, 20 bp, Artificial Sequence
  Artificially Synthesized Primer Sequence
ggtgttgagctctagccctg

SEQ ID NO: 14339 - DNA, 20 bp, Artificial Sequence
  Artificially Synthesized Primer Sequence
ggtcgacgttgagattggac

SEQ ID NO: 14340 - DNA, 19 bp, Artificial Sequence
  Artificially Synthesized Primer Sequence
gaggtgcgtaggaaacggt

SEQ ID NO: 14341 - DNA, 20 bp, Artificial Sequence
  Artificially Synthesized Primer Sequence
ctagagctcgaggaggacga

SEQ ID NO: 14342 - DNA, 20 bp, Artificial Sequence
  Artificially Synthesized Primer Sequence
acaaagaaggggctgtctga

SEQ ID NO: 14343 - DNA, 20 bp, Artificial Sequence
  Artificially Synthesized Primer Sequence
acaaagaaggggctgtctga

SEQ ID NO: 14344 - DNA, 20 bp, Artificial Sequence
  Artificially Synthesized Primer Sequence
ctagagctcgaggaggacga

SEQ ID NO: 14345 - DNA, 20 bp, Artificial Sequence
  Artificially Synthesized Primer Sequence
cctccaaactgatggaagga

SEQ ID NO: 14346 - DNA, 20 bp, Artificial Sequence
  Artificially Synthesized Primer Sequence
tctgtgtttgtgcttgagcc

SEQ ID NO: 14347 - DNA, 20 bp, Artificial Sequence
  Artificially Synthesized Primer Sequence
ccctctctctttcccactca

SEQ ID NO: 14348 - DNA, 19 bp, Artificial Sequence
  Artificially Synthesized Primer Sequence
aggacagcgtgaaggtgtg

SEQ ID NO: 14349 - DNA, 20 bp, Artificial Sequence
  Artificially Synthesized Primer Sequence
gcttagctgctagccaccac

SEQ ID NO: 14350 - DNA, 19 bp, Artificial Sequence
  Artificially Synthesized Primer Sequence
caggatgaacaccagcgtc

SEQ ID NO: 14351 - DNA, 20 bp, Artificial Sequence
  Artificially Synthesized Primer Sequence
atgcataaatcatggcagca

SEQ ID NO: 14352 - DNA, 20 bp, Artificial Sequence
  Artificially Synthesized Primer Sequence
gccacgctccactgataact

SEQ ID NO: 14353 - DNA, 20 bp, Artificial Sequence
  Artificially Synthesized Primer Sequence
tgtacgtgcttgctctccac

SEQ ID NO: 14354 - DNA, 20 bp, Artificial Sequence
  Artificially Synthesized Primer Sequence
atgcatgacgtgcgtatgtt

SEQ ID NO: 14355 - DNA, 20 bp, Artificial Sequence
  Artificially Synthesized Primer Sequence
gccatgctcacacacatacc

SEQ ID NO: 14356 - DNA, 20 bp, Artificial Sequence
  Artificially Synthesized Primer Sequence
tgtacgtgcttgctctccac

SEQ ID NO: 14357 - DNA, 20 bp, Artificial Sequence
  Artificially Synthesized Primer Sequence
atttcaaagactcccccacc

SEQ ID NO: 14358 - DNA, 20 bp, Artificial Sequence
  Artificially Synthesized Primer Sequence
atgcctcaagaacagggttg

SEQ ID NO: 14359 - DNA, 20 bp, Artificial Sequence
  Artificially Synthesized Primer Sequence
cccgcagccattaaaagata

SEQ ID NO: 14360 - DNA, 18 bp, Artificial Sequence
  Artificially Synthesized Primer Sequence
acgttggtgaacgaggga

SEQ ID NO: 14361 - DNA, 20 bp, Artificial Sequence
  Artificially Synthesized Primer Sequence
gcaagtgtccaccttgtgtg

SEQ ID NO: 14362 - DNA, 20 bp, Artificial Sequence
  Artificially Synthesized Primer Sequence
caatcgataagcactcccgt

SEQ ID NO: 14363 - DNA, 20 bp, Artificial Sequence
  Artificially Synthesized Primer Sequence
caatcgataagcactcccgt

SEQ ID NO: 14364 - DNA, 20 bp, Artificial Sequence
  Artificially Synthesized Primer Sequence
aacaaggaaatgatcgtggc

SEQ ID NO: 14365 - DNA, 20 bp, Artificial Sequence
  Artificially Synthesized Primer Sequence
ttattcatgcagttccccgt

SEQ ID NO: 14366 - DNA, 20 bp, Artificial Sequence
  Artificially Synthesized Primer Sequence
ggaaaccatggcaaaagaaa

SEQ ID NO: 14367 - DNA, 20 bp, Artificial Sequence
  Artificially Synthesized Primer Sequence
tgttggcctcatcaacaaaa

SEQ ID NO: 14368 - DNA, 20 bp, Artificial Sequence
  Artificially Synthesized Primer Sequence
actgatgcacagaaacgtgc

SEQ ID NO: 14369 - DNA, 20 bp, Artificial Sequence
  Artificially Synthesized Primer Sequence
aaaagacgcctgggaaagat

SEQ ID NO: 14370 - DNA, 20 bp, Artificial Sequence
  Artificially Synthesized Primer Sequence
ttttcggttgagcagctttt

SEQ ID NO: 14371 - DNA, 20 bp, Artificial Sequence
  Artificially Synthesized Primer Sequence
tacaatgtaaagggcagggc

SEQ ID NO: 14372 - DNA, 20 bp, Artificial Sequence
  Artificially Synthesized Primer Sequence
cgcatcacatcctcagaaaa

SEQ ID NO: 14373 - DNA, 20 bp, Artificial Sequence
  Artificially Synthesized Primer Sequence
gtggtggttgagaagaccgt

SEQ ID NO: 14374 - DNA, 20 bp, Artificial Sequence
  Artificially Synthesized Primer Sequence
cgaggcttgtcgttttcttc

SEQ ID NO: 14375 - DNA, 20 bp, Artificial Sequence
  Artificially Synthesized Primer Sequence
tctcaatcgacacccaatca

SEQ ID NO: 14376 - DNA, 20 bp, Artificial Sequence
  Artificially Synthesized Primer Sequence
taccggagcctactgcgtat

SEQ ID NO: 14377 - DNA, 20 bp, Artificial Sequence
  Artificially Synthesized Primer Sequence
gctcctgaggtcagttcgac

SEQ ID NO: 14378 - DNA, 20 bp, Artificial Sequence
  Artificially Synthesized Primer Sequence
ttttccgcagaaactatggg

SEQ ID NO: 14379 - DNA, 20 bp, Artificial Sequence
  Artificially Synthesized Primer Sequence
ctcacggctactctcaaggg

SEQ ID NO: 14380 - DNA, 20 bp, Artificial Sequence
  Artificially Synthesized Primer Sequence
cgaaaggctctacttgcctg

SEQ ID NO: 14381 - DNA, 20 bp, Artificial Sequence
  Artificially Synthesized Primer Sequence
cttcgggaaccagtttggta

SEQ ID NO: 14382 - DNA, 20 bp, Artificial Sequence
  Artificially Synthesized Primer Sequence
ccatgctcacacacataccc

SEQ ID NO: 14383 - DNA, 20 bp, Artificial Sequence
  Artificially Synthesized Primer Sequence
tagtacatgcgtgccatgct

SEQ ID NO: 14384 - DNA, 20 bp, Artificial Sequence
  Artificially Synthesized Primer Sequence
gtcatcatcctcgccttcac

SEQ ID NO: 14385 - DNA, 20 bp, Artificial Sequence
  Artificially Synthesized Primer Sequence
ctacaagggccagctttcag

SEQ ID NO: 14386 - DNA, 20 bp, Artificial Sequence
  Artificially Synthesized Primer Sequence
ataacaagcaaccgggagtg

SEQ ID NO: 14387 - DNA, 20 bp, Artificial Sequence
  Artificially Synthesized Primer Sequence
aggaaaggcgaatcaaaggt

SEQ ID NO: 14388 - DNA, 20 bp, Artificial Sequence
  Artificially Synthesized Primer Sequence
cagctgatcgaccaacaatg

SEQ ID NO: 14389 - DNA, 20 bp, Artificial Sequence
  Artificially Synthesized Primer Sequence
caaacacatggatcctcacg

SEQ ID NO: 14390 - DNA, 20 bp, Artificial Sequence
  Artificially Synthesized Primer Sequence
agcctctcaaagcaccaaaa

SEQ ID NO: 14391 - DNA, 20 bp, Artificial Sequence
  Artificially Synthesized Primer Sequence
agcctctcaaagcaccaaaa

SEQ ID NO: 14392 - DNA, 20 bp, Artificial Sequence
  Artificially Synthesized Primer Sequence
caaacacatggatcctcacg

SEQ ID NO: 14393 - DNA, 20 bp, Artificial Sequence
  Artificially Synthesized Primer Sequence
ggaataagctcaagggaggg

SEQ ID NO: 14394 - DNA, 20 bp, Artificial Sequence
  Artificially Synthesized Primer Sequence
cttcccggaaagaaagaacc

SEQ ID NO: 14395 - DNA, 20 bp, Artificial Sequence
  Artificially Synthesized Primer Sequence
cgtcaaggatctggcattct

SEQ ID NO: 14396 - DNA, 20 bp, Artificial Sequence
  Artificially Synthesized Primer Sequence
ccctcccttgagcttattcc

SEQ ID NO: 14397 - DNA, 20 bp, Artificial Sequence
  Artificially Synthesized Primer Sequence
ggtattgtttcggcgtgagt

SEQ ID NO: 14398 - DNA, 20 bp, Artificial Sequence
  Artificially Synthesized Primer Sequence
taagtttcagtgcaccagcg

SEQ ID NO: 14399 - DNA, 20 bp, Artificial Sequence
  Artificially Synthesized Primer Sequence
ttttggttggttggttggtt

SEQ ID NO: 14400 - DNA, 20 bp, Artificial Sequence
  Artificially Synthesized Primer Sequence
attgtagcacctggacacgg

SEQ ID NO: 14401 - DNA, 20 bp, Artificial Sequence
  Artificially Synthesized Primer Sequence
ttgtaggtaggtcgggaacg

SEQ ID NO: 14402 - DNA, 20 bp, Artificial Sequence
  Artificially Synthesized Primer Sequence
cgcagattagagtgatgcca

SEQ ID NO: 14403 - DNA, 20 bp, Artificial Sequence
  Artificially Synthesized Primer Sequence
ctcgctccctctcctcttct

SEQ ID NO: 14404 - DNA, 20 bp, Artificial Sequence
  Artificially Synthesized Primer Sequence
ccaagacggactcgagctta

SEQ ID NO: 14405 - DNA, 20 bp, Artificial Sequence
  Artificially Synthesized Primer Sequence
gtggctttacacggtcgaat

SEQ ID NO: 14406 - DNA, 20 bp, Artificial Sequence
  Artificially Synthesized Primer Sequence
accacaaaacttggtctcgg

SEQ ID NO: 14407 - DNA, 20 bp, Artificial Sequence
  Artificially Synthesized Primer Sequence
cagcaaggtggtttggtttt

SEQ ID NO: 14408 - DNA, 20 bp, Artificial Sequence
  Artificially Synthesized Primer Sequence
caaaagagggcgagaagttg

SEQ ID NO: 14409 - DNA, 20 bp, Artificial Sequence
  Artificially Synthesized Primer Sequence
cttatgtacccgacgcgaat

SEQ ID NO: 14410 - DNA, 20 bp, Artificial Sequence
  Artificially Synthesized Primer Sequence
gagcgtatgctctggtctcc

SEQ ID NO: 14411 - DNA, 20 bp, Artificial Sequence
  Artificially Synthesized Primer Sequence
tgtgcacaaacttctccagg

SEQ ID NO: 14412 - DNA, 20 bp, Artificial Sequence
  Artificially Synthesized Primer Sequence
gatgaagcaaagaaggccag

SEQ ID NO: 14413 - DNA, 20 bp, Artificial Sequence
  Artificially Synthesized Primer Sequence
ccagcaattgaagcttgtga

SEQ ID NO: 14414 - DNA, 20 bp, Artificial Sequence
  Artificially Synthesized Primer Sequence
atgatgccccaagaagtttg

SEQ ID NO: 14415 - DNA, 20 bp, Artificial Sequence
  Artificially Synthesized Primer Sequence
cacgcacaaaatgtttcacc

SEQ ID NO: 14416 - DNA, 20 bp, Artificial Sequence
  Artificially Synthesized Primer Sequence
aggctgcggtacaaagagaa

SEQ ID NO: 14417 - DNA, 20 bp, Artificial Sequence
  Artificially Synthesized Primer Sequence
aggccaccgatgatgttaag

SEQ ID NO: 14418 - DNA, 20 bp, Artificial Sequence
  Artificially Synthesized Primer Sequence
gggggtctaatggttaggga

SEQ ID NO: 14419 - DNA, 20 bp, Artificial Sequence
  Artificially Synthesized Primer Sequence
gaaactacgggatggcaaga

SEQ ID NO: 14420 - DNA, 20 bp, Artificial Sequence
  Artificially Synthesized Primer Sequence
caacaaatcactccattgcg

SEQ ID NO: 14421 - DNA, 20 bp, Artificial Sequence
  Artificially Synthesized Primer Sequence
gggtcgtggagtctgttgtt

SEQ ID NO: 14422 - DNA, 20 bp, Artificial Sequence
  Artificially Synthesized Primer Sequence
ctgctgcctgtctatggtga

SEQ ID NO: 14423 - DNA, 20 bp, Artificial Sequence
  Artificially Synthesized Primer Sequence
ggggcgtaactgtaactgga

SEQ ID NO: 14424 - DNA, 20 bp, Artificial Sequence
  Artificially Synthesized Primer Sequence
atatggtccccaccacagaa

SEQ ID NO: 14425 - DNA, 20 bp, Artificial Sequence
  Artificially Synthesized Primer Sequence
catgacgacccttttggagt

SEQ ID NO: 14426 - DNA, 20 bp, Artificial Sequence
  Artificially Synthesized Primer Sequence
ctctggaaagacggctgaac

SEQ ID NO: 14427 - DNA, 20 bp, Artificial Sequence
  Artificially Synthesized Primer Sequence
cctgaaatgtaccaccaccc

SEQ ID NO: 14428 - DNA, 20 bp, Artificial Sequence
  Artificially Synthesized Primer Sequence
gtcctgccggtacagatgtt

SEQ ID NO: 14429 - DNA, 20 bp, Artificial Sequence
  Artificially Synthesized Primer Sequence
tttcaaaagtcccgttgacc

SEQ ID NO: 14430 - DNA, 20 bp, Artificial Sequence
  Artificially Synthesized Primer Sequence
tgtcacaggcgtgaagaaag

SEQ ID NO: 14431 - DNA, 20 bp, Artificial Sequence
  Artificially Synthesized Primer Sequence
tccattcatccactcgttca

SEQ ID NO: 14432 - DNA, 20 bp, Artificial Sequence
  Artificially Synthesized Primer Sequence
tcgactaggccttgcttctt

SEQ ID NO: 14433 - DNA, 20 bp, Artificial Sequence
  Artificially Synthesized Primer Sequence
cagcttggaggagatcaagg

SEQ ID NO: 14434 - DNA, 20 bp, Artificial Sequence
  Artificially Synthesized Primer Sequence
cttcccttccacacaccatt

SEQ ID NO: 14435 - DNA, 20 bp, Artificial Sequence
  Artificially Synthesized Primer Sequence
tggagtagggtttacgcgag

SEQ ID NO: 14436 - DNA, 20 bp, Artificial Sequence
  Artificially Synthesized Primer Sequence
gaaaggaaggagtgccattg

SEQ ID NO: 14437 - DNA, 20 bp, Artificial Sequence
  Artificially Synthesized Primer Sequence
tatggctgtcgggtacaaca

SEQ ID NO: 14438 - DNA, 20 bp, Artificial Sequence
  Artificially Synthesized Primer Sequence
gctcaccgttagctttcagg

SEQ ID NO: 14439 - DNA, 20 bp, Artificial Sequence
  Artificially Synthesized Primer Sequence
gattcatccgttcatttccg

SEQ ID NO: 14440 - DNA, 20 bp, Artificial Sequence
  Artificially Synthesized Primer Sequence
caagacgacgtaccacctga

SEQ ID NO: 14441 - DNA, 20 bp, Artificial Sequence
  Artificially Synthesized Primer Sequence
accctcttcgacctcatcct

SEQ ID NO: 14442 - DNA, 20 bp, Artificial Sequence
  Artificially Synthesized Primer Sequence
ttcaccgacaccacctcata

SEQ ID NO: 14443 - DNA, 20 bp, Artificial Sequence
  Artificially Synthesized Primer Sequence
tcaccgacaccacctcataa

SEQ ID NO: 14444 - DNA, 20 bp, Artificial Sequence
  Artificially Synthesized Primer Sequence
gaggacctcaagaactggga

SEQ ID NO: 14445 - DNA, 20 bp, Artificial Sequence
  Artificially Synthesized Primer Sequence
aattcgacatgggactctgc

SEQ ID NO: 14446 - DNA, 20 bp, Artificial Sequence
  Artificially Synthesized Primer Sequence
cactaagggcgaattgggta

SEQ ID NO: 14447 - DNA, 20 bp, Artificial Sequence
  Artificially Synthesized Primer Sequence
aatgacaaaacgaccttggc

SEQ ID NO: 14448 - DNA, 20 bp, Artificial Sequence
  Artificially Synthesized Primer Sequence
gagttgctgcaagaacacga

SEQ ID NO: 14449 - DNA, 20 bp, Artificial Sequence
  Artificially Synthesized Primer Sequence
accttcttctgctccgacaa

SEQ ID NO: 14450 - DNA, 20 bp, Artificial Sequence
  Artificially Synthesized Primer Sequence
acggatgacaccagacatca

SEQ ID NO: 14451 - DNA, 20 bp, Artificial Sequence
  Artificially Synthesized Primer Sequence
ccttgatctcctccaagctg

SEQ ID NO: 14452 - DNA, 20 bp, Artificial Sequence
  Artificially Synthesized Primer Sequence
accttcttctgctccgacaa

SEQ ID NO: 14453 - DNA, 20 bp, Artificial Sequence
  Artificially Synthesized Primer Sequence
gaaggcgagcaaaacacaat

SEQ ID NO: 14454 - DNA, 20 bp, Artificial Sequence
  Artificially Synthesized Primer Sequence
ggtaagcctggactaagggg

SEQ ID NO: 14455 - DNA, 20 bp, Artificial Sequence
  Artificially Synthesized Primer Sequence
cgaagcaaacacagcaacat

SEQ ID NO: 14456 - DNA, 20 bp, Artificial Sequence
  Artificially Synthesized Primer Sequence
tacccccgtattccacaaaa

SEQ ID NO: 14457 - DNA, 20 bp, Artificial Sequence
  Artificially Synthesized Primer Sequence
agtctgcgaggctgtgtttt

SEQ ID NO: 14458 - DNA, 20 bp, Artificial Sequence
  Artificially Synthesized Primer Sequence
ggaaaatcgcatttaagcca

SEQ ID NO: 14459 - DNA, 20 bp, Artificial Sequence
  Artificially Synthesized Primer Sequence
atccatccatccaccaacat

SEQ ID NO: 14460 - DNA, 20 bp, Artificial Sequence
  Artificially Synthesized Primer Sequence
gaaacaggccgtagacaagg

SEQ ID NO: 14461 - DNA, 20 bp, Artificial Sequence
  Artificially Synthesized Primer Sequence
gcgtctgctcaaacttcctc

SEQ ID NO: 14462 - DNA, 20 bp, Artificial Sequence
  Artificially Synthesized Primer Sequence
ccttcttgagcatctcccag

SEQ ID NO: 14463 - DNA, 20 bp, Artificial Sequence
  Artificially Synthesized Primer Sequence
ttccactgctcagccttctt

SEQ ID NO: 14464 - DNA, 20 bp, Artificial Sequence
  Artificially Synthesized Primer Sequence
gagcagcacgacgactacaa

SEQ ID NO: 14465 - DNA, 20 bp, Artificial Sequence
  Artificially Synthesized Primer Sequence
cggactatgccatcctcatt

SEQ ID NO: 14466 - DNA, 20 bp, Artificial Sequence
  Artificially Synthesized Primer Sequence
caacctggcaaaacaacctt

SEQ ID NO: 14467 - DNA, 20 bp, Artificial Sequence
  Artificially Synthesized Primer Sequence
tacatggtgcctgaccttca

SEQ ID NO: 14468 - DNA, 20 bp, Artificial Sequence
  Artificially Synthesized Primer Sequence
acccttgcagagatgtgctt

SEQ ID NO: 14469 - DNA, 20 bp, Artificial Sequence
  Artificially Synthesized Primer Sequence
ttttaccgttcgcagtaggg

SEQ ID NO: 14470 - DNA, 20 bp, Artificial Sequence
  Artificially Synthesized Primer Sequence
cgccattatctggcgttatt

SEQ ID NO: 14471 - DNA, 20 bp, Artificial Sequence
  Artificially Synthesized Primer Sequence
catgaacggaagcaaggatt

SEQ ID NO: 14472 - DNA, 20 bp, Artificial Sequence
  Artificially Synthesized Primer Sequence
gggagcataagcagctcaac

SEQ ID NO: 14473 - DNA, 20 bp, Artificial Sequence
  Artificially Synthesized Primer Sequence
ggaaaggaaggacaaaagcc

SEQ ID NO: 14474 - DNA, 20 bp, Artificial Sequence
  Artificially Synthesized Primer Sequence
cataaggggtccaagaagca

SEQ ID NO: 14475 - DNA, 19 bp, Artificial Sequence
  Artificially Synthesized Primer Sequence
aaaacggagcgtcattggt

SEQ ID NO: 14476 - DNA, 19 bp, Artificial Sequence
  Artificially Synthesized Primer Sequence
agtggttcggcgacttctc

SEQ ID NO: 14477 - DNA, 20 bp, Artificial Sequence
  Artificially Synthesized Primer Sequence
tgtgcttgtttggtggatgt

SEQ ID NO: 14478 - DNA, 20 bp, Artificial Sequence
  Artificially Synthesized Primer Sequence
atcctaatttggtttccgcc

SEQ ID NO: 14479 - DNA, 20 bp, Artificial Sequence
  Artificially Synthesized Primer Sequence
ttacattgcattccgatcca

SEQ ID NO: 14480 - DNA, 20 bp, Artificial Sequence
  Artificially Synthesized Primer Sequence
aatctcaaagggtgtgtgcc

SEQ ID NO: 14481 - DNA, 20 bp, Artificial Sequence
  Artificially Synthesized Primer Sequence
aatgaaaccttgggggaaac

SEQ ID NO: 14482 - DNA, 20 bp, Artificial Sequence
  Artificially Synthesized Primer Sequence
ggggcaatgagctaatgaaa

SEQ ID NO: 14483 - DNA, 20 bp, Artificial Sequence
  Artificially Synthesized Primer Sequence
accatggtatgggagcaagt

SEQ ID NO: 14484 - DNA, 20 bp, Artificial Sequence
  Artificially Synthesized Primer Sequence
aatgaaaccttgggggaaac

SEQ ID NO: 14485 - DNA, 20 bp, Artificial Sequence
  Artificially Synthesized Primer Sequence
gaggtcaagggtatggctga

SEQ ID NO: 14486 - DNA, 20 bp, Artificial Sequence
  Artificially Synthesized Primer Sequence
attttccgttgttggacagc

SEQ ID NO: 14487 - DNA, 20 bp, Artificial Sequence
  Artificially Synthesized Primer Sequence
cgagtttgaagtcctccagc

SEQ ID NO: 14488 - DNA, 20 bp, Artificial Sequence
  Artificially Synthesized Primer Sequence
acacgcaacgggagaataag

SEQ ID NO: 14489 - DNA, 20 bp, Artificial Sequence
  Artificially Synthesized Primer Sequence
gctcaatggcgagatgtttt

SEQ ID NO: 14490 - DNA, 20 bp, Artificial Sequence
  Artificially Synthesized Primer Sequence
gcacgaaggaacgaagagac

SEQ ID NO: 14491 - DNA, 20 bp, Artificial Sequence
  Artificially Synthesized Primer Sequence
tagatggcctcagtcgggta

SEQ ID NO: 14492 - DNA, 20 bp, Artificial Sequence
  Artificially Synthesized Primer Sequence
gaagcctcattccgtcttga

SEQ ID NO: 14493 - DNA, 20 bp, Artificial Sequence
  Artificially Synthesized Primer Sequence
gcaagaatctatcttgccgc

SEQ ID NO: 14494 - DNA, 20 bp, Artificial Sequence
  Artificially Synthesized Primer Sequence
aagtgaaacggggtgaacag

SEQ ID NO: 14495 - DNA, 20 bp, Artificial Sequence
  Artificially Synthesized Primer Sequence
gagctcaacaggtcatgcaa

SEQ ID NO: 14496 - DNA, 20 bp, Artificial Sequence
  Artificially Synthesized Primer Sequence
caatcttggccattggttct

SEQ ID NO: 14497 - DNA, 20 bp, Artificial Sequence
  Artificially Synthesized Primer Sequence
gctgaggtatgactggggaa

SEQ ID NO: 14498 - DNA, 20 bp, Artificial Sequence
  Artificially Synthesized Primer Sequence
gcctcgatgtcgagttgagt

SEQ ID NO: 14499 - DNA, 20 bp, Artificial Sequence
  Artificially Synthesized Primer Sequence
tagcgggagtgaggagaaaa

SEQ ID NO: 14500 - DNA, 20 bp, Artificial Sequence
  Artificially Synthesized Primer Sequence
attgtcaagagggtcgttgg

SEQ ID NO: 14501 - DNA, 20 bp, Artificial Sequence
  Artificially Synthesized Primer Sequence
agacgatggtctcccatttg

SEQ ID NO: 14502 - DNA, 20 bp, Artificial Sequence
  Artificially Synthesized Primer Sequence
ctatgcccttttggaagcag

SEQ ID NO: 14503 - DNA, 20 bp, Artificial Sequence
  Artificially Synthesized Primer Sequence
gtcttccacagcccacagat

SEQ ID NO: 14504 - DNA, 20 bp, Artificial Sequence
  Artificially Synthesized Primer Sequence
gttgaagctgccaaagaagg

SEQ ID NO: 14505 - DNA, 20 bp, Artificial Sequence
  Artificially Synthesized Primer Sequence
gtttgtgggatcttgctggt

SEQ ID NO: 14506 - DNA, 20 bp, Artificial Sequence
  Artificially Synthesized Primer Sequence
ggaaaaacccacgagaacaa

SEQ ID NO: 14507 - DNA, 20 bp, Artificial Sequence
  Artificially Synthesized Primer Sequence
actcgaaacggcgattattg

SEQ ID NO: 14508 - DNA, 20 bp, Artificial Sequence
  Artificially Synthesized Primer Sequence
gtttgtgggatcttgctggt

SEQ ID NO: 14509 - DNA, 10 bp, Artificial Sequence
  Artificially Synthesized Primer Sequence
  MISC_FEATURE (1)..(10): n stands for any base
nnnnnnnnnn

SEQ ID NO: 14510 - DNA, 10 bp, Artificial Sequence
  Artificially Synthesized Primer Sequence
  MISC_FEATURE (1)..(10): n stands for any base
nnnnnnnnnn

SEQ ID NO: 14511 - DNA, 20 bp, Artificial Sequence
  Artificially Synthesized Primer Sequence
acctcaagcaaactgcaacc

SEQ ID NO: 14512 - DNA, 20 bp, Artificial Sequence
  Artificially Synthesized Primer Sequence
gaaagtgcgtgaggagaagc

SEQ ID NO: 14513 - DNA, 20 bp, Artificial Sequence
  Artificially Synthesized Primer Sequence
agtgcatcgacctatacccg

SEQ ID NO: 14514 - DNA, 20 bp, Artificial Sequence
  Artificially Synthesized Primer Sequence
ttgccggatcatagaaggtc

SEQ ID NO: 14515 - DNA, 20 bp, Artificial Sequence
  Artificially Synthesized Primer Sequence
agtgccatgtaggcttggtt

SEQ ID NO: 14516 - DNA, 20 bp, Artificial Sequence
  Artificially Synthesized Primer Sequence
gcaccgccgtctacttctat

SEQ ID NO: 14517 - DNA, 20 bp, Artificial Sequence
  Artificially Synthesized Primer Sequence
tcgattatgagcttgtcccc

SEQ ID NO: 14518 - DNA, 20 bp, Artificial Sequence
  Artificially Synthesized Primer Sequence
ttccccagtcatacctcagc

SEQ ID NO: 14519 - DNA, 20 bp, Artificial Sequence
  Artificially Synthesized Primer Sequence
ttcattctacatcgaggcga

SEQ ID NO: 14520 - DNA, 19 bp, Artificial Sequence
  Artificially Synthesized Primer Sequence
tgacgtcacgggtgtatcc

SEQ ID NO: 14521 - DNA, 20 bp, Artificial Sequence
  Artificially Synthesized Primer Sequence
gacaaattggacgcaaaggt

SEQ ID NO: 14522 - DNA, 20 bp, Artificial Sequence
  Artificially Synthesized Primer Sequence
catacaggtctgccggaaat

SEQ ID NO: 14523 - DNA, 20 bp, Artificial Sequence
  Artificially Synthesized Primer Sequence
acgcctgaacaactgaatcc

SEQ ID NO: 14524 - DNA, 20 bp, Artificial Sequence
  Artificially Synthesized Primer Sequence
gtcccatttctcccaatcaa

SEQ ID NO: 14525 - DNA, 20 bp, Artificial Sequence
  Artificially Synthesized Primer Sequence
agatcctcatcctgcacctg

SEQ ID NO: 14526 - DNA, 20 bp, Artificial Sequence
  Artificially Synthesized Primer Sequence
ctccatccgtcaatatgcct

SEQ ID NO: 14527 - DNA, 20 bp, Artificial Sequence
  Artificially Synthesized Primer Sequence
agttgtcagacccaacccag

SEQ ID NO: 14528 - DNA, 20 bp, Artificial Sequence
  Artificially Synthesized Primer Sequence
gaggtattcgagttgagccg

SEQ ID NO: 14529 - DNA, 20 bp, Artificial Sequence
  Artificially Synthesized Primer Sequence
gtgctatctttggtgtcgca

SEQ ID NO: 14530 - DNA, 20 bp, Artificial Sequence
  Artificially Synthesized Primer Sequence
atggagacccttggctttct

SEQ ID NO: 14531 - DNA, 20 bp, Artificial Sequence
  Artificially Synthesized Primer Sequence
gtgctatctttggtgtcgca

SEQ ID NO: 14532 - DNA, 20 bp, Artificial Sequence
  Artificially Synthesized Primer Sequence
tagtactcctcctccgtggc

SEQ ID NO: 14533 - DNA, 20 bp, Artificial Sequence
  Artificially Synthesized Primer Sequence
cttgaagccattgtgaagca

SEQ ID NO: 14534 - DNA, 20 bp, Artificial Sequence
  Artificially Synthesized Primer Sequence
tccccttgagtctgctcagt

SEQ ID NO: 14535 - DNA, 20 bp, Artificial Sequence
  Artificially Synthesized Primer Sequence
tctgggacgcattacaactg

SEQ ID NO: 14536 - DNA, 20 bp, Artificial Sequence
  Artificially Synthesized Primer Sequence
agcagagctacgcacaacct

SEQ ID NO: 14537 - DNA, 20 bp, Artificial Sequence
  Artificially Synthesized Primer Sequence
tcgattgcaacatgagcttc

SEQ ID NO: 14538 - DNA, 20 bp, Artificial Sequence
  Artificially Synthesized Primer Sequence
tggcaaagaacaccagaaca

SEQ ID NO: 14539 - DNA, 20 bp, Artificial Sequence
  Artificially Synthesized Primer Sequence
tgcaatgcaaaggagcacta

SEQ ID NO: 14540 - DNA, 20 bp, Artificial Sequence
  Artificially Synthesized Primer Sequence
cggcattcctccttcagata

SEQ ID NO: 14541 - DNA, 20 bp, Artificial Sequence
  Artificially Synthesized Primer Sequence
ggccaaggacaacaagaaga

SEQ ID NO: 14542 - DNA, 20 bp, Artificial Sequence
  Artificially Synthesized Primer Sequence
tacaatgtcacccttgctgc

SEQ ID NO: 14543 - DNA, 20 bp, Artificial Sequence
  Artificially Synthesized Primer Sequence
tacaatgtcacccttgctgc

SEQ ID NO: 14544 - DNA, 20 bp, Artificial Sequence
  Artificially Synthesized Primer Sequence
aacaagaagagccgcatcat

SEQ ID NO: 14545 - DNA, 20 bp, Artificial Sequence
  Artificially Synthesized Primer Sequence
acaagaagtcccgcatcatc

SEQ ID NO: 14546 - DNA, 20 bp, Artificial Sequence
  Artificially Synthesized Primer Sequence
gggtggcatcttcagtcatt

SEQ ID NO: 14547 - DNA, 20 bp, Artificial Sequence
  Artificially Synthesized Primer Sequence
ggcctgttcatcgaacaaat

SEQ ID NO: 14548 - DNA, 20 bp, Artificial Sequence
  Artificially Synthesized Primer Sequence
acaacaagaagtcccgcatc

SEQ ID NO: 14549 - DNA, 20 bp, Artificial Sequence
  Artificially Synthesized Primer Sequence
aagtccaagaagagcgtgga

SEQ ID NO: 14550 - DNA, 20 bp, Artificial Sequence
  Artificially Synthesized Primer Sequence
cgcgaaaaggatggaataaa

SEQ ID NO: 14551 - DNA, 20 bp, Artificial Sequence
  Artificially Synthesized Primer Sequence
aatgccaccatcaattcgtc

SEQ ID NO: 14552 - DNA, 18 bp, Artificial Sequence
  Artificially Synthesized Primer Sequence
acatcggcatctcctcca

SEQ ID NO: 14553 - DNA, 20 bp, Artificial Sequence
  Artificially Synthesized Primer Sequence
ttgtggagtacgagctgacg

SEQ ID NO: 14554 - DNA, 20 bp, Artificial Sequence
  Artificially Synthesized Primer Sequence
aagacgcagtacgagaccgt

SEQ ID NO: 14555 - DNA, 20 bp, Artificial Sequence
  Artificially Synthesized Primer Sequence
cgcgaactaacacaatccaa

SEQ ID NO: 14556 - DNA, 20 bp, Artificial Sequence
  Artificially Synthesized Primer Sequence
ccttactccgccaccataga

SEQ ID NO: 14557 - DNA, 20 bp, Artificial Sequence
  Artificially Synthesized Primer Sequence
tcaattctgctggcacaaag

SEQ ID NO: 14558 - DNA, 20 bp, Artificial Sequence
  Artificially Synthesized Primer Sequence
ctgctgcatgtccgctataa

SEQ ID NO: 14559 - DNA, 20 bp, Artificial Sequence
  Artificially Synthesized Primer Sequence
taaacaccagctcattccca

SEQ ID NO: 14560 - DNA, 20 bp, Artificial Sequence
  Artificially Synthesized Primer Sequence
gcggcatacacattctccat

SEQ ID NO: 14561 - DNA, 20 bp, Artificial Sequence
  Artificially Synthesized Primer Sequence
agtgtgtgtgacgctcttgg

SEQ ID NO: 14562 - DNA, 20 bp, Artificial Sequence
  Artificially Synthesized Primer Sequence
ccccgagattttctctctcc

SEQ ID NO: 14563 - DNA, 20 bp, Artificial Sequence
  Artificially Synthesized Primer Sequence
ggaagctacagcaggcactc

SEQ ID NO: 14564 - DNA, 20 bp, Artificial Sequence
  Artificially Synthesized Primer Sequence
gggcactcagtttcctcaag

SEQ ID NO: 14565 - DNA, 20 bp, Artificial Sequence
  Artificially Synthesized Primer Sequence
ttgctccaacagtcgatgag

SEQ ID NO: 14566 - DNA, 20 bp, Artificial Sequence
  Artificially Synthesized Primer Sequence
gcaagcatgacacctcagaa

SEQ ID NO: 14567 - DNA, 20 bp, Artificial Sequence
  Artificially Synthesized Primer Sequence
ccttccttaccggaggtttc

SEQ ID NO: 14568 - DNA, 20 bp, Artificial Sequence
  Artificially Synthesized Primer Sequence
ttctgaggtgtcatgcttgc

SEQ ID NO: 14569 - DNA, 20 bp, Artificial Sequence
  Artificially Synthesized Primer Sequence
agtttagcttgctgtgcggt

SEQ ID NO: 14570 - DNA, 20 bp, Artificial Sequence
  Artificially Synthesized Primer Sequence
ctcttctgctgggtttcctg

SEQ ID NO: 14571 - DNA, 20 bp, Artificial Sequence
  Artificially Synthesized Primer Sequence
gcgtgcttccttttcatctc

SEQ ID NO: 14572 - DNA, 20 bp, Artificial Sequence
  Artificially Synthesized Primer Sequence
gtggaaaagaatgagctccg

SEQ ID NO: 14573 - DNA, 20 bp, Artificial Sequence
  Artificially Synthesized Primer Sequence
aaaatgcggagggagaaact

SEQ ID NO: 14574 - DNA, 20 bp, Artificial Sequence
  Artificially Synthesized Primer Sequence
gtcaccttctttgctcggtc

SEQ ID NO: 14575 - DNA, 20 bp, Artificial Sequence
  Artificially Synthesized Primer Sequence
aagaaacagaccagcgcaat

SEQ ID NO: 14576 - DNA, 20 bp, Artificial Sequence
  Artificially Synthesized Primer Sequence
caagttccagccaacaaagg

SEQ ID NO: 14577 - DNA, 20 bp, Artificial Sequence
  Artificially Synthesized Primer Sequence
aaaggggccaatttggtaac

SEQ ID NO: 14578 - DNA, 20 bp, Artificial Sequence
  Artificially Synthesized Primer Sequence
gtctcctctgaactgccgtc

SEQ ID NO: 14579 - DNA, 20 bp, Artificial Sequence
  Artificially Synthesized Primer Sequence
gtctcctctgaactgccgtc

SEQ ID NO: 14580 - DNA, 20 bp, Artificial Sequence
  Artificially Synthesized Primer Sequence
gtccaagtgagaacagggga

SEQ ID NO: 14581 - DNA, 20 bp, Artificial Sequence
  Artificially Synthesized Primer Sequence
ggcgtcaacacctacacctt

SEQ ID NO: 14582 - DNA, 20 bp, Artificial Sequence
  Artificially Synthesized Primer Sequence
tgctcgttctcgttgaagaa

SEQ ID NO: 14583 - DNA, 20 bp, Artificial Sequence
  Artificially Synthesized Primer Sequence
tcgaccacatgatccacagt

SEQ ID NO: 14584 - DNA, 20 bp, Artificial Sequence
  Artificially Synthesized Primer Sequence
agaacaaccactacgacggc

SEQ ID NO: 14585 - DNA, 20 bp, Artificial Sequence
  Artificially Synthesized Primer Sequence
ggaggagggctgtaaaaagg

SEQ ID NO: 14586 - DNA, 20 bp, Artificial Sequence
  Artificially Synthesized Primer Sequence
catgattgtccctgacatgc

SEQ ID NO: 14587 - DNA, 20 bp, Artificial Sequence
  Artificially Synthesized Primer Sequence
tgacttgagcagcaaacacc

SEQ ID NO: 14588 - DNA, 20 bp, Artificial Sequence
  Artificially Synthesized Primer Sequence
tttcaagtgtcgagtcgtgg

SEQ ID NO: 14589 - DNA, 20 bp, Artificial Sequence
  Artificially Synthesized Primer Sequence
gcaatgctggcacagagata

SEQ ID NO: 14590 - DNA, 20 bp, Artificial Sequence
  Artificially Synthesized Primer Sequence
tgaagaagcagacggtgttg

SEQ ID NO: 14591 - DNA, 20 bp, Artificial Sequence
  Artificially Synthesized Primer Sequence
cttccttgaccccaaacaga

SEQ ID NO: 14592 - DNA, 20 bp, Artificial Sequence
  Artificially Synthesized Primer Sequence
tggttggacaaggacaatga

SEQ ID NO: 14593 - DNA, 20 bp, Artificial Sequence
  Artificially Synthesized Primer Sequence
tgagtattggcgcttgtctg

SEQ ID NO: 14594 - DNA, 20 bp, Artificial Sequence
  Artificially Synthesized Primer Sequence
gaccgcttggttcaaaatgt

SEQ ID NO: 14595 - DNA, 20 bp, Artificial Sequence
  Artificially Synthesized Primer Sequence
gaaaatgcttccactgccat

SEQ ID NO: 14596 - DNA, 20 bp, Artificial Sequence
  Artificially Synthesized Primer Sequence
atatcttgacgcatcctggc

SEQ ID NO: 14597 - DNA, 20 bp, Artificial Sequence
  Artificially Synthesized Primer Sequence
acacctcaaccaaaaccagc

SEQ ID NO: 14598 - DNA, 20 bp, Artificial Sequence
  Artificially Synthesized Primer Sequence
gttgccactgaagcagatga

SEQ ID NO: 14599 - DNA, 20 bp, Artificial Sequence
  Artificially Synthesized Primer Sequence
aggctgcgtcaaccaataac

SEQ ID NO: 14600 - DNA, 20 bp, Artificial Sequence
  Artificially Synthesized Primer Sequence
aaccatcatgttcccagagg

SEQ ID NO: 14601 - DNA, 20 bp, Artificial Sequence
  Artificially Synthesized Primer Sequence
gttgcagccactcttgttca

SEQ ID NO: 14602 - DNA, 20 bp, Artificial Sequence
  Artificially Synthesized Primer Sequence
tgtgatggctttgatggtgt

SEQ ID NO: 14603 - DNA, 20 bp, Artificial Sequence
  Artificially Synthesized Primer Sequence
caccaccatcctattcccac

SEQ ID NO: 14604 - DNA, 20 bp, Artificial Sequence
  Artificially Synthesized Primer Sequence
gctgtacgtgtcataggcga

SEQ ID NO: 14605 - DNA, 20 bp, Artificial Sequence
  Artificially Synthesized Primer Sequence
ctatcgcctgtccaagaagc

SEQ ID NO: 14606 - DNA, 20 bp, Artificial Sequence
  Artificially Synthesized Primer Sequence
ccacgagtagacgacgaaca

SEQ ID NO: 14607 - DNA, 20 bp, Artificial Sequence
  Artificially Synthesized Primer Sequence
aatcgaacaactcgtctccg

SEQ ID NO: 14608 - DNA, 20 bp, Artificial Sequence
  Artificially Synthesized Primer Sequence
ctatcgcctgtccaagaagc

SEQ ID NO: 14609 - DNA, 20 bp, Artificial Sequence
  Artificially Synthesized Primer Sequence
ggtctactggtcatgccgtt

SEQ ID NO: 14610 - DNA, 20 bp, Artificial Sequence
  Artificially Synthesized Primer Sequence
gaagccagattgagcggtag

SEQ ID NO: 14611 - DNA, 20 bp, Artificial Sequence
  Artificially Synthesized Primer Sequence
atccgtcaaatgacttggga

SEQ ID NO: 14612 - DNA, 20 bp, Artificial Sequence
  Artificially Synthesized Primer Sequence
tcagccaattccagcagtta

SEQ ID NO: 14613 - DNA, 20 bp, Artificial Sequence
  Artificially Synthesized Primer Sequence
gggtgcgcactagtctcttc

SEQ ID NO: 14614 - DNA, 20 bp, Artificial Sequence
  Artificially Synthesized Primer Sequence
taaaattaagggaacggggg

SEQ ID NO: 14615 - DNA, 20 bp, Artificial Sequence
  Artificially Synthesized Primer Sequence
agagaactgtgcaccccatc

SEQ ID NO: 14616 - DNA, 20 bp, Artificial Sequence
  Artificially Synthesized Primer Sequence
aatactccaagcccagggtc

SEQ ID NO: 14617 - DNA, 20 bp, Artificial Sequence
  Artificially Synthesized Primer Sequence
gatcaagggcagctacttcg

SEQ ID NO: 14618 - DNA, 20 bp, Artificial Sequence
  Artificially Synthesized Primer Sequence
cacaattcggcatgattcac

SEQ ID NO: 14619 - DNA, 20 bp, Artificial Sequence
  Artificially Synthesized Primer Sequence
ccaggagcttatcaaaccga

SEQ ID NO: 14620 - DNA, 20 bp, Artificial Sequence
  Artificially Synthesized Primer Sequence
aaaggcgttcagtatgcacc

SEQ ID NO: 14621 - DNA, 20 bp, Artificial Sequence
  Artificially Synthesized Primer Sequence
tccgacaagtagacgaggct

SEQ ID NO: 14622 - DNA, 20 bp, Artificial Sequence
  Artificially Synthesized Primer Sequence
ctggctcacatgataggggt

SEQ ID NO: 14623 - DNA, 20 bp, Artificial Sequence
  Artificially Synthesized Primer Sequence
gctaattgcgcacgatgtaa

SEQ ID NO: 14624 - DNA, 20 bp, Artificial Sequence
  Artificially Synthesized Primer Sequence
accctgcaaaaatcatgagg

SEQ ID NO: 14625 - DNA, 20 bp, Artificial Sequence
  Artificially Synthesized Primer Sequence
gagaagatggtggaagcagc

SEQ ID NO: 14626 - DNA, 20 bp, Artificial Sequence
  Artificially Synthesized Primer Sequence
tcctcattcagcctcagctt

SEQ ID NO: 14627 - DNA, 21 bp, Artificial Sequence
  Artificially Synthesized Primer Sequence
caatgatgactgaagttgcca

SEQ ID NO: 14628 - DNA, 19 bp, Artificial Sequence
  Artificially Synthesized Primer Sequence
gaagatggtggaagcagca

SEQ ID NO: 14629 - DNA, 20 bp, Artificial Sequence
  Artificially Synthesized Primer Sequence
acaaggaagaagaagcagcg

SEQ ID NO: 14630 - DNA, 20 bp, Artificial Sequence
  Artificially Synthesized Primer Sequence
tgcgtcttacaacttcgtgg

SEQ ID NO: 14631 - DNA, 20 bp, Artificial Sequence
  Artificially Synthesized Primer Sequence
cgtcttacaacttcgtggca

SEQ ID NO: 14632 - DNA, 20 bp, Artificial Sequence
  Artificially Synthesized Primer Sequence
acaaggaagaagaagcagcg

SEQ ID NO: 14633 - DNA, 20 bp, Artificial Sequence
  Artificially Synthesized Primer Sequence
ttattctggcctccgacaac

SEQ ID NO: 14634 - DNA, 20 bp, Artificial Sequence
  Artificially Synthesized Primer Sequence
tcgaattgctcctctgcttt

SEQ ID NO: 14635 - DNA, 20 bp, Artificial Sequence
  Artificially Synthesized Primer Sequence
tcgaattgctcctctgcttt

SEQ ID NO: 14636 - DNA, 20 bp, Artificial Sequence
  Artificially Synthesized Primer Sequence
acatggacgagcacactgag

SEQ ID NO: 14637 - DNA, 20 bp, Artificial Sequence
  Artificially Synthesized Primer Sequence
accagttctggattatgcgg

SEQ ID NO: 14638 - DNA, 20 bp, Artificial Sequence
  Artificially Synthesized Primer Sequence
ttgcattgaagctcgacaac

SEQ ID NO: 14639 - DNA, 20 bp, Artificial Sequence
  Artificially Synthesized Primer Sequence
ttgcattgaagctcgacaac

SEQ ID NO: 14640 - DNA, 20 bp, Artificial Sequence
  Artificially Synthesized Primer Sequence
accagttctggattatgcgg

SEQ ID NO: 14641 - DNA, 20 bp, Artificial Sequence
  Artificially Synthesized Primer Sequence
tgcatccctccgataatctc

SEQ ID NO: 14642 - DNA, 20 bp, Artificial Sequence
  Artificially Synthesized Primer Sequence
tccgtagtcaaacaggaccc

SEQ ID NO: 14643 - DNA, 20 bp, Artificial Sequence
  Artificially Synthesized Primer Sequence
aagtttgactgcgccattct

SEQ ID NO: 14644 - DNA, 20 bp, Artificial Sequence
  Artificially Synthesized Primer Sequence
tgcatccctccgataatctc

SEQ ID NO: 14645 - DNA, 20 bp, Artificial Sequence
  Artificially Synthesized Primer Sequence
tggagcgagttgacatgaag

SEQ ID NO: 14646 - DNA, 20 bp, Artificial Sequence
  Artificially Synthesized Primer Sequence
ccattcactccattcccttg

SEQ ID NO: 14647 - DNA, 20 bp, Artificial Sequence
  Artificially Synthesized Primer Sequence
ctaggacggtgcatccattt

SEQ ID NO: 14648 - DNA, 20 bp, Artificial Sequence
  Artificially Synthesized Primer Sequence
gttgagtatgcgcttcgtga

SEQ ID NO: 14649 - DNA, 20 bp, Artificial Sequence
  Artificially Synthesized Primer Sequence
gttccttccatctcacccaa

SEQ ID NO: 14650 - DNA, 20 bp, Artificial Sequence
  Artificially Synthesized Primer Sequence
ccactggtccttgaggatgt

SEQ ID NO: 14651 - DNA, 20 bp, Artificial Sequence
  Artificially Synthesized Primer Sequence
cgagcatatcgacagcagaa

SEQ ID NO: 14652 - DNA, 20 bp, Artificial Sequence
  Artificially Synthesized Primer Sequence
tcaaggagctcaaggacctg

SEQ ID NO: 14653 - DNA, 20 bp, Artificial Sequence
  Artificially Synthesized Primer Sequence
ccacgagatctgaggaggag

SEQ ID NO: 14654 - DNA, 20 bp, Artificial Sequence
  Artificially Synthesized Primer Sequence
gcgaccaagaagtaacagcc

SEQ ID NO: 14655 - DNA, 20 bp, Artificial Sequence
  Artificially Synthesized Primer Sequence
gcgaccaagaagtaacagcc

SEQ ID NO: 14656 - DNA, 22 bp, Artificial Sequence
  Artificially Synthesized Primer Sequence
ccagttagtgacgaagacatgg

SEQ ID NO: 14657 - DNA, 20 bp, Artificial Sequence
  Artificially Synthesized Primer Sequence
gatctgaagccagcctcatc

SEQ ID NO: 14658 - DNA, 20 bp, Artificial Sequence
  Artificially Synthesized Primer Sequence
acggcagggttgtatcactc

SEQ ID NO: 14659 - DNA, 20 bp, Artificial Sequence
  Artificially Synthesized Primer Sequence
gcgaggcagtaccatgagat

SEQ ID NO: 14660 - DNA, 20 bp, Artificial Sequence
  Artificially Synthesized Primer Sequence
gacggaagctcgatacgaag

SEQ ID NO: 14661 - DNA, 20 bp, Artificial Sequence
  Artificially Synthesized Primer Sequence
ggcaggatattgcctcacat

SEQ ID NO: 14662 - DNA, 20 bp, Artificial Sequence
  Artificially Synthesized Primer Sequence
atgcgcctcaaggtagagaa

SEQ ID NO: 14663 - DNA, 20 bp, Artificial Sequence
  Artificially Synthesized Primer Sequence
aatatcatcccaatgggcaa

SEQ ID NO: 14664 - DNA, 20 bp, Artificial Sequence
  Artificially Synthesized Primer Sequence
ttcctgacctggatgaaacc

SEQ ID NO: 14665 - DNA, 20 bp, Artificial Sequence
  Artificially Synthesized Primer Sequence
tctggaccaaggtcgatttc

SEQ ID NO: 14666 - DNA, 20 bp, Artificial Sequence
  Artificially Synthesized Primer Sequence
agctccacgcttgatttgtt

SEQ ID NO: 14667 - DNA, 20 bp, Artificial Sequence
  Artificially Synthesized Primer Sequence
aaagaccaccggtgtgaatc

SEQ ID NO: 14668 - DNA, 20 bp, Artificial Sequence
  Artificially Synthesized Primer Sequence
acctacgacgtggagtggac

SEQ ID NO: 14669 - DNA, 20 bp, Artificial Sequence
  Artificially Synthesized Primer Sequence
ccgaaggtgttcttcgacat

SEQ ID NO: 14670 - DNA, 20 bp, Artificial Sequence
  Artificially Synthesized Primer Sequence
tctcgatgttcttgacgacg

SEQ ID NO: 14671 - DNA, 20 bp, Artificial Sequence
  Artificially Synthesized Primer Sequence
gcagatccagcagcctaaag

SEQ ID NO: 14672 - DNA, 19 bp, Artificial Sequence
  Artificially Synthesized Primer Sequence
aagttcgccgacgagaagt

SEQ ID NO: 14673 - DNA, 20 bp, Artificial Sequence
  Artificially Synthesized Primer Sequence
tggtgctctcgatgttgaag

SEQ ID NO: 14674 - DNA, 20 bp, Artificial Sequence
  Artificially Synthesized Primer Sequence
tcggctgcctctatgaactt

SEQ ID NO: 14675 - DNA, 20 bp, Artificial Sequence
  Artificially Synthesized Primer Sequence
atctcggcattgaaagcaag

SEQ ID NO: 14676 - DNA, 20 bp, Artificial Sequence
  Artificially Synthesized Primer Sequence
tatgagccatggtgacttgg

SEQ ID NO: 14677 - DNA, 20 bp, Artificial Sequence
  Artificially Synthesized Primer Sequence
gttgtgcagttctgctggaa

SEQ ID NO: 14678 - DNA, 20 bp, Artificial Sequence
  Artificially Synthesized Primer Sequence
cccaacacatgaacaacagg

SEQ ID NO: 14679 - DNA, 20 bp, Artificial Sequence
  Artificially Synthesized Primer Sequence
cccaacacatgaacaacagg

SEQ ID NO: 14680 - DNA, 20 bp, Artificial Sequence
  Artificially Synthesized Primer Sequence
gttgtgcagttctgctggaa

SEQ ID NO: 14681 - DNA, 19 bp, Artificial Sequence
  Artificially Synthesized Primer Sequence
gggggaccaaaatttcttt

SEQ ID NO: 14682 - DNA, 20 bp, Artificial Sequence
  Artificially Synthesized Primer Sequence
tccccctctttttctttttc

SEQ ID NO: 14683 - DNA, 20 bp, Artificial Sequence
  Artificially Synthesized Primer Sequence
gcatcgcccgtttagataga

SEQ ID NO: 14684 - DNA, 20 bp, Artificial Sequence
  Artificially Synthesized Primer Sequence
ctgttccggtgctatggttt

SEQ ID NO: 14685 - DNA, 20 bp, Artificial Sequence
  Artificially Synthesized Primer Sequence
caaaggtgtttgccacattg

SEQ ID NO: 14686 - DNA, 20 bp, Artificial Sequence
  Artificially Synthesized Primer Sequence
acaccattctttccaccagc

SEQ ID NO: 14687 - DNA, 21 bp, Artificial Sequence
  Artificially Synthesized Primer Sequence
tcatcacgacacacacacaga

SEQ ID NO: 14688 - DNA, 20 bp, Artificial Sequence
  Artificially Synthesized Primer Sequence
ggcaaaacatgttcccagat

SEQ ID NO: 14689 - DNA, 20 bp, Artificial Sequence
  Artificially Synthesized Primer Sequence
ggtaatcaaggtccccgtct

SEQ ID NO: 14690 - DNA, 20 bp, Artificial Sequence
  Artificially Synthesized Primer Sequence
gggcatcgatgagttcagtt

SEQ ID NO: 14691 - DNA, 20 bp, Artificial Sequence
  Artificially Synthesized Primer Sequence
tttgaactattgggggcatc

SEQ ID NO: 14692 - DNA, 20 bp, Artificial Sequence
  Artificially Synthesized Primer Sequence
ttcagggtggagaactggac

SEQ ID NO: 14693 - DNA, 20 bp, Artificial Sequence
  Artificially Synthesized Primer Sequence
gctaacctagcctcctccgt

SEQ ID NO: 14694 - DNA, 20 bp, Artificial Sequence
  Artificially Synthesized Primer Sequence
gtttgcctagaagcagccac

SEQ ID NO: 14695 - DNA, 20 bp, Artificial Sequence
  Artificially Synthesized Primer Sequence
cctgcagctcttcatggttt

SEQ ID NO: 14696 - DNA, 20 bp, Artificial Sequence
  Artificially Synthesized Primer Sequence
attttgccactacggctgtc

SEQ ID NO: 14697 - DNA, 20 bp, Artificial Sequence
  Artificially Synthesized Primer Sequence
acactggcttcactatgggg

SEQ ID NO: 14698 - DNA, 20 bp, Artificial Sequence
  Artificially Synthesized Primer Sequence
agcgcaagattgtcctgaat

SEQ ID NO: 14699 - DNA, 20 bp, Artificial Sequence
  Artificially Synthesized Primer Sequence
aaatcacaggacttgggcag

SEQ ID NO: 14700 - DNA, 20 bp, Artificial Sequence
  Artificially Synthesized Primer Sequence
acactggcttcactatgggg

SEQ ID NO: 14701 - DNA, 20 bp, Artificial Sequence
  Artificially Synthesized Primer Sequence
aaggagtccacccttcacct

SEQ ID NO: 14702 - DNA, 20 bp, Artificial Sequence
  Artificially Synthesized Primer Sequence
ctccttgtcctggatcttcg

SEQ ID NO: 14703 - DNA, 20 bp, Artificial Sequence
  Artificially Synthesized Primer Sequence
cgtcgacaccagacctatga

SEQ ID NO: 14704 - DNA, 21 bp, Artificial Sequence
  Artificially Synthesized Primer Sequence
gcaccctggctgactataaca

SEQ ID NO: 14705 - DNA, 20 bp, Artificial Sequence
  Artificially Synthesized Primer Sequence
agaaacgtctcagcctggaa

SEQ ID NO: 14706 - DNA, 20 bp, Artificial Sequence
  Artificially Synthesized Primer Sequence
accaaaacgggtgaactgag

SEQ ID NO: 14707 - DNA, 20 bp, Artificial Sequence
  Artificially Synthesized Primer Sequence
caccaaaccaagtgatgtgc

SEQ ID NO: 14708 - DNA, 20 bp, Artificial Sequence
  Artificially Synthesized Primer Sequence
agaaagagcattggtacccg

SEQ ID NO: 14709 - DNA, 20 bp, Artificial Sequence
  Artificially Synthesized Primer Sequence
cgacaggtgacaacagatgg

SEQ ID NO: 14710 - DNA, 20 bp, Artificial Sequence
  Artificially Synthesized Primer Sequence
gggagaatgacgcaggaata

SEQ ID NO: 14711 - DNA, 20 bp, Artificial Sequence
  Artificially Synthesized Primer Sequence
agatatgtcgagggcagcac

SEQ ID NO: 14712 - DNA, 20 bp, Artificial Sequence
  Artificially Synthesized Primer Sequence
agagggccttgtttggagat

SEQ ID NO: 14713 - DNA, 20 bp, Artificial Sequence
  Artificially Synthesized Primer Sequence
tgtacaacatgcgccaattt

SEQ ID NO: 14714 - DNA, 20 bp, Artificial Sequence
  Artificially Synthesized Primer Sequence
ttctaagttcatcgggggtg

SEQ ID NO: 14715 - DNA, 20 bp, Artificial Sequence
  Artificially Synthesized Primer Sequence
tcctgcgtagcacagaacag

SEQ ID NO: 14716 - DNA, 20 bp, Artificial Sequence
  Artificially Synthesized Primer Sequence
cacccccgatgaacttagaa

SEQ ID NO: 14717 - DNA, 20 bp, Artificial Sequence
  Artificially Synthesized Primer Sequence
atctgcgctctcatgcctat

SEQ ID NO: 14718 - DNA, 20 bp, Artificial Sequence
  Artificially Synthesized Primer Sequence
ccctccagggtcttcttagg

SEQ ID NO: 14719 - DNA, 20 bp, Artificial Sequence
  Artificially Synthesized Primer Sequence
ttagttagcagccgcatcct

SEQ ID NO: 14720 - DNA, 20 bp, Artificial Sequence
  Artificially Synthesized Primer Sequence
tgggatcctgatctttctgg

SEQ ID NO: 14721 - DNA, 20 bp, Artificial Sequence
  Artificially Synthesized Primer Sequence
cgctgatttcagttggttga

SEQ ID NO: 14722 - DNA, 20 bp, Artificial Sequence
  Artificially Synthesized Primer Sequence
aggccttgtacagcctctca

SEQ ID NO: 14723 - DNA, 20 bp, Artificial Sequence
  Artificially Synthesized Primer Sequence
gtgcccagaaactctgaagc

SEQ ID NO: 14724 - DNA, 20 bp, Artificial Sequence
  Artificially Synthesized Primer Sequence
aacgagctgcaggttgagat

SEQ ID NO: 14725 - DNA, 20 bp, Artificial Sequence
  Artificially Synthesized Primer Sequence
ctctcgtcctcctcaccaag

SEQ ID NO: 14726 - DNA, 20 bp, Artificial Sequence
  Artificially Synthesized Primer Sequence
agacacaaccgaacaggtcc

SEQ ID NO: 14727 - DNA, 20 bp, Artificial Sequence
  Artificially Synthesized Primer Sequence
agacacaaccgaacaggtcc

SEQ ID NO: 14728 - DNA, 20 bp, Artificial Sequence
  Artificially Synthesized Primer Sequence
ctctcgtcctcctcaccaag

SEQ ID NO: 14729 - DNA, 20 bp, Artificial Sequence
  Artificially Synthesized Primer Sequence
tcatcacccgtaacaaccaa

SEQ ID NO: 14730 - DNA, 20 bp, Artificial Sequence
  Artificially Synthesized Primer Sequence
agatggataagtgcccaacg

SEQ ID NO: 14731 - DNA, 20 bp, Artificial Sequence
  Artificially Synthesized Primer Sequence
tacagagggagtgctcgttg

SEQ ID NO: 14732 - DNA, 19 bp, Artificial Sequence
  Artificially Synthesized Primer Sequence
aggataccgcatgattccc

SEQ ID NO: 14733 - DNA, 20 bp, Artificial Sequence
  Artificially Synthesized Primer Sequence
gcgattgaagaataaccgga

SEQ ID NO: 14734 - DNA, 20 bp, Artificial Sequence
  Artificially Synthesized Primer Sequence
ttcgaactcatgtcagcgag

SEQ ID NO: 14735 - DNA, 20 bp, Artificial Sequence
  Artificially Synthesized Primer Sequence
acagctttgatgccaggaac

SEQ ID NO: 14736 - DNA, 20 bp, Artificial Sequence
  Artificially Synthesized Primer Sequence
acaataacatctggcgaggg

SEQ ID NO: 14737 - DNA, 20 bp, Artificial Sequence
  Artificially Synthesized Primer Sequence
gaagaggacaaggctgaacg

SEQ ID NO: 14738 - DNA, 20 bp, Artificial Sequence
  Artificially Synthesized Primer Sequence
ccgaaagaaaggattggtga

SEQ ID NO: 14739 - DNA, 22 bp, Artificial Sequence
  Artificially Synthesized Primer Sequence
attcgacaactgttcgtcacac

SEQ ID NO: 14740 - DNA, 20 bp, Artificial Sequence
  Artificially Synthesized Primer Sequence
agggctttccaaacactcct

SEQ ID NO: 14741 - DNA, 20 bp, Artificial Sequence
  Artificially Synthesized Primer Sequence
cttgccttttaactcggctg

SEQ ID NO: 14742 - DNA, 20 bp, Artificial Sequence
  Artificially Synthesized Primer Sequence
aaaagcggcgacaactaaga

SEQ ID NO: 14743 - DNA, 20 bp, Artificial Sequence
  Artificially Synthesized Primer Sequence
gctcattttccgccagatag

SEQ ID NO: 14744 - DNA, 20 bp, Artificial Sequence
  Artificially Synthesized Primer Sequence
gagaagaaagctgtgcgagg

SEQ ID NO: 14745 - DNA, 20 bp, Artificial Sequence
  Artificially Synthesized Primer Sequence
gctgctgtgggtggattatt

SEQ ID NO: 14746 - DNA, 20 bp, Artificial Sequence
  Artificially Synthesized Primer Sequence
tttgatagcgccagaacctt

SEQ ID NO: 14747 - DNA, 20 bp, Artificial Sequence
  Artificially Synthesized Primer Sequence
agaactctgaacccgcacat

SEQ ID NO: 14748 - DNA, 20 bp, Artificial Sequence
  Artificially Synthesized Primer Sequence
ctggcgctatcaaaggaaac

SEQ ID NO: 14749 - DNA, 20 bp, Artificial Sequence
  Artificially Synthesized Primer Sequence
gcacaacctttcctaaccca

SEQ ID NO: 14750 - DNA, 20 bp, Artificial Sequence
  Artificially Synthesized Primer Sequence
agaggacatggcgttactgg

SEQ ID NO: 14751 - DNA, 20 bp, Artificial Sequence
  Artificially Synthesized Primer Sequence
agccttccttcaccaacaaa

SEQ ID NO: 14752 - DNA, 20 bp, Artificial Sequence
  Artificially Synthesized Primer Sequence
atcaaggagaaaactcgcca

SEQ ID NO: 14753 - DNA, 20 bp, Artificial Sequence
  Artificially Synthesized Primer Sequence
cggttggaggtcctttatga

SEQ ID NO: 14754 - DNA, 20 bp, Artificial Sequence
  Artificially Synthesized Primer Sequence
agctccattccaacaccatc

SEQ ID NO: 14755 - DNA, 20 bp, Artificial Sequence
  Artificially Synthesized Primer Sequence
atttgtatgcctcaccctgc

SEQ ID NO: 14756 - DNA, 20 bp, Artificial Sequence
  Artificially Synthesized Primer Sequence
aactctttgccatggaggtg

SEQ ID NO: 14757 - DNA, 20 bp, Artificial Sequence
  Artificially Synthesized Primer Sequence
gagaagctgctgaggcaagt

SEQ ID NO: 14758 - DNA, 20 bp, Artificial Sequence
  Artificially Synthesized Primer Sequence
ctaaacggctacgccaaaag

SEQ ID NO: 14759 - DNA, 20 bp, Artificial Sequence
  Artificially Synthesized Primer Sequence
tacaacttgcaaccacgcat

SEQ ID NO: 14760 - DNA, 20 bp, Artificial Sequence
  Artificially Synthesized Primer Sequence
gatctgtgcgaagctgatga

SEQ ID NO: 14761 - DNA, 20 bp, Artificial Sequence
  Artificially Synthesized Primer Sequence
gcgactatggttgggacact

SEQ ID NO: 14762 - DNA, 20 bp, Artificial Sequence
  Artificially Synthesized Primer Sequence
tttaccttaagctcggcgaa

SEQ ID NO: 14763 - DNA, 20 bp, Artificial Sequence
  Artificially Synthesized Primer Sequence
cctcatggtgggcatagtct

SEQ ID NO: 14764 - DNA, 20 bp, Artificial Sequence
  Artificially Synthesized Primer Sequence
gaggttgtttggttcaaggc

SEQ ID NO: 14765 - DNA, 20 bp, Artificial Sequence
  Artificially Synthesized Primer Sequence
tgaagtcgttgaagtcgtcg

SEQ ID NO: 14766 - DNA, 20 bp, Artificial Sequence
  Artificially Synthesized Primer Sequence
aagatgcacagaggaccacc

SEQ ID NO: 14767 - DNA, 20 bp, Artificial Sequence
  Artificially Synthesized Primer Sequence
gttctaagggtgcccagaca

SEQ ID NO: 14768 - DNA, 20 bp, Artificial Sequence
  Artificially Synthesized Primer Sequence
gctcgaactcatcaaggacc

SEQ ID NO: 14769 - DNA, 20 bp, Artificial Sequence
  Artificially Synthesized Primer Sequence
cgagttcgacatcgtcttca

SEQ ID NO: 14770 - DNA, 20 bp, Artificial Sequence
  Artificially Synthesized Primer Sequence
tatttgcacgttttcaggca

SEQ ID NO: 14771 - DNA, 20 bp, Artificial Sequence
  Artificially Synthesized Primer Sequence
attccacggcgagtttattg

SEQ ID NO: 14772 - DNA, 20 bp, Artificial Sequence
  Artificially Synthesized Primer Sequence
gaactgcagggtcaaggaag

SEQ ID NO: 14773 - DNA, 20 bp, Artificial Sequence
  Artificially Synthesized Primer Sequence
cttaccttttcccccgaaag

SEQ ID NO: 14774 - DNA, 20 bp, Artificial Sequence
  Artificially Synthesized Primer Sequence
ggcattgccccagaatagta

SEQ ID NO: 14775 - DNA, 20 bp, Artificial Sequence
  Artificially Synthesized Primer Sequence
ttcatggcatgcacaatctt

SEQ ID NO: 14776 - DNA, 20 bp, Artificial Sequence
  Artificially Synthesized Primer Sequence
cggctcccagatctttagtg

SEQ ID NO: 14777 - DNA, 20 bp, Artificial Sequence
  Artificially Synthesized Primer Sequence
acatcacctcaagtccccac

SEQ ID NO: 14778 - DNA, 20 bp, Artificial Sequence
  Artificially Synthesized Primer Sequence
ccagtcctctggcttctgtc

SEQ ID NO: 14779 - DNA, 20 bp, Artificial Sequence
  Artificially Synthesized Primer Sequence
cttcaccggctcgtagattc

SEQ ID NO: 14780 - DNA, 20 bp, Artificial Sequence
  Artificially Synthesized Primer Sequence
tgagaagggagagaagcagc

SEQ ID NO: 14781 - DNA, 20 bp, Artificial Sequence
  Artificially Synthesized Primer Sequence
caagttgtggcaaatgatgg

SEQ ID NO: 14782 - DNA, 20 bp, Artificial Sequence
  Artificially Synthesized Primer Sequence
aacttccctgtcttcccgtt

SEQ ID NO: 14783 - DNA, 20 bp, Artificial Sequence
  Artificially Synthesized Primer Sequence
cagaaacacacacccttcca

SEQ ID NO: 14784 - DNA, 20 bp, Artificial Sequence
  Artificially Synthesized Primer Sequence
ctgcggaccgttacagtttt

SEQ ID NO: 14785 - DNA, 20 bp, Artificial Sequence
  Artificially Synthesized Primer Sequence
gttgttccacgagtccttcg

SEQ ID NO: 14786 - DNA, 20 bp, Artificial Sequence
  Artificially Synthesized Primer Sequence
ttcgaactgcaggacaactg

SEQ ID NO: 14787 - DNA, 20 bp, Artificial Sequence
  Artificially Synthesized Primer Sequence
ttcgaactgcaggacaactg

SEQ ID NO: 14788 - DNA, 20 bp, Artificial Sequence
  Artificially Synthesized Primer Sequence
gtctccggcaaggaagagta

SEQ ID NO: 14789 - DNA, 20 bp, Artificial Sequence
  Artificially Synthesized Primer Sequence
cccaatgcagttccagagtt

SEQ ID NO: 14790 - DNA, 20 bp, Artificial Sequence
  Artificially Synthesized Primer Sequence
cacagcttgacaaccctcaa

SEQ ID NO: 14791 - DNA, 20 bp, Artificial Sequence
  Artificially Synthesized Primer Sequence
agttcttcccacacgacgat

SEQ ID NO: 14792 - DNA, 20 bp, Artificial Sequence
  Artificially Synthesized Primer Sequence
gcaaaagagatcctgggaca

SEQ ID NO: 14793 - DNA, 20 bp, Artificial Sequence
  Artificially Synthesized Primer Sequence
ctggaatcaggctggaacat

SEQ ID NO: 14794 - DNA, 20 bp, Artificial Sequence
  Artificially Synthesized Primer Sequence
acttgtcgtcccattcaagg

SEQ ID NO: 14795 - DNA, 20 bp, Artificial Sequence
  Artificially Synthesized Primer Sequence
cagcaacgcttaatccaaca

SEQ ID NO: 14796 - DNA, 19 bp, Artificial Sequence
  Artificially Synthesized Primer Sequence
gaagtcaccaaatgctccg

SEQ ID NO: 14797 - DNA, 20 bp, Artificial Sequence
  Artificially Synthesized Primer Sequence
ccagcctaagcaagtggaag

SEQ ID NO: 14798 - DNA, 20 bp, Artificial Sequence
  Artificially Synthesized Primer Sequence
cctttgctctggcagaaaac

SEQ ID NO: 14799 - DNA, 20 bp, Artificial Sequence
  Artificially Synthesized Primer Sequence
ggaactagcaggcaaaatcg

SEQ ID NO: 14800 - DNA, 20 bp, Artificial Sequence
  Artificially Synthesized Primer Sequence
gtttcctgcaagagcagagg

SEQ ID NO: 14801 - DNA, 20 bp, Artificial Sequence
  Artificially Synthesized Primer Sequence
ccgagacatttgctatgggt

SEQ ID NO: 14802 - DNA, 20 bp, Artificial Sequence
  Artificially Synthesized Primer Sequence
tggcatttcatagcatccaa

SEQ ID NO: 14803 - DNA, 20 bp, Artificial Sequence
  Artificially Synthesized Primer Sequence
ccatcttcttgtacagcgca

SEQ ID NO: 14804 - DNA, 20 bp, Artificial Sequence
  Artificially Synthesized Primer Sequence
gaacctgaagaagctgtggc

SEQ ID NO: 14805 - DNA, 20 bp, Artificial Sequence
  Artificially Synthesized Primer Sequence
gaatcaaagcgtcgaggaag

SEQ ID NO: 14806 - DNA, 20 bp, Artificial Sequence
  Artificially Synthesized Primer Sequence
ctgtgaccaatgacaaaccg

SEQ ID NO: 14807 - DNA, 20 bp, Artificial Sequence
  Artificially Synthesized Primer Sequence
caggattcagggacgtgttt

SEQ ID NO: 14808 - DNA, 20 bp, Artificial Sequence
  Artificially Synthesized Primer Sequence
atatgcaactcggaaggcag

SEQ ID NO: 14809 - DNA, 20 bp, Artificial Sequence
  Artificially Synthesized Primer Sequence
aagctgctcctcggtttgta

SEQ ID NO: 14810 - DNA, 20 bp, Artificial Sequence
  Artificially Synthesized Primer Sequence
ttggtgtttggggtgttttt

SEQ ID NO: 14811 - DNA, 20 bp, Artificial Sequence
  Artificially Synthesized Primer Sequence
atgaccccaaaacttccctt

SEQ ID NO: 14812 - DNA, 20 bp, Artificial Sequence
  Artificially Synthesized Primer Sequence
tgatgggctcgacatctaca

SEQ ID NO: 14813 - DNA, 20 bp, Artificial Sequence
  Artificially Synthesized Primer Sequence
aggcagcaaggaagcaaata

SEQ ID NO: 14814 - DNA, 20 bp, Artificial Sequence
  Artificially Synthesized Primer Sequence
atttgtgccatccatccatt

SEQ ID NO: 14815 - DNA, 20 bp, Artificial Sequence
  Artificially Synthesized Primer Sequence
tacaggggatctctgctgct

SEQ ID NO: 14816 - DNA, 20 bp, Artificial Sequence
  Artificially Synthesized Primer Sequence
tgtgggcatctggtgataga

SEQ ID NO: 14817 - DNA, 20 bp, Artificial Sequence
  Artificially Synthesized Primer Sequence
ctggtggagatggttccagt

SEQ ID NO: 14818 - DNA, 20 bp, Artificial Sequence
  Artificially Synthesized Primer Sequence
ttctgaaggacaagagccgt

SEQ ID NO: 14819 - DNA, 20 bp, Artificial Sequence
  Artificially Synthesized Primer Sequence
gcggagaacatacaaggcat

SEQ ID NO: 14820 - DNA, 20 bp, Artificial Sequence
  Artificially Synthesized Primer Sequence
gctatgcaaacggaattggt

SEQ ID NO: 14821 - DNA, 20 bp, Artificial Sequence
  Artificially Synthesized Primer Sequence
tctgcacgaggcaattactg

SEQ ID NO: 14822 - DNA, 20 bp, Artificial Sequence
  Artificially Synthesized Primer Sequence
tctcgctgtgttcacgattc

SEQ ID NO: 14823 - DNA, 20 bp, Artificial Sequence
  Artificially Synthesized Primer Sequence
caattccggcagaggaataa

SEQ ID NO: 14824 - DNA, 20 bp, Artificial Sequence
  Artificially Synthesized Primer Sequence
gttggcctaacgaagaacca

SEQ ID NO: 14825 - DNA, 20 bp, Artificial Sequence
  Artificially Synthesized Primer Sequence
aatgagacatttgaaggcgg

SEQ ID NO: 14826 - DNA, 20 bp, Artificial Sequence
  Artificially Synthesized Primer Sequence
agcgagttgctcattcctgt

SEQ ID NO: 14827 - DNA, 20 bp, Artificial Sequence
  Artificially Synthesized Primer Sequence
cgagttgctcattcctgtca

SEQ ID NO: 14828 - DNA, 20 bp, Artificial Sequence
  Artificially Synthesized Primer Sequence
aatgagacatttgaaggcgg

SEQ ID NO: 14829 - DNA, 20 bp, Artificial Sequence
  Artificially Synthesized Primer Sequence
tggaagctggacacactctg

SEQ ID NO: 14830 - DNA, 20 bp, Artificial Sequence
  Artificially Synthesized Primer Sequence
cttctggatgtcgaacagca

SEQ ID NO: 14831 - DNA, 20 bp, Artificial Sequence
  Artificially Synthesized Primer Sequence
cttctggatgtcgaacagca

SEQ ID NO: 14832 - DNA, 20 bp, Artificial Sequence
  Artificially Synthesized Primer Sequence
tggaagctggacacactctg

SEQ ID NO: 14833 - DNA, 20 bp, Artificial Sequence
  Artificially Synthesized Primer Sequence
ggttgttgcgcatcctactt

SEQ ID NO: 14834 - DNA, 20 bp, Artificial Sequence
  Artificially Synthesized Primer Sequence
cgtgtttcttctgaatcgca

SEQ ID NO: 14835 - DNA, 20 bp, Artificial Sequence
  Artificially Synthesized Primer Sequence
tgtgaagattccacttgcca

SEQ ID NO: 14836 - DNA, 20 bp, Artificial Sequence
  Artificially Synthesized Primer Sequence
gagggaactgcaaaaagctg

SEQ ID NO: 14837 - DNA, 20 bp, Artificial Sequence
  Artificially Synthesized Primer Sequence
gcttgcctgttggacttctc

SEQ ID NO: 14838 - DNA, 20 bp, Artificial Sequence
  Artificially Synthesized Primer Sequence
tctccctgacatgatccctc

SEQ ID NO: 14839 - DNA, 20 bp, Artificial Sequence
  Artificially Synthesized Primer Sequence
ggcagactcgacatcacaga

SEQ ID NO: 14840 - DNA, 20 bp, Artificial Sequence
  Artificially Synthesized Primer Sequence
cggcccgatgtactcactat

SEQ ID NO: 14841 - DNA, 20 bp, Artificial Sequence
  Artificially Synthesized Primer Sequence
aaggagtccacccttcacct

SEQ ID NO: 14842 - DNA, 20 bp, Artificial Sequence
  Artificially Synthesized Primer Sequence
cagacgcaaacgagaaaaca

SEQ ID NO: 14843 - DNA, 20 bp, Artificial Sequence
  Artificially Synthesized Primer Sequence
cagacgcaaacgagaaaaca

SEQ ID NO: 14844 - DNA, 20 bp, Artificial Sequence
  Artificially Synthesized Primer Sequence
aggagtccacccttcacctt

SEQ ID NO: 14845 - DNA, 20 bp, Artificial Sequence
  Artificially Synthesized Primer Sequence
tcaagtacttaccgggtgcc

SEQ ID NO: 14846 - DNA, 20 bp, Artificial Sequence
  Artificially Synthesized Primer Sequence
ccatggcacagttgtaggtg

SEQ ID NO: 14847 - DNA, 20 bp, Artificial Sequence
  Artificially Synthesized Primer Sequence
gggttccagaatcagcttca

SEQ ID NO: 14848 - DNA, 20 bp, Artificial Sequence
  Artificially Synthesized Primer Sequence
tcaagtacttaccgggtgcc

SEQ ID NO: 14849 - DNA, 20 bp, Artificial Sequence
  Artificially Synthesized Primer Sequence
atgcatctcgcactgtatcg

SEQ ID NO: 14850 - DNA, 20 bp, Artificial Sequence
  Artificially Synthesized Primer Sequence
ttctcgcggaagcttgtaat

SEQ ID NO: 14851 - DNA, 20 bp, Artificial Sequence
  Artificially Synthesized Primer Sequence
aaaacacgaccaggcttgag

SEQ ID NO: 14852 - DNA, 20 bp, Artificial Sequence
  Artificially Synthesized Primer Sequence
tgccaaagacctatccatcg

SEQ ID NO: 14853 - DNA, 20 bp, Artificial Sequence
  Artificially Synthesized Primer Sequence
tggatgcagagctgaatgag

SEQ ID NO: 14854 - DNA, 20 bp, Artificial Sequence
  Artificially Synthesized Primer Sequence
gacgtgttgtgtatttgccg

SEQ ID NO: 14855 - DNA, 20 bp, Artificial Sequence
  Artificially Synthesized Primer Sequence
aacgcattctccagaacacc

SEQ ID NO: 14856 - DNA, 20 bp, Artificial Sequence
  Artificially Synthesized Primer Sequence
cgcttcaagatgctgtcaaa

SEQ ID NO: 14857 - DNA, 20 bp, Artificial Sequence
  Artificially Synthesized Primer Sequence
ctgttaggacgaacccgaaa

SEQ ID NO: 14858 - DNA, 20 bp, Artificial Sequence
  Artificially Synthesized Primer Sequence
gccggacagagaacaagaag

SEQ ID NO: 14859 - DNA, 20 bp, Artificial Sequence
  Artificially Synthesized Primer Sequence
attttccagtcgggtgaaca

SEQ ID NO: 14860 - DNA, 20 bp, Artificial Sequence
  Artificially Synthesized Primer Sequence
caccggaactacaaggtcgt

SEQ ID NO: 14861 - DNA, 20 bp, Artificial Sequence
  Artificially Synthesized Primer Sequence
taatttcggaatacgcaggc

SEQ ID NO: 14862 - DNA, 20 bp, Artificial Sequence
  Artificially Synthesized Primer Sequence
tacgcgaatcgtagatgctg

SEQ ID NO: 14863 - DNA, 20 bp, Artificial Sequence
  Artificially Synthesized Primer Sequence
aatgccaaatggtaggcaac

SEQ ID NO: 14864 - DNA, 20 bp, Artificial Sequence
  Artificially Synthesized Primer Sequence
aaggtgattcacatccgctc

SEQ ID NO: 14865 - DNA, 20 bp, Artificial Sequence
  Artificially Synthesized Primer Sequence
agtagcagcagcagggagag

SEQ ID NO: 14866 - DNA, 20 bp, Artificial Sequence
  Artificially Synthesized Primer Sequence
cttgctccctgaaactggag

SEQ ID NO: 14867 - DNA, 20 bp, Artificial Sequence
  Artificially Synthesized Primer Sequence
ggcacgtggttttaagcatt

SEQ ID NO: 14868 - DNA, 20 bp, Artificial Sequence
  Artificially Synthesized Primer Sequence
aatgctttctccgagggact

SEQ ID NO: 14869 - DNA, 20 bp, Artificial Sequence
  Artificially Synthesized Primer Sequence
aaaaaccccttgtattgggc

SEQ ID NO: 14870 - DNA, 20 bp, Artificial Sequence
  Artificially Synthesized Primer Sequence
ggatttttcctccccaaaaa

SEQ ID NO: 14871 - DNA, 20 bp, Artificial Sequence
  Artificially Synthesized Primer Sequence
tgtctaattcagcaccgcag

SEQ ID NO: 14872 - DNA, 20 bp, Artificial Sequence
  Artificially Synthesized Primer Sequence
gacgtcagcgaaatgtcaga

SEQ ID NO: 14873 - DNA, 20 bp, Artificial Sequence
  Artificially Synthesized Primer Sequence
gggggtggttgaatttcttt

SEQ ID NO: 14874 - DNA, 20 bp, Artificial Sequence
  Artificially Synthesized Primer Sequence
tccttcggaaaagaaagggt

SEQ ID NO: 14875 - DNA, 20 bp, Artificial Sequence
  Artificially Synthesized Primer Sequence
agcttccaagcttcttgctg

SEQ ID NO: 14876 - DNA, 20 bp, Artificial Sequence
  Artificially Synthesized Primer Sequence
ataagcaagcacaaggccac

SEQ ID NO: 14877 - DNA, 20 bp, Artificial Sequence
  Artificially Synthesized Primer Sequence
tgttttctcgtttgcgtctg

SEQ ID NO: 14878 - DNA, 20 bp, Artificial Sequence
  Artificially Synthesized Primer Sequence
aggaggatatttggggatgg

SEQ ID NO: 14879 - DNA, 20 bp, Artificial Sequence
  Artificially Synthesized Primer Sequence
aattgaacagacagggcacc

SEQ ID NO: 14880 - DNA, 20 bp, Artificial Sequence
  Artificially Synthesized Primer Sequence
aagacattgacgggcaagac

SEQ ID NO: 14881 - DNA, 20 bp, Artificial Sequence
  Artificially Synthesized Primer Sequence
ttacatgccaggcagaagtg

SEQ ID NO: 14882 - DNA, 20 bp, Artificial Sequence
  Artificially Synthesized Primer Sequence
ccaccaagagcgtaacgaat

SEQ ID NO: 14883 - DNA, 20 bp, Artificial Sequence
  Artificially Synthesized Primer Sequence
agcgtatggtttgttcaggg

SEQ ID NO: 14884 - DNA, 20 bp, Artificial Sequence
  Artificially Synthesized Primer Sequence
ttcttgcagttgcaggtttg

SEQ ID NO: 14885 - DNA, 20 bp, Artificial Sequence
  Artificially Synthesized Primer Sequence
agggattctgttcgtggatg

SEQ ID NO: 14886 - DNA, 20 bp, Artificial Sequence
  Artificially Synthesized Primer Sequence
ccagacctccgttcatctgt

SEQ ID NO: 14887 - DNA, 20 bp, Artificial Sequence
  Artificially Synthesized Primer Sequence
ccagacctccgttcatctgt

SEQ ID NO: 14888 - DNA, 20 bp, Artificial Sequence
  Artificially Synthesized Primer Sequence
agggattctgttcgtggatg

SEQ ID NO: 14889 - DNA, 20 bp, Artificial Sequence
  Artificially Synthesized Primer Sequence
ggcaaggttgtaaaggtgga

SEQ ID NO: 14890 - DNA, 20 bp, Artificial Sequence
  Artificially Synthesized Primer Sequence
ttgcttcttgttttgcgatg

SEQ ID NO: 14891 - DNA, 20 bp, Artificial Sequence
  Artificially Synthesized Primer Sequence
tcgaatgtttcaggagtccc

SEQ ID NO: 14892 - DNA, 20 bp, Artificial Sequence
  Artificially Synthesized Primer Sequence
ccgaatctgctgcttgtgta

SEQ ID NO: 14893 - DNA, 20 bp, Artificial Sequence
  Artificially Synthesized Primer Sequence
agggtcttctctctgggagg

SEQ ID NO: 14894 - DNA, 20 bp, Artificial Sequence
  Artificially Synthesized Primer Sequence
gttgaagatctcgccgtagg

SEQ ID NO: 14895 - DNA, 20 bp, Artificial Sequence
  Artificially Synthesized Primer Sequence
acattttacacccaccctcg

SEQ ID NO: 14896 - DNA, 20 bp, Artificial Sequence
  Artificially Synthesized Primer Sequence
gcagtacttcctgggtctcg

SEQ ID NO: 14897 - DNA, 20 bp, Artificial Sequence
  Artificially Synthesized Primer Sequence
ctcgtaaaaccacgggaaaa

SEQ ID NO: 14898 - DNA, 20 bp, Artificial Sequence
  Artificially Synthesized Primer Sequence
gccattaaaactgcccttga

SEQ ID NO: 14899 - DNA, 20 bp, Artificial Sequence
  Artificially Synthesized Primer Sequence
tactccaccaaaagatgccc

SEQ ID NO: 14900 - DNA, 20 bp, Artificial Sequence
  Artificially Synthesized Primer Sequence
cgacaagctaatgcaaccaa

SEQ ID NO: 14901 - DNA, 20 bp, Artificial Sequence
  Artificially Synthesized Primer Sequence
catggccttagagcttaccg

SEQ ID NO: 14902 - DNA, 20 bp, Artificial Sequence
  Artificially Synthesized Primer Sequence
agaaacggcgaggtagacaa

SEQ ID NO: 14903 - DNA, 20 bp, Artificial Sequence
  Artificially Synthesized Primer Sequence
gcaaagaaatagaacgggca

SEQ ID NO: 14904 - DNA, 20 bp, Artificial Sequence
  Artificially Synthesized Primer Sequence
tcctcctgctgctacctctc

SEQ ID NO: 14905 - DNA, 20 bp, Artificial Sequence
  Artificially Synthesized Primer Sequence
tcagagagtcaggggcaagt

SEQ ID NO: 14906 - DNA, 20 bp, Artificial Sequence
  Artificially Synthesized Primer Sequence
aatcccccacgttcatcata

SEQ ID NO: 14907 - DNA, 20 bp, Artificial Sequence
  Artificially Synthesized Primer Sequence
atactgcgggcagcttacat

SEQ ID NO: 14908 - DNA, 20 bp, Artificial Sequence
  Artificially Synthesized Primer Sequence
actggaggatgaattggctg

SEQ ID NO: 14909 - DNA, 20 bp, Artificial Sequence
  Artificially Synthesized Primer Sequence
gctcaacatgttcttggggt

SEQ ID NO: 14910 - DNA, 20 bp, Artificial Sequence
  Artificially Synthesized Primer Sequence
caagcttttgagaaggaccg

SEQ ID NO: 14911 - DNA, 20 bp, Artificial Sequence
  Artificially Synthesized Primer Sequence
cgcgacatctctcttctcct

SEQ ID NO: 14912 - DNA, 20 bp, Artificial Sequence
  Artificially Synthesized Primer Sequence
ggactgtgacgcagcaacta

SEQ ID NO: 14913 - DNA, 20 bp, Artificial Sequence
  Artificially Synthesized Primer Sequence
cacagctccgaaagcacata

SEQ ID NO: 14914 - DNA, 20 bp, Artificial Sequence
  Artificially Synthesized Primer Sequence
tcctgaagttgggtgaaagg

SEQ ID NO: 14915 - DNA, 20 bp, Artificial Sequence
  Artificially Synthesized Primer Sequence
gctatcacaacccaacccaa

SEQ ID NO: 14916 - DNA, 20 bp, Artificial Sequence
  Artificially Synthesized Primer Sequence
accgaactaaacatggctgc

SEQ ID NO: 14917 - DNA, 20 bp, Artificial Sequence
  Artificially Synthesized Primer Sequence
ggttggtcgagtggacatct

SEQ ID NO: 14918 - DNA, 20 bp, Artificial Sequence
  Artificially Synthesized Primer Sequence
agtccaggctacttggagca

SEQ ID NO: 14919 - DNA, 20 bp, Artificial Sequence
  Artificially Synthesized Primer Sequence
tctcaaagtcctcctgcgtt

SEQ ID NO: 14920 - DNA, 20 bp, Artificial Sequence
  Artificially Synthesized Primer Sequence
gggagcatgcaccatctatt

SEQ ID NO: 14921 - DNA, 20 bp, Artificial Sequence
  Artificially Synthesized Primer Sequence
gatggtggaggagaaggtca

SEQ ID NO: 14922 - DNA, 20 bp, Artificial Sequence
  Artificially Synthesized Primer Sequence
tcttcttcatctgatccggg

SEQ ID NO: 14923 - DNA, 20 bp, Artificial Sequence
  Artificially Synthesized Primer Sequence
gtgacatggttcacacaggc

SEQ ID NO: 14924 - DNA, 20 bp, Artificial Sequence
  Artificially Synthesized Primer Sequence
tggctgtgttggagtttgag

SEQ ID NO: 14925 - DNA, 20 bp, Artificial Sequence
  Artificially Synthesized Primer Sequence
acatccacggccagttctac

SEQ ID NO: 14926 - DNA, 20 bp, Artificial Sequence
  Artificially Synthesized Primer Sequence
gtatgcgatcaagagcacga

SEQ ID NO: 14927 - DNA, 20 bp, Artificial Sequence
  Artificially Synthesized Primer Sequence
ggaggagaggagcatcaaca

SEQ ID NO: 14928 - DNA, 20 bp, Artificial Sequence
  Artificially Synthesized Primer Sequence
ttcaccaagaggagcaggtt

SEQ ID NO: 14929 - DNA, 20 bp, Artificial Sequence
  Artificially Synthesized Primer Sequence
cgtgcactcctttcagatca

SEQ ID NO: 14930 - DNA, 20 bp, Artificial Sequence
  Artificially Synthesized Primer Sequence
gtctggccaagatgtggttt

SEQ ID NO: 14931 - DNA, 20 bp, Artificial Sequence
  Artificially Synthesized Primer Sequence
gtgttgctaggctccaaagc

SEQ ID NO: 14932 - DNA, 20 bp, Artificial Sequence
  Artificially Synthesized Primer Sequence
ctcgaccacttgcttccttc

SEQ ID NO: 14933 - DNA, 20 bp, Artificial Sequence
  Artificially Synthesized Primer Sequence
aattccactgtcagttgccc

SEQ ID NO: 14934 - DNA, 20 bp, Artificial Sequence
  Artificially Synthesized Primer Sequence
atctcgacggtctgtgctct

SEQ ID NO: 14935 - DNA, 20 bp, Artificial Sequence
  Artificially Synthesized Primer Sequence
gatataccgcctacagccga

SEQ ID NO: 14936 - DNA, 20 bp, Artificial Sequence
  Artificially Synthesized Primer Sequence
acgaggccaagcttagatca

SEQ ID NO: 14937 - DNA, 20 bp, Artificial Sequence
  Artificially Synthesized Primer Sequence
catgtatggtgctggacctg

SEQ ID NO: 14938 - DNA, 20 bp, Artificial Sequence
  Artificially Synthesized Primer Sequence
ttgatgaggacgacttgcag

SEQ ID NO: 14939 - DNA, 20 bp, Artificial Sequence
  Artificially Synthesized Primer Sequence
aaccaccgagtgtatcctgc

SEQ ID NO: 14940 - DNA, 20 bp, Artificial Sequence
  Artificially Synthesized Primer Sequence
ctgcaagtcgtcctcatcaa

SEQ ID NO: 14941 - DNA, 20 bp, Artificial Sequence
  Artificially Synthesized Primer Sequence
aaggacgccgactacaagaa

SEQ ID NO: 14942 - DNA, 20 bp, Artificial Sequence
  Artificially Synthesized Primer Sequence
agaagaagaaggcgagggag

SEQ ID NO: 14943 - DNA, 20 bp, Artificial Sequence
  Artificially Synthesized Primer Sequence
cacgctcacaacaaaaagga

SEQ ID NO: 14944 - DNA, 20 bp, Artificial Sequence
  Artificially Synthesized Primer Sequence
aagaaggacaagacctgcca

SEQ ID NO: 14945 - DNA, 20 bp, Artificial Sequence
  Artificially Synthesized Primer Sequence
ttgggaagaggaaatgttgc

SEQ ID NO: 14946 - DNA, 20 bp, Artificial Sequence
  Artificially Synthesized Primer Sequence
tccctcagaccagactttgc

SEQ ID NO: 14947 - DNA, 22 bp, Artificial Sequence
  Artificially Synthesized Primer Sequence
cacatgcataatactccttccg

SEQ ID NO: 14948 - DNA, 20 bp, Artificial Sequence
  Artificially Synthesized Primer Sequence
gccagtagtggtggagaagg

SEQ ID NO: 14949 - DNA, 20 bp, Artificial Sequence
  Artificially Synthesized Primer Sequence
cgaatgtagccagaccgatt

SEQ ID NO: 14950 - DNA, 20 bp, Artificial Sequence
  Artificially Synthesized Primer Sequence
aagcacagactcaagcggat

SEQ ID NO: 14951 - DNA, 20 bp, Artificial Sequence
  Artificially Synthesized Primer Sequence
ccacctcccagaccaagtta

SEQ ID NO: 14952 - DNA, 20 bp, Artificial Sequence
  Artificially Synthesized Primer Sequence
tcagcagatgattcagccac

SEQ ID NO: 14953 - DNA, 20 bp, Artificial Sequence
  Artificially Synthesized Primer Sequence
cattctcgcacatgctcaac

SEQ ID NO: 14954 - DNA, 20 bp, Artificial Sequence
  Artificially Synthesized Primer Sequence
gtgcgctgtgaacacaagat

SEQ ID NO: 14955 - DNA, 20 bp, Artificial Sequence
  Artificially Synthesized Primer Sequence
gcagcaatgcccttcatagt

SEQ ID NO: 14956 - DNA, 20 bp, Artificial Sequence
  Artificially Synthesized Primer Sequence
tgacaaattgcttgtggctc

SEQ ID NO: 14957 - DNA, 20 bp, Artificial Sequence
  Artificially Synthesized Primer Sequence
gcgctgtgcttgatgagata

SEQ ID NO: 14958 - DNA, 20 bp, Artificial Sequence
  Artificially Synthesized Primer Sequence
attcagcaaccttggacacc

SEQ ID NO: 14959 - DNA, 20 bp, Artificial Sequence
  Artificially Synthesized Primer Sequence
aatacccgacagatcaccca

SEQ ID NO: 14960 - DNA, 20 bp, Artificial Sequence
  Artificially Synthesized Primer Sequence
gcgctgtgcttgatgagata

SEQ ID NO: 14961 - DNA, 20 bp, Artificial Sequence
  Artificially Synthesized Primer Sequence
atcataccacctgatgggga

SEQ ID NO: 14962 - DNA, 20 bp, Artificial Sequence
  Artificially Synthesized Primer Sequence
ttgcagttgccttctgtctg

SEQ ID NO: 14963 - DNA, 20 bp, Artificial Sequence
  Artificially Synthesized Primer Sequence
gcaccaagtggcacctctat

SEQ ID NO: 14964 - DNA, 20 bp, Artificial Sequence
  Artificially Synthesized Primer Sequence
gaaagcacaaggctcgaaag

SEQ ID NO: 14965 - DNA, 20 bp, Artificial Sequence
  Artificially Synthesized Primer Sequence
ggattggggtgttgattttg

SEQ ID NO: 14966 - DNA, 20 bp, Artificial Sequence
  Artificially Synthesized Primer Sequence
taaggcccctgattgacaac

SEQ ID NO: 14967 - DNA, 20 bp, Artificial Sequence
  Artificially Synthesized Primer Sequence
tacagctcctctgttgccct

SEQ ID NO: 14968 - DNA, 20 bp, Artificial Sequence
  Artificially Synthesized Primer Sequence
aggggaaatctacctcgcat

SEQ ID NO: 14969 - DNA, 20 bp, Artificial Sequence
  Artificially Synthesized Primer Sequence
tggcttgaaaggtcctatgg

SEQ ID NO: 14970 - DNA, 20 bp, Artificial Sequence
  Artificially Synthesized Primer Sequence
gccattggttttggcataat

SEQ ID NO: 14971 - DNA, 20 bp, Artificial Sequence
  Artificially Synthesized Primer Sequence
gcttgactgcaatgctggta

SEQ ID NO: 14972 - DNA, 20 bp, Artificial Sequence
  Artificially Synthesized Primer Sequence
ggtgaaggtggcatttgtct

SEQ ID NO: 14973 - DNA, 20 bp, Artificial Sequence
  Artificially Synthesized Primer Sequence
tatacgggacaccatgctca

SEQ ID NO: 14974 - DNA, 20 bp, Artificial Sequence
  Artificially Synthesized Primer Sequence
tgctgagaaaatacgcgttg

SEQ ID NO: 14975 - DNA, 20 bp, Artificial Sequence
  Artificially Synthesized Primer Sequence
cggtcccttccactacaaaa

SEQ ID NO: 14976 - DNA, 20 bp, Artificial Sequence
  Artificially Synthesized Primer Sequence
aattcacacaaaacgagggc

SEQ ID NO: 14977 - DNA, 20 bp, Artificial Sequence
  Artificially Synthesized Primer Sequence
tgtgcagttcaaggatgctc

SEQ ID NO: 14978 - DNA, 20 bp, Artificial Sequence
  Artificially Synthesized Primer Sequence
aaactttgcaagggttggtg

SEQ ID NO: 14979 - DNA, 20 bp, Artificial Sequence
  Artificially Synthesized Primer Sequence
aaactttgcaagggttggtg

SEQ ID NO: 14980 - DNA, 20 bp, Artificial Sequence
  Artificially Synthesized Primer Sequence
cgggctacggtaccaagata

SEQ ID NO: 14981 - DNA, 20 bp, Artificial Sequence
  Artificially Synthesized Primer Sequence
acaaaaacttggcgatgtcc

SEQ ID NO: 14982 - DNA, 20 bp, Artificial Sequence
  Artificially Synthesized Primer Sequence
aggtcgtggaagatccattg

SEQ ID NO: 14983 - DNA, 20 bp, Artificial Sequence
  Artificially Synthesized Primer Sequence
aatctcgaggacgcgagtaa

SEQ ID NO: 14984 - DNA, 20 bp, Artificial Sequence
  Artificially Synthesized Primer Sequence
gatggacagaatggcctgtt

SEQ ID NO: 14985 - DNA, 20 bp, Artificial Sequence
  Artificially Synthesized Primer Sequence
tcgagctcccaaagaaagaa

SEQ ID NO: 14986 - DNA, 20 bp, Artificial Sequence
  Artificially Synthesized Primer Sequence
tcaggcttgaacctttgctt

SEQ ID NO: 14987 - DNA, 20 bp, Artificial Sequence
  Artificially Synthesized Primer Sequence
catttctaagatttcgcggg

SEQ ID NO: 14988 - DNA, 20 bp, Artificial Sequence
  Artificially Synthesized Primer Sequence
tcgagctcccaaagaaagaa

SEQ ID NO: 14989 - DNA, 20 bp, Artificial Sequence
  Artificially Synthesized Primer Sequence
caaacccatttggcaagtct

SEQ ID NO: 14990 - DNA, 20 bp, Artificial Sequence
  Artificially Synthesized Primer Sequence
caacctcgtgatttctgcaa

SEQ ID NO: 14991 - DNA, 20 bp, Artificial Sequence
  Artificially Synthesized Primer Sequence
tttatccggtatgaccccaa

SEQ ID NO: 14992 - DNA, 20 bp, Artificial Sequence
  Artificially Synthesized Primer Sequence
atcaagaagtttgcggatgc

SEQ ID NO: 14993 - DNA, 20 bp, Artificial Sequence
  Artificially Synthesized Primer Sequence
tcactcgtttccccagattc

SEQ ID NO: 14994 - DNA, 20 bp, Artificial Sequence
  Artificially Synthesized Primer Sequence
tgaggacgagaggcaaagtt

SEQ ID NO: 14995 - DNA, 20 bp, Artificial Sequence
  Artificially Synthesized Primer Sequence
tggggaagatcaattccaga

SEQ ID NO: 14996 - DNA, 20 bp, Artificial Sequence
  Artificially Synthesized Primer Sequence
aacttccagttcatcaccgc

SEQ ID NO: 14997 - DNA, 20 bp, Artificial Sequence
  Artificially Synthesized Primer Sequence
gccagcaaagagtgccttac

SEQ ID NO: 14998 - DNA, 20 bp, Artificial Sequence
  Artificially Synthesized Primer Sequence
ttcagtgcttcctcttgcct

SEQ ID NO: 14999 - DNA, 20 bp, Artificial Sequence
  Artificially Synthesized Primer Sequence
agttgagcatcgcaggattt

SEQ ID NO: 15000 - DNA, 20 bp, Artificial Sequence
  Artificially Synthesized Primer Sequence
tgtgtttaagttggaggccc

SEQ ID NO: 15001 - DNA, 20 bp, Artificial Sequence
  Artificially Synthesized Primer Sequence
tccatccatgtggaccctat

SEQ ID NO: 15002 - DNA, 20 bp, Artificial Sequence
  Artificially Synthesized Primer Sequence
gaagcaaagcacgacaacaa

SEQ ID NO: 15003 - DNA, 20 bp, Artificial Sequence
  Artificially Synthesized Primer Sequence
attttatgctgcgacggaac

SEQ ID NO: 15004 - DNA, 20 bp, Artificial Sequence
  Artificially Synthesized Primer Sequence
catgtggaccctagggaatg

SEQ ID NO: 15005 - DNA, 20 bp, Artificial Sequence
  Artificially Synthesized Primer Sequence
aattcctcgagcactgttgg

SEQ ID NO: 15006 - DNA, 20 bp, Artificial Sequence
  Artificially Synthesized Primer Sequence
acgggatgtactccacgaac

SEQ ID NO: 15007 - DNA, 20 bp, Artificial Sequence
  Artificially Synthesized Primer Sequence
ttccttcgtgcacattcaag

SEQ ID NO: 15008 - DNA, 21 bp, Artificial Sequence
  Artificially Synthesized Primer Sequence
cgtcgtcttcttcagctcatt

SEQ ID NO: 15009 - DNA, 20 bp, Artificial Sequence
  Artificially Synthesized Primer Sequence
ggagaaggaaaacccaaagc

SEQ ID NO: 15010 - DNA, 20 bp, Artificial Sequence
  Artificially Synthesized Primer Sequence
gtcgactacctgatccgctc

SEQ ID NO: 15011 - DNA, 20 bp, Artificial Sequence
  Artificially Synthesized Primer Sequence
catggaatggtagcccaaac

SEQ ID NO: 15012 - DNA, 19 bp, Artificial Sequence
  Artificially Synthesized Primer Sequence
gacgccaagaagctggaat

SEQ ID NO: 15013 - DNA, 20 bp, Artificial Sequence
  Artificially Synthesized Primer Sequence
gagacttcgccagagcagat

SEQ ID NO: 15014 - DNA, 20 bp, Artificial Sequence
  Artificially Synthesized Primer Sequence
cgcacacaacaaggagaaaa

SEQ ID NO: 15015 - DNA, 20 bp, Artificial Sequence
  Artificially Synthesized Primer Sequence
aacaaattaaggcgccctct

SEQ ID NO: 15016 - DNA, 19 bp, Artificial Sequence
  Artificially Synthesized Primer Sequence
ctgatgaggcggatgatgt

SEQ ID NO: 15017 - DNA, 20 bp, Artificial Sequence
  Artificially Synthesized Primer Sequence
tagtgctgctacactgcgct

SEQ ID NO: 15018 - DNA, 20 bp, Artificial Sequence
  Artificially Synthesized Primer Sequence
ggcgaatcaatggtgaactt

SEQ ID NO: 15019 - DNA, 20 bp, Artificial Sequence
  Artificially Synthesized Primer Sequence
gactggagcaagagctggac

SEQ ID NO: 15020 - DNA, 20 bp, Artificial Sequence
  Artificially Synthesized Primer Sequence
gagcaagatgcctaggttgc

SEQ ID NO: 15021 - DNA, 20 bp, Artificial Sequence
  Artificially Synthesized Primer Sequence
tgcactgtgatgcgttgata

SEQ ID NO: 15022 - DNA, 20 bp, Artificial Sequence
  Artificially Synthesized Primer Sequence
gagcagtgatagctacgggc

SEQ ID NO: 15023 - DNA, 20 bp, Artificial Sequence
  Artificially Synthesized Primer Sequence
acggcttgctcgtagaacat

SEQ ID NO: 15024 - DNA, 20 bp, Artificial Sequence
  Artificially Synthesized Primer Sequence
agtcctcaagctattcggca

SEQ ID NO: 15025 - DNA, 20 bp, Artificial Sequence
  Artificially Synthesized Primer Sequence
aaacaaactggtccacaggg

SEQ ID NO: 15026 - DNA, 20 bp, Artificial Sequence
  Artificially Synthesized Primer Sequence
ggcagccatatcatcgaagt

SEQ ID NO: 15027 - DNA, 20 bp, Artificial Sequence
  Artificially Synthesized Primer Sequence
acttcaagatttcgtccccc

SEQ ID NO: 15028 - DNA, 20 bp, Artificial Sequence
  Artificially Synthesized Primer Sequence
gacaggtcgtggaagcattt

SEQ ID NO: 15029 - DNA, 20 bp, Artificial Sequence
  Artificially Synthesized Primer Sequence
tggcacatttcttggaatca

SEQ ID NO: 15030 - DNA, 20 bp, Artificial Sequence
  Artificially Synthesized Primer Sequence
aacaacaaaaggaacgcacc

SEQ ID NO: 15031 - DNA, 20 bp, Artificial Sequence
  Artificially Synthesized Primer Sequence
tacatacgggaccgggataa

SEQ ID NO: 15032 - DNA, 20 bp, Artificial Sequence
  Artificially Synthesized Primer Sequence
gaggaacagtggggtacgaa

SEQ ID NO: 15033 - DNA, 20 bp, Artificial Sequence
  Artificially Synthesized Primer Sequence
gcctcgctttgaagaacatc

SEQ ID NO: 15034 - DNA, 20 bp, Artificial Sequence
  Artificially Synthesized Primer Sequence
aggaatcggtcgatatgctg

SEQ ID NO: 15035 - DNA, 20 bp, Artificial Sequence
  Artificially Synthesized Primer Sequence
tcagtaagggacagggatgc

SEQ ID NO: 15036 - DNA, 20 bp, Artificial Sequence
  Artificially Synthesized Primer Sequence
actcaccaaggtggaaggtg

SEQ ID NO: 15037 - DNA, 20 bp, Artificial Sequence
  Artificially Synthesized Primer Sequence
ggaggagcagtttgagcaac

SEQ ID NO: 15038 - DNA, 20 bp, Artificial Sequence
  Artificially Synthesized Primer Sequence
acctgctgctccctgtagaa

SEQ ID NO: 15039 - DNA, 20 bp, Artificial Sequence
  Artificially Synthesized Primer Sequence
tacaattgaagggagggtgc

SEQ ID NO: 15040 - DNA, 20 bp, Artificial Sequence
  Artificially Synthesized Primer Sequence
ctgccagcataagggatgtt

SEQ ID NO: 15041 - DNA, 19 bp, Artificial Sequence
  Artificially Synthesized Primer Sequence
gcagtcgcgttacgagttt

SEQ ID NO: 15042 - DNA, 20 bp, Artificial Sequence
  Artificially Synthesized Primer Sequence
gccacttttgcaaggaaaga

SEQ ID NO: 15043 - DNA, 20 bp, Artificial Sequence
  Artificially Synthesized Primer Sequence
gtagaggaacaaagccgtgc

SEQ ID NO: 15044 - DNA, 20 bp, Artificial Sequence
  Artificially Synthesized Primer Sequence
agcagactgttatttcgccg

SEQ ID NO: 15045 - DNA, 20 bp, Artificial Sequence
  Artificially Synthesized Primer Sequence
gagaatattcgtttgcggga

SEQ ID NO: 15046 - DNA, 20 bp, Artificial Sequence
  Artificially Synthesized Primer Sequence
atctcttcgcgagcttgtgt

SEQ ID NO: 15047 - DNA, 20 bp, Artificial Sequence
  Artificially Synthesized Primer Sequence
aaggcatgaacaaaaatggc

SEQ ID NO: 15048 - DNA, 20 bp, Artificial Sequence
  Artificially Synthesized Primer Sequence
acatgcagctgaaacacagg

SEQ ID NO: 15049 - DNA, 20 bp, Artificial Sequence
  Artificially Synthesized Primer Sequence
gacgttggttgatgcatttg

SEQ ID NO: 15050 - DNA, 20 bp, Artificial Sequence
  Artificially Synthesized Primer Sequence
aaccagccataattggcaag

SEQ ID NO: 15051 - DNA, 20 bp, Artificial Sequence
  Artificially Synthesized Primer Sequence
ttggcaagacaccaatgaac

SEQ ID NO: 15052 - DNA, 20 bp, Artificial Sequence
  Artificially Synthesized Primer Sequence
aaccttgagccgacttttga

SEQ ID NO: 15053 - DNA, 20 bp, Artificial Sequence
  Artificially Synthesized Primer Sequence
gcatccttcgtcaactccat

SEQ ID NO: 15054 - DNA, 20 bp, Artificial Sequence
  Artificially Synthesized Primer Sequence
cagctgcatgtcaccgtact

SEQ ID NO: 15055 - DNA, 20 bp, Artificial Sequence
  Artificially Synthesized Primer Sequence
aacaagacgaaacctgacgg

SEQ ID NO: 15056 - DNA, 20 bp, Artificial Sequence
  Artificially Synthesized Primer Sequence
gcatcaagaaggcctacgac

SEQ ID NO: 15057 - DNA, 20 bp, Artificial Sequence
  Artificially Synthesized Primer Sequence
ctaattccacgcacacatgg

SEQ ID NO: 15058 - DNA, 20 bp, Artificial Sequence
  Artificially Synthesized Primer Sequence
ttctgggaatccctcctctt

SEQ ID NO: 15059 - DNA, 20 bp, Artificial Sequence
  Artificially Synthesized Primer Sequence
caacgcgagcctaatgtgta

SEQ ID NO: 15060 - DNA, 20 bp, Artificial Sequence
  Artificially Synthesized Primer Sequence
acttgctcgatggcaagtct

SEQ ID NO: 15061 - DNA, 20 bp, Artificial Sequence
  Artificially Synthesized Primer Sequence
gttacatgtgtacacgccgc

SEQ ID NO: 15062 - DNA, 20 bp, Artificial Sequence
  Artificially Synthesized Primer Sequence
gtcgaagaagacggacgaag

SEQ ID NO: 15063 - DNA, 20 bp, Artificial Sequence
  Artificially Synthesized Primer Sequence
agagcgacttgaaccaccag

SEQ ID NO: 15064 - DNA, 20 bp, Artificial Sequence
  Artificially Synthesized Primer Sequence
cgacgactaccagtatgccc

SEQ ID NO: 15065 - DNA, 20 bp, Artificial Sequence
  Artificially Synthesized Primer Sequence
ctacgactcccttgccactc

SEQ ID NO: 15066 - DNA, 20 bp, Artificial Sequence
  Artificially Synthesized Primer Sequence
ctggcgaacagaagacaaca

SEQ ID NO: 15067 - DNA, 20 bp, Artificial Sequence
  Artificially Synthesized Primer Sequence
cccacatttcatcgccttat

SEQ ID NO: 15068 - DNA, 20 bp, Artificial Sequence
  Artificially Synthesized Primer Sequence
tgttatcatttcgccgtcag

SEQ ID NO: 15069 - DNA, 20 bp, Artificial Sequence
  Artificially Synthesized Primer Sequence
aggttcaaggtcatgttggc

SEQ ID NO: 15070 - DNA, 20 bp, Artificial Sequence
  Artificially Synthesized Primer Sequence
accattcaaatgaaggcagc

SEQ ID NO: 15071 - DNA, 20 bp, Artificial Sequence
  Artificially Synthesized Primer Sequence
cagcaacctccttcttgagc

SEQ ID NO: 15072 - DNA, 20 bp, Artificial Sequence
  Artificially Synthesized Primer Sequence
gccagatgaacttcaagcgt

SEQ ID NO: 15073 - DNA, 20 bp, Artificial Sequence
  Artificially Synthesized Primer Sequence
tagtaagttgccggacccac

SEQ ID NO: 15074 - DNA, 20 bp, Artificial Sequence
  Artificially Synthesized Primer Sequence
cgcgaccctcttatttgaag

SEQ ID NO: 15075 - DNA, 20 bp, Artificial Sequence
  Artificially Synthesized Primer Sequence
gtgggtccggcaacttacta

SEQ ID NO: 15076 - DNA, 20 bp, Artificial Sequence
  Artificially Synthesized Primer Sequence
atgatggccctgattctgac

SEQ ID NO: 15077 - DNA, 20 bp, Artificial Sequence
  Artificially Synthesized Primer Sequence
gtgtccttgggacggttcta

SEQ ID NO: 15078 - DNA, 20 bp, Artificial Sequence
  Artificially Synthesized Primer Sequence
tcggaaggacatgcaataca

SEQ ID NO: 15079 - DNA, 20 bp, Artificial Sequence
  Artificially Synthesized Primer Sequence
aatctccagtgcccatgaac

SEQ ID NO: 15080 - DNA, 20 bp, Artificial Sequence
  Artificially Synthesized Primer Sequence
ctcagatgcccaatcaacaa

SEQ ID NO: 15081 - DNA, 20 bp, Artificial Sequence
  Artificially Synthesized Primer Sequence
gagtcggaggcagaagagaa

SEQ ID NO: 15082 - DNA, 20 bp, Artificial Sequence
  Artificially Synthesized Primer Sequence
ccaagtgtggagcagactga

SEQ ID NO: 15083 - DNA, 20 bp, Artificial Sequence
  Artificially Synthesized Primer Sequence
gcctggaacaagaggaaatg

SEQ ID NO: 15084 - DNA, 20 bp, Artificial Sequence
  Artificially Synthesized Primer Sequence
gagaaggagtgaaggagggg

SEQ ID NO: 15085 - DNA, 20 bp, Artificial Sequence
  Artificially Synthesized Primer Sequence
ctggcgtatttgaggtggat

SEQ ID NO: 15086 - DNA, 20 bp, Artificial Sequence
  Artificially Synthesized Primer Sequence
agcaccagctcctaaggtga

SEQ ID NO: 15087 - DNA, 20 bp, Artificial Sequence
  Artificially Synthesized Primer Sequence
tgtgtgtgtgtgtgtcctgc

SEQ ID NO: 15088 - DNA, 20 bp, Artificial Sequence
  Artificially Synthesized Primer Sequence
tggtcgtacccctttacctg

SEQ ID NO: 15089 - DNA, 20 bp, Artificial Sequence
  Artificially Synthesized Primer Sequence
ctccagggaagatgctgaag

SEQ ID NO: 15090 - DNA, 20 bp, Artificial Sequence
  Artificially Synthesized Primer Sequence
cgaaactggggatcttttca

SEQ ID NO: 15091 - DNA, 20 bp, Artificial Sequence
  Artificially Synthesized Primer Sequence
tcagcagcatacacatgcaa

SEQ ID NO: 15092 - DNA, 20 bp, Artificial Sequence
  Artificially Synthesized Primer Sequence
gaccggaatgacagaggaga

SEQ ID NO: 15093 - DNA, 20 bp, Artificial Sequence
  Artificially Synthesized Primer Sequence
aggctgaggagagggttcat

SEQ ID NO: 15094 - DNA, 20 bp, Artificial Sequence
  Artificially Synthesized Primer Sequence
tcgtgctcttcccaaagaat

SEQ ID NO: 15095 - DNA, 20 bp, Artificial Sequence
  Artificially Synthesized Primer Sequence
tcgtgctcttcccaaagaat

SEQ ID NO: 15096 - DNA, 20 bp, Artificial Sequence
  Artificially Synthesized Primer Sequence
aagatttaggagggcaaggc

SEQ ID NO: 15097 - DNA, 20 bp, Artificial Sequence
  Artificially Synthesized Primer Sequence
tataccccgtggcagaaaag

SEQ ID NO: 15098 - DNA, 20 bp, Artificial Sequence
  Artificially Synthesized Primer Sequence
ctcggcctcttctttctcct

SEQ ID NO: 15099 - DNA, 20 bp, Artificial Sequence
  Artificially Synthesized Primer Sequence
cccagtcagcagacagacaa

SEQ ID NO: 15100 - DNA, 20 bp, Artificial Sequence
  Artificially Synthesized Primer Sequence
tggatctgtgaagggtaggc

SEQ ID NO: 15101 - DNA, 20 bp, Artificial Sequence
  Artificially Synthesized Primer Sequence
tgcattgctagactcatccg

SEQ ID NO: 15102 - DNA, 20 bp, Artificial Sequence
  Artificially Synthesized Primer Sequence
atcttttgccccttggaagt

SEQ ID NO: 15103 - DNA, 20 bp, Artificial Sequence
  Artificially Synthesized Primer Sequence
atccatcgcattgctaggtc

SEQ ID NO: 15104 - DNA, 20 bp, Artificial Sequence
  Artificially Synthesized Primer Sequence
ggaggaggagaaaccgaaac

SEQ ID NO: 15105 - DNA, 20 bp, Artificial Sequence
  Artificially Synthesized Primer Sequence
gaagtggttgagggtttgga

SEQ ID NO: 15106 - DNA, 20 bp, Artificial Sequence
  Artificially Synthesized Primer Sequence
caaaggaggagacaagccag

SEQ ID NO: 15107 - DNA, 20 bp, Artificial Sequence
  Artificially Synthesized Primer Sequence
tgggccaaaggagataactg

SEQ ID NO: 15108 - DNA, 20 bp, Artificial Sequence
  Artificially Synthesized Primer Sequence
ggaacctggagacgaggata

SEQ ID NO: 15109 - DNA, 20 bp, Artificial Sequence
  Artificially Synthesized Primer Sequence
tgcagattccccctacaaag

SEQ ID NO: 15110 - DNA, 20 bp, Artificial Sequence
  Artificially Synthesized Primer Sequence
actgatgacggtggcataca

SEQ ID NO: 15111 - DNA, 20 bp, Artificial Sequence
  Artificially Synthesized Primer Sequence
cccatgccacttgttctacc

SEQ ID NO: 15112 - DNA, 20 bp, Artificial Sequence
  Artificially Synthesized Primer Sequence
tctggttggaggaattggag

SEQ ID NO: 15113 - DNA, 20 bp, Artificial Sequence
  Artificially Synthesized Primer Sequence
ccatcctgccaatctgatct

SEQ ID NO: 15114 - DNA, 20 bp, Artificial Sequence
  Artificially Synthesized Primer Sequence
aagcaacctttcttgctgga

SEQ ID NO: 15115 - DNA, 20 bp, Artificial Sequence
  Artificially Synthesized Primer Sequence
ttcccaattgcacacttcaa

SEQ ID NO: 15116 - DNA, 20 bp, Artificial Sequence
  Artificially Synthesized Primer Sequence
atgcacctatgggatcaagc

SEQ ID NO: 15117 - DNA, 20 bp, Artificial Sequence
  Artificially Synthesized Primer Sequence
aatcaggacgaagatgccac

SEQ ID NO: 15118 - DNA, 20 bp, Artificial Sequence
  Artificially Synthesized Primer Sequence
tggggctcagtctcagctat

SEQ ID NO: 15119 - DNA, 20 bp, Artificial Sequence
  Artificially Synthesized Primer Sequence
gatgcacccaaatatgctcc

SEQ ID NO: 15120 - DNA, 20 bp, Artificial Sequence
  Artificially Synthesized Primer Sequence
gaaatcgtttgcttctggga

SEQ ID NO: 15121 - DNA, 20 bp, Artificial Sequence
  Artificially Synthesized Primer Sequence
agctttccaaaccccactct

SEQ ID NO: 15122 - DNA, 20 bp, Artificial Sequence
  Artificially Synthesized Primer Sequence
cgcagtacttctttgggctc

SEQ ID NO: 15123 - DNA, 20 bp, Artificial Sequence
  Artificially Synthesized Primer Sequence
acgagaccgagagcacgtat

SEQ ID NO: 15124 - DNA, 20 bp, Artificial Sequence
  Artificially Synthesized Primer Sequence
taagacgggaaatcagcagg

SEQ ID NO: 15125 - DNA, 20 bp, Artificial Sequence
  Artificially Synthesized Primer Sequence
caagggagtcaccaacacct

SEQ ID NO: 15126 - DNA, 20 bp, Artificial Sequence
  Artificially Synthesized Primer Sequence
cctagagctccacgatgagg

SEQ ID NO: 15127 - DNA, 20 bp, Artificial Sequence
  Artificially Synthesized Primer Sequence
attagtgtgtgcccctcgac

SEQ ID NO: 15128 - DNA, 20 bp, Artificial Sequence
  Artificially Synthesized Primer Sequence
ctgctccctcggatgtaaaa

SEQ ID NO: 15129 - DNA, 20 bp, Artificial Sequence
  Artificially Synthesized Primer Sequence
agaagagtagagggccggag

SEQ ID NO: 15130 - DNA, 20 bp, Artificial Sequence
  Artificially Synthesized Primer Sequence
ccttggggaagaagaaggtc

SEQ ID NO: 15131 - DNA, 20 bp, Artificial Sequence
  Artificially Synthesized Primer Sequence
atcgcagcactatggtgaca

SEQ ID NO: 15132 - DNA, 20 bp, Artificial Sequence
  Artificially Synthesized Primer Sequence
gaccttcttcttccccaagg

SEQ ID NO: 15133 - DNA, 20 bp, Artificial Sequence
  Artificially Synthesized Primer Sequence
aagccgtgctactgcaatct

SEQ ID NO: 15134 - DNA, 20 bp, Artificial Sequence
  Artificially Synthesized Primer Sequence
cttgaagctcctatttgccg

SEQ ID NO: 15135 - DNA, 20 bp, Artificial Sequence
  Artificially Synthesized Primer Sequence
aaacacgggctaaacattgc

SEQ ID NO: 15136 - DNA, 20 bp, Artificial Sequence
  Artificially Synthesized Primer Sequence
tacagcgtttgaaggacgaa

SEQ ID NO: 15137 - DNA, 20 bp, Artificial Sequence
  Artificially Synthesized Primer Sequence
cggtcaaggctgtggtctat

SEQ ID NO: 15138 - DNA, 20 bp, Artificial Sequence
  Artificially Synthesized Primer Sequence
taggtagccaaagtgcaggg

SEQ ID NO: 15139 - DNA, 20 bp, Artificial Sequence
  Artificially Synthesized Primer Sequence
aacataaaacaagctgggcg

SEQ ID NO: 15140 - DNA, 20 bp, Artificial Sequence
  Artificially Synthesized Primer Sequence
aggcttgcaacatccagaag

SEQ ID NO: 15141 - DNA, 20 bp, Artificial Sequence
  Artificially Synthesized Primer Sequence
ggggacgacaaggactacaa

SEQ ID NO: 15142 - DNA, 20 bp, Artificial Sequence
  Artificially Synthesized Primer Sequence
acgaaggtgccaatgatctc

SEQ ID NO: 15143 - DNA, 22 bp, Artificial Sequence
  Artificially Synthesized Primer Sequence
cacacgagtctggattcaggta

SEQ ID NO: 15144 - DNA, 20 bp, Artificial Sequence
  Artificially Synthesized Primer Sequence
gggactcgcatgttcctatc

SEQ ID NO: 15145 - DNA, 20 bp, Artificial Sequence
  Artificially Synthesized Primer Sequence
tcctcttatcccattgcctg

SEQ ID NO: 15146 - DNA, 20 bp, Artificial Sequence
  Artificially Synthesized Primer Sequence
tccagaatgttttcccttgg

SEQ ID NO: 15147 - DNA, 20 bp, Artificial Sequence
  Artificially Synthesized Primer Sequence
cggaaacaacaccaacttcc

SEQ ID NO: 15148 - DNA, 20 bp, Artificial Sequence
  Artificially Synthesized Primer Sequence
catctccacaactgcacacc

SEQ ID NO: 15149 - DNA, 20 bp, Artificial Sequence
  Artificially Synthesized Primer Sequence
cttggaactagatccgcagc

SEQ ID NO: 15150 - DNA, 20 bp, Artificial Sequence
  Artificially Synthesized Primer Sequence
ggaaatggggaaaataggga

SEQ ID NO: 15151 - DNA, 20 bp, Artificial Sequence
  Artificially Synthesized Primer Sequence
gcgagggacaatacatttgg

SEQ ID NO: 15152 - DNA, 20 bp, Artificial Sequence
  Artificially Synthesized Primer Sequence
acgagggaagaaaaagccat

SEQ ID NO: 15153 - DNA, 20 bp, Artificial Sequence
  Artificially Synthesized Primer Sequence
ccagtcaccacaccagattg

SEQ ID NO: 15154 - DNA, 20 bp, Artificial Sequence
  Artificially Synthesized Primer Sequence
acggagcatcccatgattag

SEQ ID NO: 15155 - DNA, 20 bp, Artificial Sequence
  Artificially Synthesized Primer Sequence
gcactacgggtggctaacat

SEQ ID NO: 15156 - DNA, 20 bp, Artificial Sequence
  Artificially Synthesized Primer Sequence
cctgtttgatcggtccagtt

SEQ ID NO: 15157 - DNA, 20 bp, Artificial Sequence
  Artificially Synthesized Primer Sequence
caagtcatggcaccattttg

SEQ ID NO: 15158 - DNA, 20 bp, Artificial Sequence
  Artificially Synthesized Primer Sequence
ttttcaagcaagcggtcttt

SEQ ID NO: 15159 - DNA, 20 bp, Artificial Sequence
  Artificially Synthesized Primer Sequence
atcggtgtaaacctgggaca

SEQ ID NO: 15160 - DNA, 20 bp, Artificial Sequence
  Artificially Synthesized Primer Sequence
gcaaaagaggtcccatagca

SEQ ID NO: 15161 - DNA, 20 bp, Artificial Sequence
  Artificially Synthesized Primer Sequence
atggaaagcctccattgttg

SEQ ID NO: 15162 - DNA, 20 bp, Artificial Sequence
  Artificially Synthesized Primer Sequence
gctatgcatgacgggatctt

SEQ ID NO: 15163 - DNA, 20 bp, Artificial Sequence
  Artificially Synthesized Primer Sequence
cacaccgcacacaacataca

SEQ ID NO: 15164 - DNA, 20 bp, Artificial Sequence
  Artificially Synthesized Primer Sequence
taagcgtgtgtcatgggaaa

SEQ ID NO: 15165 - DNA, 20 bp, Artificial Sequence
  Artificially Synthesized Primer Sequence
ggaatgagccagtcgttgat

SEQ ID NO: 15166 - DNA, 20 bp, Artificial Sequence
  Artificially Synthesized Primer Sequence
tttctcccagcagctctcat

SEQ ID NO: 15167 - DNA, 21 bp, Artificial Sequence
  Artificially Synthesized Primer Sequence
aaaggtctatcttgcttgcga

SEQ ID NO: 15168 - DNA, 20 bp, Artificial Sequence
  Artificially Synthesized Primer Sequence
cgagaacgtgattcccatct

SEQ ID NO: 15169 - DNA, 20 bp, Artificial Sequence
  Artificially Synthesized Primer Sequence
ggatcagcacgaggtcaaat

SEQ ID NO: 15170 - DNA, 20 bp, Artificial Sequence
  Artificially Synthesized Primer Sequence
caagttcccaactcgctctc

SEQ ID NO: 15171 - DNA, 20 bp, Artificial Sequence
  Artificially Synthesized Primer Sequence
atgcaactatctcttccggc

SEQ ID NO: 15172 - DNA, 20 bp, Artificial Sequence
  Artificially Synthesized Primer Sequence
gtggaaaggcattaagctcg

SEQ ID NO: 15173 - DNA, 20 bp, Artificial Sequence
  Artificially Synthesized Primer Sequence
cgtttctggttttgtttggg

SEQ ID NO: 15174 - DNA, 20 bp, Artificial Sequence
  Artificially Synthesized Primer Sequence
gggccttctcttgcctaaat

SEQ ID NO: 15175 - DNA, 20 bp, Artificial Sequence
  Artificially Synthesized Primer Sequence
aacatcagctttagggccaa

SEQ ID NO: 15176 - DNA, 21 bp, Artificial Sequence
  Artificially Synthesized Primer Sequence
gcagaatgaggaacagagtgg

SEQ ID NO: 15177 - DNA, 20 bp, Artificial Sequence
  Artificially Synthesized Primer Sequence
ggagaaagctctcgtggttg

SEQ ID NO: 15178 - DNA, 20 bp, Artificial Sequence
  Artificially Synthesized Primer Sequence
atccattttggttgggtgaa

SEQ ID NO: 15179 - DNA, 20 bp, Artificial Sequence
  Artificially Synthesized Primer Sequence
tcacccgtcgattcctctac

SEQ ID NO: 15180 - DNA, 20 bp, Artificial Sequence
  Artificially Synthesized Primer Sequence
aggacaggttaggaggaggg

SEQ ID NO: 15181 - DNA, 20 bp, Artificial Sequence
  Artificially Synthesized Primer Sequence
gtttagggtggaggaggagg

SEQ ID NO: 15182 - DNA, 20 bp, Artificial Sequence
  Artificially Synthesized Primer Sequence
atgaacgcattggtgtacga

SEQ ID NO: 15183 - DNA, 20 bp, Artificial Sequence
  Artificially Synthesized Primer Sequence
ttcatgctattctccacccc

SEQ ID NO: 15184 - DNA, 20 bp, Artificial Sequence
  Artificially Synthesized Primer Sequence
atcgatggaatctttcacgc

SEQ ID NO: 15185 - DNA, 20 bp, Artificial Sequence
  Artificially Synthesized Primer Sequence
tgagcgacaatctgatggag

SEQ ID NO: 15186 - DNA, 20 bp, Artificial Sequence
  Artificially Synthesized Primer Sequence
tctctcgagatcttctcggc

SEQ ID NO: 15187 - DNA, 20 bp, Artificial Sequence
  Artificially Synthesized Primer Sequence
tgacgacggaacaagagcta

SEQ ID NO: 15188 - DNA, 20 bp, Artificial Sequence
  Artificially Synthesized Primer Sequence
gcaagaagggaggaagcagt

SEQ ID NO: 15189 - DNA, 20 bp, Artificial Sequence
  Artificially Synthesized Primer Sequence
tatctctttatcgcgccgtt

SEQ ID NO: 15190 - DNA, 20 bp, Artificial Sequence
  Artificially Synthesized Primer Sequence
gagggataatagggggtgga

SEQ ID NO: 15191 - DNA, 20 bp, Artificial Sequence
  Artificially Synthesized Primer Sequence
tttttccatccatgtgcatc

SEQ ID NO: 15192 - DNA, 20 bp, Artificial Sequence
  Artificially Synthesized Primer Sequence
agattctacttcgccccctc

SEQ ID NO: 15193 - DNA, 20 bp, Artificial Sequence
  Artificially Synthesized Primer Sequence
ccactcctacaccgagttcc

SEQ ID NO: 15194 - DNA, 20 bp, Artificial Sequence
  Artificially Synthesized Primer Sequence
agggaaagatctcccctgaa

SEQ ID NO: 15195 - DNA, 20 bp, Artificial Sequence
  Artificially Synthesized Primer Sequence
cagtcgtcactcgtcagtgg

SEQ ID NO: 15196 - DNA, 20 bp, Artificial Sequence
  Artificially Synthesized Primer Sequence
gaggccatccactcctacac

SEQ ID NO: 15197 - DNA, 20 bp, Artificial Sequence
  Artificially Synthesized Primer Sequence
gggtcgatgcagtcagaaat

SEQ ID NO: 15198 - DNA, 20 bp, Artificial Sequence
  Artificially Synthesized Primer Sequence
ttgatcaggtgcagacgaag

SEQ ID NO: 15199 - DNA, 20 bp, Artificial Sequence
  Artificially Synthesized Primer Sequence
cacaatgccgaatacttccc

SEQ ID NO: 15200 - DNA, 20 bp, Artificial Sequence
  Artificially Synthesized Primer Sequence
aggtgcagacgaagggtatg

SEQ ID NO: 15201 - DNA, 20 bp, Artificial Sequence
  Artificially Synthesized Primer Sequence
ctgtaccaccacgcattgtc

SEQ ID NO: 15202 - DNA, 20 bp, Artificial Sequence
  Artificially Synthesized Primer Sequence
acgctcgccatataataccg

SEQ ID NO: 15203 - DNA, 20 bp, Artificial Sequence
  Artificially Synthesized Primer Sequence
cccgacagactgatggtttt

SEQ ID NO: 15204 - DNA, 20 bp, Artificial Sequence
  Artificially Synthesized Primer Sequence
aacaagttgtccctggttgc

SEQ ID NO: 15205 - DNA, 20 bp, Artificial Sequence
  Artificially Synthesized Primer Sequence
ccgaggaaggtgagagtgag

SEQ ID NO: 15206 - DNA, 20 bp, Artificial Sequence
  Artificially Synthesized Primer Sequence
gggatcgttgtagcacaggt

SEQ ID NO: 15207 - DNA, 20 bp, Artificial Sequence
  Artificially Synthesized Primer Sequence
cccatgtacccctatcacca

SEQ ID NO: 15208 - DNA, 20 bp, Artificial Sequence
  Artificially Synthesized Primer Sequence
gaatacgggccatatcatgc

SEQ ID NO: 15209 - DNA, 20 bp, Artificial Sequence
  Artificially Synthesized Primer Sequence
gaccgcaagaaggtcaagaa

SEQ ID NO: 15210 - DNA, 20 bp, Artificial Sequence
  Artificially Synthesized Primer Sequence
ataacaacctccccaaagcc

SEQ ID NO: 15211 - DNA, 21 bp, Artificial Sequence
  Artificially Synthesized Primer Sequence
tggaagcactaaagcatgaca

SEQ ID NO: 15212 - DNA, 20 bp, Artificial Sequence
  Artificially Synthesized Primer Sequence
gaccgcaagaaggtcaagaa

SEQ ID NO: 15213 - DNA, 20 bp, Artificial Sequence
  Artificially Synthesized Primer Sequence
cctccgtcgtgaactaccat

SEQ ID NO: 15214 - DNA, 20 bp, Artificial Sequence
  Artificially Synthesized Primer Sequence
gctctccagcgttaccactc

SEQ ID NO: 15215 - DNA, 20 bp, Artificial Sequence
  Artificially Synthesized Primer Sequence
aaggcaatcaaagaaggcaa

SEQ ID NO: 15216 - DNA, 20 bp, Artificial Sequence
  Artificially Synthesized Primer Sequence
tcaaaatcaggtttcctggc

SEQ ID NO: 15217 - DNA, 20 bp, Artificial Sequence
  Artificially Synthesized Primer Sequence
ccctttttaaccttgggctt

SEQ ID NO: 15218 - DNA, 20 bp, Artificial Sequence
  Artificially Synthesized Primer Sequence
aaaagcggtccctgaaagat

SEQ ID NO: 15219 - DNA, 20 bp, Artificial Sequence
  Artificially Synthesized Primer Sequence
aggctgaacgtagatcccct

SEQ ID NO: 15220 - DNA, 20 bp, Artificial Sequence
  Artificially Synthesized Primer Sequence
caactaggtagtgcacgcca

SEQ ID NO: 15221 - DNA, 20 bp, Artificial Sequence
  Artificially Synthesized Primer Sequence
tatcccctttttccaccctc

SEQ ID NO: 15222 - DNA, 20 bp, Artificial Sequence
  Artificially Synthesized Primer Sequence
tttgaacggtgaaagctcct

SEQ ID NO: 15223 - DNA, 20 bp, Artificial Sequence
  Artificially Synthesized Primer Sequence
caggatgaccagacctgaca

SEQ ID NO: 15224 - DNA, 20 bp, Artificial Sequence
  Artificially Synthesized Primer Sequence
gtgctcggagcttgattacc

SEQ ID NO: 15225 - DNA, 20 bp, Artificial Sequence
  Artificially Synthesized Primer Sequence
aatgaaataccagccaacgc

SEQ ID NO: 15226 - DNA, 20 bp, Artificial Sequence
  Artificially Synthesized Primer Sequence
ccagtgaaacaagggcaaat

SEQ ID NO: 15227 - DNA, 20 bp, Artificial Sequence
  Artificially Synthesized Primer Sequence
atgcacagaactgcagaacg

SEQ ID NO: 15228 - DNA, 20 bp, Artificial Sequence
  Artificially Synthesized Primer Sequence
ggcctctgtaccgtgctatg

SEQ ID NO: 15229 - DNA, 20 bp, Artificial Sequence
  Artificially Synthesized Primer Sequence
gaacaccgtcgtttccaact

SEQ ID NO: 15230 - DNA, 20 bp, Artificial Sequence
  Artificially Synthesized Primer Sequence
tggtgaaacctcccataagc

SEQ ID NO: 15231 - DNA, 20 bp, Artificial Sequence
  Artificially Synthesized Primer Sequence
agttggaaacgacggtgttc

SEQ ID NO: 15232 - DNA, 20 bp, Artificial Sequence
  Artificially Synthesized Primer Sequence
ttacctccatcgcaacaaca

SEQ ID NO: 15233 - DNA, 20 bp, Artificial Sequence
  Artificially Synthesized Primer Sequence
aaccctagcgaatgggactt

SEQ ID NO: 15234 - DNA, 20 bp, Artificial Sequence
  Artificially Synthesized Primer Sequence
tccaaaacaagggtccagtc

SEQ ID NO: 15235 - DNA, 20 bp, Artificial Sequence
  Artificially Synthesized Primer Sequence
aatgcggtaaattgagcctg

SEQ ID NO: 15236 - DNA, 20 bp, Artificial Sequence
  Artificially Synthesized Primer Sequence
agcattgtgcaaagcaactg

SEQ ID NO: 15237 - DNA, 20 bp, Artificial Sequence
  Artificially Synthesized Primer Sequence
caagtcgacaacgtacaccg

SEQ ID NO: 15238 - DNA, 20 bp, Artificial Sequence
  Artificially Synthesized Primer Sequence
gttggcttctgagcatctcc

SEQ ID NO: 15239 - DNA, 20 bp, Artificial Sequence
  Artificially Synthesized Primer Sequence
aggaagcacgatgattttgg

SEQ ID NO: 15240 - DNA, 20 bp, Artificial Sequence
  Artificially Synthesized Primer Sequence
aggacaacgtcaccataccc

SEQ ID NO: 15241 - DNA, 20 bp, Artificial Sequence
  Artificially Synthesized Primer Sequence
caccattttctttgccacct

SEQ ID NO: 15242 - DNA, 20 bp, Artificial Sequence
  Artificially Synthesized Primer Sequence
cttcgcagggatttctcttg

SEQ ID NO: 15243 - DNA, 20 bp, Artificial Sequence
  Artificially Synthesized Primer Sequence
atggaaccaacagttgcaca

SEQ ID NO: 15244 - DNA, 20 bp, Artificial Sequence
  Artificially Synthesized Primer Sequence
tgtctctcttgccatcatgc

SEQ ID NO: 15245 - DNA, 20 bp, Artificial Sequence
  Artificially Synthesized Primer Sequence
cacggtattagacagcccgt

SEQ ID NO: 15246 - DNA, 20 bp, Artificial Sequence
  Artificially Synthesized Primer Sequence
acgtgcaaggctaggtgagt

SEQ ID NO: 15247 - DNA, 20 bp, Artificial Sequence
  Artificially Synthesized Primer Sequence
gccagccacaagataagacc

SEQ ID NO: 15248 - DNA, 20 bp, Artificial Sequence
  Artificially Synthesized Primer Sequence
tggcgagttgtaggagaagg

SEQ ID NO: 15249 - DNA, 20 bp, Artificial Sequence
  Artificially Synthesized Primer Sequence
gcagcagagaaactatgggg

SEQ ID NO: 15250 - DNA, 20 bp, Artificial Sequence
  Artificially Synthesized Primer Sequence
tcgcaagctcctcttttgat

SEQ ID NO: 15251 - DNA, 20 bp, Artificial Sequence
  Artificially Synthesized Primer Sequence
cacgtcgatcactagcaacg

SEQ ID NO: 15252 - DNA, 20 bp, Artificial Sequence
  Artificially Synthesized Primer Sequence
ggtcaaggaggtggtcaaga

SEQ ID NO: 15253 - DNA, 20 bp, Artificial Sequence
  Artificially Synthesized Primer Sequence
tacaccgtcaacctccacaa

SEQ ID NO: 15254 - DNA, 20 bp, Artificial Sequence
  Artificially Synthesized Primer Sequence
ctcctccttagcgtcctcct

SEQ ID NO: 15255 - DNA, 20 bp, Artificial Sequence
  Artificially Synthesized Primer Sequence
agcaagacttcccaacatgc

SEQ ID NO: 15256 - DNA, 20 bp, Artificial Sequence
  Artificially Synthesized Primer Sequence
tacaccgtcaacctccacaa

SEQ ID NO: 15257 - DNA, 20 bp, Artificial Sequence
  Artificially Synthesized Primer Sequence
aggctagctatcacacggga

SEQ ID NO: 15258 - DNA, 20 bp, Artificial Sequence
  Artificially Synthesized Primer Sequence
tccttctcggtcaagatgct

SEQ ID NO: 15259 - DNA, 20 bp, Artificial Sequence
  Artificially Synthesized Primer Sequence
gcagcgagtcatgataccaa

SEQ ID NO: 15260 - DNA, 20 bp, Artificial Sequence
  Artificially Synthesized Primer Sequence
gggggatgatcctaatggtt

SEQ ID NO: 15261 - DNA, 20 bp, Artificial Sequence
  Artificially Synthesized Primer Sequence
agggagaggatgtcagggat

SEQ ID NO: 15262 - DNA, 20 bp, Artificial Sequence
  Artificially Synthesized Primer Sequence
gcaggctggaaacttctcac

SEQ ID NO: 15263 - DNA, 20 bp, Artificial Sequence
  Artificially Synthesized Primer Sequence
gcacacattggcagagaaaa

SEQ ID NO: 15264 - DNA, 20 bp, Artificial Sequence
  Artificially Synthesized Primer Sequence
tgcatgcaacagtgatcaaa

SEQ ID NO: 15265 - DNA, 20 bp, Artificial Sequence
  Artificially Synthesized Primer Sequence
ttggcttccggaattatgag

SEQ ID NO: 15266 - DNA, 20 bp, Artificial Sequence
  Artificially Synthesized Primer Sequence
tagaatacgggcttgggttg

SEQ ID NO: 15267 - DNA, 20 bp, Artificial Sequence
  Artificially Synthesized Primer Sequence
gtgtttcggcgtttctgatt

SEQ ID NO: 15268 - DNA, 20 bp, Artificial Sequence
  Artificially Synthesized Primer Sequence
ggtgctttctatggtccgaa

SEQ ID NO: 15269 - DNA, 20 bp, Artificial Sequence
  Artificially Synthesized Primer Sequence
cgggctctctctcctctttt

SEQ ID NO: 15270 - DNA, 20 bp, Artificial Sequence
  Artificially Synthesized Primer Sequence
cacactgtgaagatgtgccc

SEQ ID NO: 15271 - DNA, 20 bp, Artificial Sequence
  Artificially Synthesized Primer Sequence
gaagcgaatacagaggaccg

SEQ ID NO: 15272 - DNA, 20 bp, Artificial Sequence
  Artificially Synthesized Primer Sequence
gctgctcatggtgctacaaa

SEQ ID NO: 15273 - DNA, 20 bp, Artificial Sequence
  Artificially Synthesized Primer Sequence
ggtgtttgtggtcctgcttt

SEQ ID NO: 15274 - DNA, 20 bp, Artificial Sequence
  Artificially Synthesized Primer Sequence
gctttaggggattctttggc

SEQ ID NO: 15275 - DNA, 20 bp, Artificial Sequence
  Artificially Synthesized Primer Sequence
ggagtttcgcatgaggacat

SEQ ID NO: 15276 - DNA, 20 bp, Artificial Sequence
  Artificially Synthesized Primer Sequence
aaagcaaatggaactgacgg

SEQ ID NO: 15277 - DNA, 20 bp, Artificial Sequence
  Artificially Synthesized Primer Sequence
tgcatgtggtccagtcattt

SEQ ID NO: 15278 - DNA, 20 bp, Artificial Sequence
  Artificially Synthesized Primer Sequence
agtaagtggggcacagatgg

SEQ ID NO: 15279 - DNA, 20 bp, Artificial Sequence
  Artificially Synthesized Primer Sequence
ccatgggaaatgaaaccatc

SEQ ID NO: 15280 - DNA, 20 bp, Artificial Sequence
  Artificially Synthesized Primer Sequence
ttggaggttgtgatggatga

SEQ ID NO: 15281 - DNA, 20 bp, Artificial Sequence
  Artificially Synthesized Primer Sequence
cccaggtgtcacagttgttg

SEQ ID NO: 15282 - DNA, 20 bp, Artificial Sequence
  Artificially Synthesized Primer Sequence
atgtccttgaaagcaccacc

SEQ ID NO: 15283 - DNA, 20 bp, Artificial Sequence
  Artificially Synthesized Primer Sequence
gaaaaacgcatggttcacag

SEQ ID NO: 15284 - DNA, 20 bp, Artificial Sequence
  Artificially Synthesized Primer Sequence
ggcaacccagaaaatgagag

SEQ ID NO: 15285 - DNA, 21 bp, Artificial Sequence
  Artificially Synthesized Primer Sequence
acagtgtcttccacacaaggg

SEQ ID NO: 15286 - DNA, 20 bp, Artificial Sequence
  Artificially Synthesized Primer Sequence
cctcctcctcctatcccaag

SEQ ID NO: 15287 - DNA, 20 bp, Artificial Sequence
  Artificially Synthesized Primer Sequence
tttctcctggcatgttttcc

SEQ ID NO: 15288 - DNA, 20 bp, Artificial Sequence
  Artificially Synthesized Primer Sequence
cgtttcgagataaagcagcc

SEQ ID NO: 15289 - DNA, 20 bp, Artificial Sequence
  Artificially Synthesized Primer Sequence
ggctactacgccgagacctt

SEQ ID NO: 15290 - DNA, 20 bp, Artificial Sequence
  Artificially Synthesized Primer Sequence
ccatcgtcgtgtagctcaaa

SEQ ID NO: 15291 - DNA, 20 bp, Artificial Sequence
  Artificially Synthesized Primer Sequence
tcgggtcctgcttacttgtt

SEQ ID NO: 15292 - DNA, 20 bp, Artificial Sequence
  Artificially Synthesized Primer Sequence
cctggcatttctacaaggga

SEQ ID NO: 15293 - DNA, 20 bp, Artificial Sequence
  Artificially Synthesized Primer Sequence
acaaactgtgccaaaggacc

SEQ ID NO: 15294 - DNA, 20 bp, Artificial Sequence
  Artificially Synthesized Primer Sequence
atcccatcagtctttgctgg

SEQ ID NO: 15295 - DNA, 20 bp, Artificial Sequence
  Artificially Synthesized Primer Sequence
atgcggtgcattacaaacaa

SEQ ID NO: 15296 - DNA, 20 bp, Artificial Sequence
  Artificially Synthesized Primer Sequence
caccattgttcccgatgatt

SEQ ID NO: 15297 - DNA, 20 bp, Artificial Sequence
  Artificially Synthesized Primer Sequence
ctgcttttgatggtgaagca

SEQ ID NO: 15298 - DNA, 20 bp, Artificial Sequence
  Artificially Synthesized Primer Sequence
ccttccaaaatggctgtgat

SEQ ID NO: 15299 - DNA, 20 bp, Artificial Sequence
  Artificially Synthesized Primer Sequence
gcatttccagaagcatccat

SEQ ID NO: 15300 - DNA, 20 bp, Artificial Sequence
  Artificially Synthesized Primer Sequence
aggctgaagttcgaggacaa

SEQ ID NO: 15301 - DNA, 20 bp, Artificial Sequence
  Artificially Synthesized Primer Sequence
aattcgattcgttttggtgg

SEQ ID NO: 15302 - DNA, 20 bp, Artificial Sequence
  Artificially Synthesized Primer Sequence
caatcctagcattcgggcta

SEQ ID NO: 15303 - DNA, 20 bp, Artificial Sequence
  Artificially Synthesized Primer Sequence
ttatgtcgacgagcatcagc

SEQ ID NO: 15304 - DNA, 20 bp, Artificial Sequence
  Artificially Synthesized Primer Sequence
caacttctcaacaccagcca

SEQ ID NO: 15305 - DNA, 20 bp, Artificial Sequence
  Artificially Synthesized Primer Sequence
cttgcaatggaagccaagtt

SEQ ID NO: 15306 - DNA, 20 bp, Artificial Sequence
  Artificially Synthesized Primer Sequence
aagtccagcatggtactggg

SEQ ID NO: 15307 - DNA, 20 bp, Artificial Sequence
  Artificially Synthesized Primer Sequence
gtttgaatgtgctgattcgc

SEQ ID NO: 15308 - DNA, 20 bp, Artificial Sequence
  Artificially Synthesized Primer Sequence
taccggcattgacaagcata

SEQ ID NO: 15309 - DNA, 20 bp, Artificial Sequence
  Artificially Synthesized Primer Sequence
gtccctccctcttctccatc

SEQ ID NO: 15310 - DNA, 20 bp, Artificial Sequence
  Artificially Synthesized Primer Sequence
aaggggaaagaggggaaaat

SEQ ID NO: 15311 - DNA, 20 bp, Artificial Sequence
  Artificially Synthesized Primer Sequence
aacagacgggaatcacaagg

SEQ ID NO: 15312 - DNA, 20 bp, Artificial Sequence
  Artificially Synthesized Primer Sequence
ggaacagacgagggggttat

SEQ ID NO: 15313 - DNA, 20 bp, Artificial Sequence
  Artificially Synthesized Primer Sequence
ctgtacccacaggccatctt

SEQ ID NO: 15314 - DNA, 20 bp, Artificial Sequence
  Artificially Synthesized Primer Sequence
caacttggactccccactgt

SEQ ID NO: 15315 - DNA, 20 bp, Artificial Sequence
  Artificially Synthesized Primer Sequence
acccaaagacgagaacgaga

SEQ ID NO: 15316 - DNA, 20 bp, Artificial Sequence
  Artificially Synthesized Primer Sequence
tgaagcacaaggagcacatc

SEQ ID NO: 15317 - DNA, 20 bp, Artificial Sequence
  Artificially Synthesized Primer Sequence
caaggagtcgttcaaggagc

SEQ ID NO: 15318 - DNA, 20 bp, Artificial Sequence
  Artificially Synthesized Primer Sequence
tcagatccgggctaatatgc

SEQ ID NO: 15319 - DNA, 20 bp, Artificial Sequence
  Artificially Synthesized Primer Sequence
aactcatgactcggtccagg

SEQ ID NO: 15320 - DNA, 20 bp, Artificial Sequence
  Artificially Synthesized Primer Sequence
gttcgtcaaggagacggaga

SEQ ID NO: 15321 - DNA, 20 bp, Artificial Sequence
  Artificially Synthesized Primer Sequence
ttctgcctcttcctgctcat

SEQ ID NO: 15322 - DNA, 20 bp, Artificial Sequence
  Artificially Synthesized Primer Sequence
gaaacacatgcatcacaggg

SEQ ID NO: 15323 - DNA, 20 bp, Artificial Sequence
  Artificially Synthesized Primer Sequence
gaaacacatgcatcacaggg

SEQ ID NO: 15324 - DNA, 20 bp, Artificial Sequence
  Artificially Synthesized Primer Sequence
ttctgcctcttcctgctcat

SEQ ID NO: 15325 - DNA, 20 bp, Artificial Sequence
  Artificially Synthesized Primer Sequence
ggtcagatgctctgctcctc

SEQ ID NO: 15326 - DNA, 20 bp, Artificial Sequence
  Artificially Synthesized Primer Sequence
tcccttaaagatggcctgtg

SEQ ID NO: 15327 - DNA, 20 bp, Artificial Sequence
  Artificially Synthesized Primer Sequence
ggcaagggaaaacaatcaac

SEQ ID NO: 15328 - DNA, 20 bp, Artificial Sequence
  Artificially Synthesized Primer Sequence
agaacggcaagggctacttc

SEQ ID NO: 15329 - DNA, 20 bp, Artificial Sequence
  Artificially Synthesized Primer Sequence
cgaggcacaagttgacaaaa

SEQ ID NO: 15330 - DNA, 20 bp, Artificial Sequence
  Artificially Synthesized Primer Sequence
gcatgctttcaggagtgtca

SEQ ID NO: 15331 - DNA, 20 bp, Artificial Sequence
  Artificially Synthesized Primer Sequence
agcaagcatccaatccattc

SEQ ID NO: 15332 - DNA, 20 bp, Artificial Sequence
  Artificially Synthesized Primer Sequence
atactgtgatacggcacccc

SEQ ID NO: 15333 - DNA, 20 bp, Artificial Sequence
  Artificially Synthesized Primer Sequence
agtccgtggtctccaacaac

SEQ ID NO: 15334 - DNA, 20 bp, Artificial Sequence
  Artificially Synthesized Primer Sequence
tcaaaccagcctttaccacc

SEQ ID NO: 15335 - DNA, 20 bp, Artificial Sequence
  Artificially Synthesized Primer Sequence
tcaaaccagcctttaccacc

SEQ ID NO: 15336 - DNA, 20 bp, Artificial Sequence
  Artificially Synthesized Primer Sequence
agtccgtggtctccaacaac

SEQ ID NO: 15337 - DNA, 20 bp, Artificial Sequence
  Artificially Synthesized Primer Sequence
gagttcgaccggctctactg

SEQ ID NO: 15338 - DNA, 20 bp, Artificial Sequence
  Artificially Synthesized Primer Sequence
ccaagacacgacctctcgat

SEQ ID NO: 15339 - DNA, 20 bp, Artificial Sequence
  Artificially Synthesized Primer Sequence
gttcgaccaagacacgacct

SEQ ID NO: 15340 - DNA, 20 bp, Artificial Sequence
  Artificially Synthesized Primer Sequence
gagttcgaccggctctactg

SEQ ID NO: 15341 - DNA, 20 bp, Artificial Sequence
  Artificially Synthesized Primer Sequence
atcgccgtctactggctcta

SEQ ID NO: 15342 - DNA, 20 bp, Artificial Sequence
  Artificially Synthesized Primer Sequence
cgctttagctccaaatcagg

SEQ ID NO: 15343 - DNA, 20 bp, Artificial Sequence
  Artificially Synthesized Primer Sequence
cgctttagctccaaatcagg

SEQ ID NO: 15344 - DNA, 20 bp, Artificial Sequence
  Artificially Synthesized Primer Sequence
atcgccgtctactggctcta

SEQ ID NO: 15345 - DNA, 20 bp, Artificial Sequence
  Artificially Synthesized Primer Sequence
tccatggatcctacagagcc

SEQ ID NO: 15346 - DNA, 20 bp, Artificial Sequence
  Artificially Synthesized Primer Sequence
aaaagatcgccttcccagat

SEQ ID NO: 15347 - DNA, 20 bp, Artificial Sequence
  Artificially Synthesized Primer Sequence
acagtgacacaccccaaaca

SEQ ID NO: 15348 - DNA, 20 bp, Artificial Sequence
  Artificially Synthesized Primer Sequence
catgcgctgaagagaaatca

SEQ ID NO: 15349 - DNA, 20 bp, Artificial Sequence
  Artificially Synthesized Primer Sequence
cgatggacaaccaagatgtg

SEQ ID NO: 15350 - DNA, 20 bp, Artificial Sequence
  Artificially Synthesized Primer Sequence
gttcagcggtaccatcacct

SEQ ID NO: 15351 - DNA, 20 bp, Artificial Sequence
  Artificially Synthesized Primer Sequence
ctcgggcaacaaagtagctc

SEQ ID NO: 15352 - DNA, 20 bp, Artificial Sequence
  Artificially Synthesized Primer Sequence
agaaggtgatggtaccgctg

SEQ ID NO: 15353 - DNA, 20 bp, Artificial Sequence
  Artificially Synthesized Primer Sequence
aggttcgtgtatgcagtccc

SEQ ID NO: 15354 - DNA, 20 bp, Artificial Sequence
  Artificially Synthesized Primer Sequence
tcacagcaggagttgaggtg

SEQ ID NO: 15355 - DNA, 20 bp, Artificial Sequence
  Artificially Synthesized Primer Sequence
taccttggtttgcttcagcc

SEQ ID NO: 15356 - DNA, 20 bp, Artificial Sequence
  Artificially Synthesized Primer Sequence
ggttcgtgtatgcagtccct

SEQ ID NO: 15357 - DNA, 20 bp, Artificial Sequence
  Artificially Synthesized Primer Sequence
aaagacgagggcttgtcaga

SEQ ID NO: 15358 - DNA, 20 bp, Artificial Sequence
  Artificially Synthesized Primer Sequence
gccttcttgagtaaccgcag

SEQ ID NO: 15359 - DNA, 20 bp, Artificial Sequence
  Artificially Synthesized Primer Sequence
tacaccgaaatagccgttcc

SEQ ID NO: 15360 - DNA, 20 bp, Artificial Sequence
  Artificially Synthesized Primer Sequence
tgatgtatgaaccgctccag

SEQ ID NO: 15361 - DNA, 20 bp, Artificial Sequence
  Artificially Synthesized Primer Sequence
atgatcaaggtgaagccgag

SEQ ID NO: 15362 - DNA, 20 bp, Artificial Sequence
  Artificially Synthesized Primer Sequence
gcgcaccatgtacacaaaac

SEQ ID NO: 15363 - DNA, 20 bp, Artificial Sequence
  Artificially Synthesized Primer Sequence
aaccaaagtgcatttccctg

SEQ ID NO: 15364 - DNA, 20 bp, Artificial Sequence
  Artificially Synthesized Primer Sequence
cgaggtcaactcgaagctgt

SEQ ID NO: 15365 - DNA, 20 bp, Artificial Sequence
  Artificially Synthesized Primer Sequence
ccttctgatcgagggatttg

SEQ ID NO: 15366 - DNA, 20 bp, Artificial Sequence
  Artificially Synthesized Primer Sequence
tgctctgagtggacatgagc

SEQ ID NO: 15367 - DNA, 20 bp, Artificial Sequence
  Artificially Synthesized Primer Sequence
caaacaattgcgttaccgtg

SEQ ID NO: 15368 - DNA, 20 bp, Artificial Sequence
  Artificially Synthesized Primer Sequence
gaacaggaagcacgacatga

SEQ ID NO: 15369 - DNA, 20 bp, Artificial Sequence
  Artificially Synthesized Primer Sequence
tgctacatttctctgtggcg

SEQ ID NO: 15370 - DNA, 20 bp, Artificial Sequence
  Artificially Synthesized Primer Sequence
aaacgggggtaatggaaaag

SEQ ID NO: 15371 - DNA, 20 bp, Artificial Sequence
  Artificially Synthesized Primer Sequence
caacaaccaagggagctgat

SEQ ID NO: 15372 - DNA, 20 bp, Artificial Sequence
  Artificially Synthesized Primer Sequence
ggtcatggggtagggaaagt

SEQ ID NO: 15373 - DNA, 20 bp, Artificial Sequence
  Artificially Synthesized Primer Sequence
gtgctcaacgagacctggac

SEQ ID NO: 15374 - DNA, 20 bp, Artificial Sequence
  Artificially Synthesized Primer Sequence
gacgtggagcacccagtagt

SEQ ID NO: 15375 - DNA, 20 bp, Artificial Sequence
  Artificially Synthesized Primer Sequence
acgcaaattattccgcaaag

SEQ ID NO: 15376 - DNA, 20 bp, Artificial Sequence
  Artificially Synthesized Primer Sequence
gtgagcaagctcaggaggac

SEQ ID NO: 15377 - DNA, 20 bp, Artificial Sequence
  Artificially Synthesized Primer Sequence
ctctgctcacgacggtatga

SEQ ID NO: 15378 - DNA, 20 bp, Artificial Sequence
  Artificially Synthesized Primer Sequence
cgacaaaggcacagtgaaga

SEQ ID NO: 15379 - DNA, 20 bp, Artificial Sequence
  Artificially Synthesized Primer Sequence
aggcaactccggatcatcta

SEQ ID NO: 15380 - DNA, 20 bp, Artificial Sequence
  Artificially Synthesized Primer Sequence
cctccttcgacagccactac

SEQ ID NO: 15381 - DNA, 20 bp, Artificial Sequence
  Artificially Synthesized Primer Sequence
cacccagccgatcactatct

SEQ ID NO: 15382 - DNA, 20 bp, Artificial Sequence
  Artificially Synthesized Primer Sequence
aacaggtgtgaaggtggagg

SEQ ID NO: 15383 - DNA, 20 bp, Artificial Sequence
  Artificially Synthesized Primer Sequence
tcttcactcggccttgatct

SEQ ID NO: 15384 - DNA, 20 bp, Artificial Sequence
  Artificially Synthesized Primer Sequence
gaagcagggctccattacaa

SEQ ID NO: 15385 - DNA, 20 bp, Artificial Sequence
  Artificially Synthesized Primer Sequence
attcacaagtggaacctgcc

SEQ ID NO: 15386 - DNA, 20 bp, Artificial Sequence
  Artificially Synthesized Primer Sequence
cacatatggcttccgtcctt

SEQ ID NO: 15387 - DNA, 20 bp, Artificial Sequence
  Artificially Synthesized Primer Sequence
tcaacaatttcactccacgc

SEQ ID NO: 15388 - DNA, 20 bp, Artificial Sequence
  Artificially Synthesized Primer Sequence
caaggcctgattgatggact

SEQ ID NO: 15389 - DNA, 20 bp, Artificial Sequence
  Artificially Synthesized Primer Sequence
tggaaggaggaagtcattgg

SEQ ID NO: 15390 - DNA, 20 bp, Artificial Sequence
  Artificially Synthesized Primer Sequence
ctcctgcattgatgagcaga

SEQ ID NO: 15391 - DNA, 20 bp, Artificial Sequence
  Artificially Synthesized Primer Sequence
cctgcattgatgagcagaaa

SEQ ID NO: 15392 - DNA, 20 bp, Artificial Sequence
  Artificially Synthesized Primer Sequence
acaaccagcccatcatcatc

SEQ ID NO: 15393 - DNA, 20 bp, Artificial Sequence
  Artificially Synthesized Primer Sequence
ttccccttacacccaccata

SEQ ID NO: 15394 - DNA, 20 bp, Artificial Sequence
  Artificially Synthesized Primer Sequence
acgcggcaagaaatttaaga

SEQ ID NO: 15395 - DNA, 20 bp, Artificial Sequence
  Artificially Synthesized Primer Sequence
tcgaaacaggttcggttttc

SEQ ID NO: 15396 - DNA, 20 bp, Artificial Sequence
  Artificially Synthesized Primer Sequence
ggcatctttcatgagcacag

SEQ ID NO: 15397 - DNA, 20 bp, Artificial Sequence
  Artificially Synthesized Primer Sequence
cagctgcaaatgctgatgtt

SEQ ID NO: 15398 - DNA, 20 bp, Artificial Sequence
  Artificially Synthesized Primer Sequence
ctcccatgactcgttggttt

SEQ ID NO: 15399 - DNA, 20 bp, Artificial Sequence
  Artificially Synthesized Primer Sequence
ttgcagatgaagaagcatgg

SEQ ID NO: 15400 - DNA, 20 bp, Artificial Sequence
  Artificially Synthesized Primer Sequence
gtgaaaccattggcagcttt

SEQ ID NO: 15401 - DNA, 20 bp, Artificial Sequence
  Artificially Synthesized Primer Sequence
tggaggtagaagctatggcg

SEQ ID NO: 15402 - DNA, 20 bp, Artificial Sequence
  Artificially Synthesized Primer Sequence
tgttggagttcccaggtctc

SEQ ID NO: 15403 - DNA, 20 bp, Artificial Sequence
  Artificially Synthesized Primer Sequence
aatccatctggcatcaaacc

SEQ ID NO: 15404 - DNA, 20 bp, Artificial Sequence
  Artificially Synthesized Primer Sequence
gccttggattagagcacgag

SEQ ID NO: 15405 - DNA, 20 bp, Artificial Sequence
  Artificially Synthesized Primer Sequence
gctacaaatatggcagcggt

SEQ ID NO: 15406 - DNA, 20 bp, Artificial Sequence
  Artificially Synthesized Primer Sequence
acgacactcaacgcacagtc

SEQ ID NO: 15407 - DNA, 20 bp, Artificial Sequence
  Artificially Synthesized Primer Sequence
ctctcgagcatcggatcagt

SEQ ID NO: 15408 - DNA, 20 bp, Artificial Sequence
  Artificially Synthesized Primer Sequence
tacgtcgaagaggatctgcc

SEQ ID NO: 15409 - DNA, 20 bp, Artificial Sequence
  Artificially Synthesized Primer Sequence
cacgcgtctaaggagagtcc

SEQ ID NO: 15410 - DNA, 20 bp, Artificial Sequence
  Artificially Synthesized Primer Sequence
tctatcacgctccctctcgt

SEQ ID NO: 15411 - DNA, 20 bp, Artificial Sequence
  Artificially Synthesized Primer Sequence
cgggagacacctgtctttgt

SEQ ID NO: 15412 - DNA, 20 bp, Artificial Sequence
  Artificially Synthesized Primer Sequence
acgagagggagcgtgataga

SEQ ID NO: 15413 - DNA, 20 bp, Artificial Sequence
  Artificially Synthesized Primer Sequence
catgggtaagccgatcctaa

SEQ ID NO: 15414 - DNA, 20 bp, Artificial Sequence
  Artificially Synthesized Primer Sequence
ttccctgcctacattgttcc

SEQ ID NO: 15415 - DNA, 19 bp, Artificial Sequence
  Artificially Synthesized Primer Sequence
gcagcaaagaacaaaccca

SEQ ID NO: 15416 - DNA, 20 bp, Artificial Sequence
  Artificially Synthesized Primer Sequence
cactcacccaagcagttgaa

SEQ ID NO: 15417 - DNA, 20 bp, Artificial Sequence
  Artificially Synthesized Primer Sequence
tcagcttctgccgaggtaat

SEQ ID NO: 15418 - DNA, 20 bp, Artificial Sequence
  Artificially Synthesized Primer Sequence
gtagcacccttggcattgtt

SEQ ID NO: 15419 - DNA, 20 bp, Artificial Sequence
  Artificially Synthesized Primer Sequence
tgggaatccctcagtacagg

SEQ ID NO: 15420 - DNA, 20 bp, Artificial Sequence
  Artificially Synthesized Primer Sequence
aacaatgccaagggtgctac

SEQ ID NO: 15421 - DNA, 20 bp, Artificial Sequence
  Artificially Synthesized Primer Sequence
gacgggatcaatgggatatg

SEQ ID NO: 15422 - DNA, 20 bp, Artificial Sequence
  Artificially Synthesized Primer Sequence
taccaagtaccgtgaagccc

SEQ ID NO: 15423 - DNA, 20 bp, Artificial Sequence
  Artificially Synthesized Primer Sequence
gtgacgggttttgcagagat

SEQ ID NO: 15424 - DNA, 20 bp, Artificial Sequence
  Artificially Synthesized Primer Sequence
tattgatggggacgaagagg

SEQ ID NO: 15425 - DNA, 20 bp, Artificial Sequence
  Artificially Synthesized Primer Sequence
aaattccttgggctcaacct

SEQ ID NO: 15426 - DNA, 20 bp, Artificial Sequence
  Artificially Synthesized Primer Sequence
ggctgcaaagcagtacaaca

SEQ ID NO: 15427 - DNA, 20 bp, Artificial Sequence
  Artificially Synthesized Primer Sequence
ggctgcaaagcagtacaaca

SEQ ID NO: 15428 - DNA, 20 bp, Artificial Sequence
  Artificially Synthesized Primer Sequence
gtctcgtcatcttcacgcaa

SEQ ID NO: 15429 - DNA, 20 bp, Artificial Sequence
  Artificially Synthesized Primer Sequence
ggagggcttctttccttcac

SEQ ID NO: 15430 - DNA, 20 bp, Artificial Sequence
  Artificially Synthesized Primer Sequence
gctacggaatcttcagcgtc

SEQ ID NO: 15431 - DNA, 21 bp, Artificial Sequence
  Artificially Synthesized Primer Sequence
taacacgttatcagcacgctc

SEQ ID NO: 15432 - DNA, 20 bp, Artificial Sequence
  Artificially Synthesized Primer Sequence
gaggaacttagccgaggagg

SEQ ID NO: 15433 - DNA, 20 bp, Artificial Sequence
  Artificially Synthesized Primer Sequence
ggagctggaagagtttgtcg

SEQ ID NO: 15434 - DNA, 20 bp, Artificial Sequence
  Artificially Synthesized Primer Sequence
caaggcccatttcacagagt

SEQ ID NO: 15435 - DNA, 20 bp, Artificial Sequence
  Artificially Synthesized Primer Sequence
catgatctcatcccatgctg

SEQ ID NO: 15436 - DNA, 20 bp, Artificial Sequence
  Artificially Synthesized Primer Sequence
cataaagttcttggggctgc

SEQ ID NO: 15437 - DNA, 20 bp, Artificial Sequence
  Artificially Synthesized Primer Sequence
tggcactgagacagaaatgc

SEQ ID NO: 15438 - DNA, 20 bp, Artificial Sequence
  Artificially Synthesized Primer Sequence
cgtagaccatctagctccgc

SEQ ID NO: 15439 - DNA, 20 bp, Artificial Sequence
  Artificially Synthesized Primer Sequence
tcagttcaaccatccagcaa

SEQ ID NO: 15440 - DNA, 20 bp, Artificial Sequence
  Artificially Synthesized Primer Sequence
ccagctccttatcctgcaac

SEQ ID NO: 15441 - DNA, 20 bp, Artificial Sequence
  Artificially Synthesized Primer Sequence
atcatacctttcagcgggtg

SEQ ID NO: 15442 - DNA, 20 bp, Artificial Sequence
  Artificially Synthesized Primer Sequence
ataaccgtggtccacagagc

SEQ ID NO: 15443 - DNA, 20 bp, Artificial Sequence
  Artificially Synthesized Primer Sequence
cacagcaaaaactcttggca

SEQ ID NO: 15444 - DNA, 20 bp, Artificial Sequence
  Artificially Synthesized Primer Sequence
ccattggctcggagtttaga

SEQ ID NO: 15445 - DNA, 20 bp, Artificial Sequence
  Artificially Synthesized Primer Sequence
taccgacgatgccaaataca

SEQ ID NO: 15446 - DNA, 20 bp, Artificial Sequence
  Artificially Synthesized Primer Sequence
cggataaaacaagcatccgt

SEQ ID NO: 15447 - DNA, 20 bp, Artificial Sequence
  Artificially Synthesized Primer Sequence
cgtgctgtttacaaccaacg

SEQ ID NO: 15448 - DNA, 20 bp, Artificial Sequence
  Artificially Synthesized Primer Sequence
ggccgtacccagatattcaa

SEQ ID NO: 15449 - DNA, 20 bp, Artificial Sequence
  Artificially Synthesized Primer Sequence
ggtggtggagcgagatgtat

SEQ ID NO: 15450 - DNA, 20 bp, Artificial Sequence
  Artificially Synthesized Primer Sequence
gtattcccccatgcattgac

SEQ ID NO: 15451 - DNA, 20 bp, Artificial Sequence
  Artificially Synthesized Primer Sequence
agccaagatacattcgctcc

SEQ ID NO: 15452 - DNA, 20 bp, Artificial Sequence
  Artificially Synthesized Primer Sequence
gggtgtcatggagaacatca

SEQ ID NO: 15453 - DNA, 20 bp, Artificial Sequence
  Artificially Synthesized Primer Sequence
tctggacaactacgccagtg

SEQ ID NO: 15454 - DNA, 20 bp, Artificial Sequence
  Artificially Synthesized Primer Sequence
tgaacatatgctcgatccca

SEQ ID NO: 15455 - DNA, 20 bp, Artificial Sequence
  Artificially Synthesized Primer Sequence
ttacatggcggtgacacatt

SEQ ID NO: 15456 - DNA, 20 bp, Artificial Sequence
  Artificially Synthesized Primer Sequence
tggctgagcttatcaaagca

SEQ ID NO: 15457 - DNA, 20 bp, Artificial Sequence
  Artificially Synthesized Primer Sequence
caaccacgagctgcagagta

SEQ ID NO: 15458 - DNA, 20 bp, Artificial Sequence
  Artificially Synthesized Primer Sequence
atcttgtccttgaggccctt

SEQ ID NO: 15459 - DNA, 21 bp, Artificial Sequence
  Artificially Synthesized Primer Sequence
cacacactcgacgttcagaga

SEQ ID NO: 15460 - DNA, 20 bp, Artificial Sequence
  Artificially Synthesized Primer Sequence
agaagggcatcatggacaag

SEQ ID NO: 15461 - DNA, 20 bp, Artificial Sequence
  Artificially Synthesized Primer Sequence
gcgcaaatctttttgaaagc

SEQ ID NO: 15462 - DNA, 20 bp, Artificial Sequence
  Artificially Synthesized Primer Sequence
cacagttgacccctcaaggt

SEQ ID NO: 15463 - DNA, 20 bp, Artificial Sequence
  Artificially Synthesized Primer Sequence
aagggtaaaatacgggcacc

SEQ ID NO: 15464 - DNA, 20 bp, Artificial Sequence
  Artificially Synthesized Primer Sequence
gtggtgcttgggataatgct

SEQ ID NO: 15465 - DNA, 20 bp, Artificial Sequence
  Artificially Synthesized Primer Sequence
tcactttcgatcttcccacc

SEQ ID NO: 15466 - DNA, 20 bp, Artificial Sequence
  Artificially Synthesized Primer Sequence
agtacggaagaggtagcgca

SEQ ID NO: 15467 - DNA, 20 bp, Artificial Sequence
  Artificially Synthesized Primer Sequence
gctccattgctttcgtcttc

SEQ ID NO: 15468 - DNA, 20 bp, Artificial Sequence
  Artificially Synthesized Primer Sequence
atccaagaacttgtgaccgc

SEQ ID NO: 15469 - DNA, 20 bp, Artificial Sequence
  Artificially Synthesized Primer Sequence
tcttgcaaaactggttgctg

SEQ ID NO: 15470 - DNA, 20 bp, Artificial Sequence
  Artificially Synthesized Primer Sequence
gcagccgttggttacatttt

SEQ ID NO: 15471 - DNA, 20 bp, Artificial Sequence
  Artificially Synthesized Primer Sequence
caagctcctttgcaatgaca

SEQ ID NO: 15472 - DNA, 20 bp, Artificial Sequence
  Artificially Synthesized Primer Sequence
gtcccgaaggaaacgataca

SEQ ID NO: 15473 - DNA, 20 bp, Artificial Sequence
  Artificially Synthesized Primer Sequence
agtgcataccaatgtggcaa

SEQ ID NO: 15474 - DNA, 20 bp, Artificial Sequence
  Artificially Synthesized Primer Sequence
aaaatttgtttgtcgccagg

SEQ ID NO: 15475 - DNA, 20 bp, Artificial Sequence
  Artificially Synthesized Primer Sequence
ggacagcgagcaacagtaca

SEQ ID NO: 15476 - DNA, 20 bp, Artificial Sequence
  Artificially Synthesized Primer Sequence
tgaggcggagaagaagaaag

SEQ ID NO: 15477 - DNA, 20 bp, Artificial Sequence
  Artificially Synthesized Primer Sequence
tgctgcatctgagttatcgg

SEQ ID NO: 15478 - DNA, 20 bp, Artificial Sequence
  Artificially Synthesized Primer Sequence
ccattcattcactggtgcag

SEQ ID NO: 15479 - DNA, 20 bp, Artificial Sequence
  Artificially Synthesized Primer Sequence
aaacgatgaaatgaaacgcc

SEQ ID NO: 15480 - DNA, 20 bp, Artificial Sequence
  Artificially Synthesized Primer Sequence
tttgtcgacgagaaggttca

SEQ ID NO: 15481 - DNA, 20 bp, Artificial Sequence
  Artificially Synthesized Primer Sequence
caccaagccaatttcaggat

SEQ ID NO: 15482 - DNA, 20 bp, Artificial Sequence
  Artificially Synthesized Primer Sequence
aagcatttgccttggttttg

SEQ ID NO: 15483 - DNA, 21 bp, Artificial Sequence
  Artificially Synthesized Primer Sequence
catccatttaggcagtgatgc

SEQ ID NO: 15484 - DNA, 20 bp, Artificial Sequence
  Artificially Synthesized Primer Sequence
atgacgatacaggcaaaggg

SEQ ID NO: 15485 - DNA, 20 bp, Artificial Sequence
  Artificially Synthesized Primer Sequence
tattcgctattgttgcgctg

SEQ ID NO: 15486 - DNA, 20 bp, Artificial Sequence
  Artificially Synthesized Primer Sequence
caggagcatgccagagtaca

SEQ ID NO: 15487 - DNA, 20 bp, Artificial Sequence
  Artificially Synthesized Primer Sequence
gaccagactcgacaacgtca

SEQ ID NO: 15488 - DNA, 20 bp, Artificial Sequence
  Artificially Synthesized Primer Sequence
acgaggaggaaaccaaggat

SEQ ID NO: 15489 - DNA, 20 bp, Artificial Sequence
  Artificially Synthesized Primer Sequence
aacgaccgggcttcttatct

SEQ ID NO: 15490 - DNA, 20 bp, Artificial Sequence
  Artificially Synthesized Primer Sequence
attcccccggaagtgttatc

SEQ ID NO: 15491 - DNA, 20 bp, Artificial Sequence
  Artificially Synthesized Primer Sequence
cgtacaaaccatctgttcgg

SEQ ID NO: 15492 - DNA, 20 bp, Artificial Sequence
  Artificially Synthesized Primer Sequence
aagatcaaggtcgacaagcc

SEQ ID NO: 15493 - DNA, 20 bp, Artificial Sequence
  Artificially Synthesized Primer Sequence
ggaacgaccgtgcttgttat

SEQ ID NO: 15494 - DNA, 20 bp, Artificial Sequence
  Artificially Synthesized Primer Sequence
tgggatttgtttaacgctcc

SEQ ID NO: 15495 - DNA, 20 bp, Artificial Sequence
  Artificially Synthesized Primer Sequence
ctcaaaatgtccacccgatt

SEQ ID NO: 15496 - DNA, 20 bp, Artificial Sequence
  Artificially Synthesized Primer Sequence
ggcaagaagggtgtctacca

SEQ ID NO: 15497 - DNA, 20 bp, Artificial Sequence
  Artificially Synthesized Primer Sequence
attgaggttggttggagcac

SEQ ID NO: 15498 - DNA, 20 bp, Artificial Sequence
  Artificially Synthesized Primer Sequence
agaacatttgaaacccgcac

SEQ ID NO: 15499 - DNA, 20 bp, Artificial Sequence
  Artificially Synthesized Primer Sequence
cttcacaaagcaaagccaca

SEQ ID NO: 15500 - DNA, 20 bp, Artificial Sequence
  Artificially Synthesized Primer Sequence
ttcttcgaggagcaaggaaa

SEQ ID NO: 15501 - DNA, 20 bp, Artificial Sequence
  Artificially Synthesized Primer Sequence
gaaggaaatgagcgcagaag

SEQ ID NO: 15502 - DNA, 20 bp, Artificial Sequence
  Artificially Synthesized Primer Sequence
caatctgatctgctttggca

SEQ ID NO: 15503 - DNA, 20 bp, Artificial Sequence
  Artificially Synthesized Primer Sequence
cgcatcctctatgcacttca

SEQ ID NO: 15504 - DNA, 20 bp, Artificial Sequence
  Artificially Synthesized Primer Sequence
ttggctatgacttcccaagc

SEQ ID NO: 15505 - DNA, 20 bp, Artificial Sequence
  Artificially Synthesized Primer Sequence
tcgcacataagctatcgcac

SEQ ID NO: 15506 - DNA, 20 bp, Artificial Sequence
  Artificially Synthesized Primer Sequence
aacatgctccccgtattgag

SEQ ID NO: 15507 - DNA, 20 bp, Artificial Sequence
  Artificially Synthesized Primer Sequence
tacatcagtttcccatgcca

SEQ ID NO: 15508 - DNA, 20 bp, Artificial Sequence
  Artificially Synthesized Primer Sequence
aggaaatcttgccctccaat

SEQ ID NO: 15509 - DNA, 20 bp, Artificial Sequence
  Artificially Synthesized Primer Sequence
gagctgctcaggttttgacc

SEQ ID NO: 15510 - DNA, 20 bp, Artificial Sequence
  Artificially Synthesized Primer Sequence
agctagccactgagggttca

SEQ ID NO: 15511 - DNA, 20 bp, Artificial Sequence
  Artificially Synthesized Primer Sequence
cagctagccactgagggttc

SEQ ID NO: 15512 - DNA, 20 bp, Artificial Sequence
  Artificially Synthesized Primer Sequence
gagctgctcaggttttgacc

SEQ ID NO: 15513 - DNA, 20 bp, Artificial Sequence
  Artificially Synthesized Primer Sequence
caggggactggtctgacatt

SEQ ID NO: 15514 - DNA, 20 bp, Artificial Sequence
  Artificially Synthesized Primer Sequence
cagcattgcaaaccagaaga

SEQ ID NO: 15515 - DNA, 20 bp, Artificial Sequence
  Artificially Synthesized Primer Sequence
tggatgcacgctactgactc

SEQ ID NO: 15516 - DNA, 20 bp, Artificial Sequence
  Artificially Synthesized Primer Sequence
cagatcagggtgagcaggat

SEQ ID NO: 15517 - DNA, 20 bp, Artificial Sequence
  Artificially Synthesized Primer Sequence
ccgaaacggaaaagaaatga

SEQ ID NO: 15518 - DNA, 20 bp, Artificial Sequence
  Artificially Synthesized Primer Sequence
gaagcttcgaaccagtttgc

SEQ ID NO: 15519 - DNA, 20 bp, Artificial Sequence
  Artificially Synthesized Primer Sequence
gaagcttcgaaccagtttgc

SEQ ID NO: 15520 - DNA, 20 bp, Artificial Sequence
  Artificially Synthesized Primer Sequence
tgcagcaaaagatcacaagg

SEQ ID NO: 15521 - DNA, 20 bp, Artificial Sequence
  Artificially Synthesized Primer Sequence
tacgtttggtgcggattaca

SEQ ID NO: 15522 - DNA, 20 bp, Artificial Sequence
  Artificially Synthesized Primer Sequence
gttcctcaacagcagcaaca

SEQ ID NO: 15523 - DNA, 20 bp, Artificial Sequence
  Artificially Synthesized Primer Sequence
atcttgatgtttgccgaagc

SEQ ID NO: 15524 - DNA, 20 bp, Artificial Sequence
  Artificially Synthesized Primer Sequence
tacgtttggtgcggattaca

SEQ ID NO: 15525 - DNA, 20 bp, Artificial Sequence
  Artificially Synthesized Primer Sequence
gaattcggcacgaggataaa

SEQ ID NO: 15526 - DNA, 20 bp, Artificial Sequence
  Artificially Synthesized Primer Sequence
acggtcttccaccgtatctg

SEQ ID NO: 15527 - DNA, 20 bp, Artificial Sequence
  Artificially Synthesized Primer Sequence
gactggggaattgttggaga

SEQ ID NO: 15528 - DNA, 20 bp, Artificial Sequence
  Artificially Synthesized Primer Sequence
agtgagcgatgccagagatt

SEQ ID NO: 15529 - DNA, 20 bp, Artificial Sequence
  Artificially Synthesized Primer Sequence
tttttatctgatcggcctcg

SEQ ID NO: 15530 - DNA, 20 bp, Artificial Sequence
  Artificially Synthesized Primer Sequence
gggatgagagacgaatggaa

SEQ ID NO: 15531 - DNA, 20 bp, Artificial Sequence
  Artificially Synthesized Primer Sequence
aggtcctcgaaacagctcaa

SEQ ID NO: 15532 - DNA, 20 bp, Artificial Sequence
  Artificially Synthesized Primer Sequence
ggagatttggagggaggaag

SEQ ID NO: 15533 - DNA, 20 bp, Artificial Sequence
  Artificially Synthesized Primer Sequence
accgttttgtcttttgtgcc

SEQ ID NO: 15534 - DNA, 20 bp, Artificial Sequence
  Artificially Synthesized Primer Sequence
taaagtcatttcgcgttccc

SEQ ID NO: 15535 - DNA, 20 bp, Artificial Sequence
  Artificially Synthesized Primer Sequence
gctgctacagccgtatgtga

SEQ ID NO: 15536 - DNA, 20 bp, Artificial Sequence
  Artificially Synthesized Primer Sequence
ggacttcctcaaggacatgg

SEQ ID NO: 15537 - DNA, 20 bp, Artificial Sequence
  Artificially Synthesized Primer Sequence
gtattgggtggggtgttttg

SEQ ID NO: 15538 - DNA, 20 bp, Artificial Sequence
  Artificially Synthesized Primer Sequence
aacaccgtggtggaagactc

SEQ ID NO: 15539 - DNA, 20 bp, Artificial Sequence
  Artificially Synthesized Primer Sequence
cccctcttcttccgttcatc

SEQ ID NO: 15540 - DNA, 20 bp, Artificial Sequence
  Artificially Synthesized Primer Sequence
gtcagatgacgagccgtagc

SEQ ID NO: 15541 - DNA, 20 bp, Artificial Sequence
  Artificially Synthesized Primer Sequence
gtcgtgcctctttggttgtt

SEQ ID NO: 15542 - DNA, 20 bp, Artificial Sequence
  Artificially Synthesized Primer Sequence
agggacgaaaaaggaggaaa

SEQ ID NO: 15543 - DNA, 20 bp, Artificial Sequence
  Artificially Synthesized Primer Sequence
ctctcataaccaggaagccg

SEQ ID NO: 15544 - DNA, 20 bp, Artificial Sequence
  Artificially Synthesized Primer Sequence
ccgtgtccctgctctagtgt

SEQ ID NO: 15545 - DNA, 20 bp, Artificial Sequence
  Artificially Synthesized Primer Sequence
tcgccacctataactcggtc

SEQ ID NO: 15546 - DNA, 20 bp, Artificial Sequence
  Artificially Synthesized Primer Sequence
atgccagcctttatctccct

SEQ ID NO: 15547 - DNA, 20 bp, Artificial Sequence
  Artificially Synthesized Primer Sequence
agcatcacgtacacgggttt

SEQ ID NO: 15548 - DNA, 20 bp, Artificial Sequence
  Artificially Synthesized Primer Sequence
agatgatcatggttggcctc

SEQ ID NO: 15549 - DNA, 20 bp, Artificial Sequence
  Artificially Synthesized Primer Sequence
gaagacctacagctccgtcg

SEQ ID NO: 15550 - DNA, 20 bp, Artificial Sequence
  Artificially Synthesized Primer Sequence
cggactcccttgtgactctc

SEQ ID NO: 15551 - DNA, 20 bp, Artificial Sequence
  Artificially Synthesized Primer Sequence
cgagcaacatggttctgcta

SEQ ID NO: 15552 - DNA, 20 bp, Artificial Sequence
  Artificially Synthesized Primer Sequence
ggagtggaacgtcatctgct

SEQ ID NO: 15553 - DNA, 20 bp, Artificial Sequence
  Artificially Synthesized Primer Sequence
aaggaggacctggagtcgtt

SEQ ID NO: 15554 - DNA, 20 bp, Artificial Sequence
  Artificially Synthesized Primer Sequence
ccagctggcactagacttcc

SEQ ID NO: 15555 - DNA, 20 bp, Artificial Sequence
  Artificially Synthesized Primer Sequence
cagttaacaacgagcgacga

SEQ ID NO: 15556 - DNA, 20 bp, Artificial Sequence
  Artificially Synthesized Primer Sequence
gacgggtctaaaagcatgga

SEQ ID NO: 15557 - DNA, 20 bp, Artificial Sequence
  Artificially Synthesized Primer Sequence
gtcaacaatgggtacgggtc

SEQ ID NO: 15558 - DNA, 20 bp, Artificial Sequence
  Artificially Synthesized Primer Sequence
cacacggcttaagaatgggt

SEQ ID NO: 15559 - DNA, 20 bp, Artificial Sequence
  Artificially Synthesized Primer Sequence
taacacgttgtctcgcttgg

SEQ ID NO: 15560 - DNA, 20 bp, Artificial Sequence
  Artificially Synthesized Primer Sequence
cattatcaacatggtcggca

SEQ ID NO: 15561 - DNA, 20 bp, Artificial Sequence
  Artificially Synthesized Primer Sequence
caccaccacttcaccttcct

SEQ ID NO: 15562 - DNA, 20 bp, Artificial Sequence
  Artificially Synthesized Primer Sequence
agttgagcttgctctccagc

SEQ ID NO: 15563 - DNA, 20 bp, Artificial Sequence
  Artificially Synthesized Primer Sequence
gataacgatgaggggctcaa

SEQ ID NO: 15564 - DNA, 20 bp, Artificial Sequence
  Artificially Synthesized Primer Sequence
gctggagagcaagctcaact

SEQ ID NO: 15565 - DNA, 20 bp, Artificial Sequence
  Artificially Synthesized Primer Sequence
agaagcctgaacctgcaaaa

SEQ ID NO: 15566 - DNA, 20 bp, Artificial Sequence
  Artificially Synthesized Primer Sequence
aagtccgattcatcgtctgg

SEQ ID NO: 15567 - DNA, 20 bp, Artificial Sequence
  Artificially Synthesized Primer Sequence
tcttggcgaaataggaatgg

SEQ ID NO: 15568 - DNA, 20 bp, Artificial Sequence
  Artificially Synthesized Primer Sequence
ccagacgatgaatcggactt

SEQ ID NO: 15569 - DNA, 20 bp, Artificial Sequence
  Artificially Synthesized Primer Sequence
accgtacaaggaccaagtcg

SEQ ID NO: 15570 - DNA, 20 bp, Artificial Sequence
  Artificially Synthesized Primer Sequence
tggaagtgcactgaccaaag

SEQ ID NO: 15571 - DNA, 20 bp, Artificial Sequence
  Artificially Synthesized Primer Sequence
tgtggaaccgaatgaacaga

SEQ ID NO: 15572 - DNA, 20 bp, Artificial Sequence
  Artificially Synthesized Primer Sequence
cgatgttctggggaatgaag

SEQ ID NO: 15573 - DNA, 20 bp, Artificial Sequence
  Artificially Synthesized Primer Sequence
acgaggacgacgaagaagaa

SEQ ID NO: 15574 - DNA, 20 bp, Artificial Sequence
  Artificially Synthesized Primer Sequence
ctacactctgcgggtccatt

SEQ ID NO: 15575 - DNA, 20 bp, Artificial Sequence
  Artificially Synthesized Primer Sequence
aagccgggaagggttatgta

SEQ ID NO: 15576 - DNA, 20 bp, Artificial Sequence
  Artificially Synthesized Primer Sequence
gatgcaattttgagatgggc

SEQ ID NO: 15577 - DNA, 20 bp, Artificial Sequence
  Artificially Synthesized Primer Sequence
tgaccaatctatcatggcga

SEQ ID NO: 15578 - DNA, 18 bp, Artificial Sequence
  Artificially Synthesized Primer Sequence
ggggaatgactgcacgtt

SEQ ID NO: 15579 - DNA, 20 bp, Artificial Sequence
  Artificially Synthesized Primer Sequence
aaatcaactgcacgcaacag

SEQ ID NO: 15580 - DNA, 20 bp, Artificial Sequence
  Artificially Synthesized Primer Sequence
agaacatcaccgtcggaaac

SEQ ID NO: 15581 - DNA, 20 bp, Artificial Sequence
  Artificially Synthesized Primer Sequence
tacaaggaggagctctggga

SEQ ID NO: 15582 - DNA, 20 bp, Artificial Sequence
  Artificially Synthesized Primer Sequence
ctcccctctcctcgctagat

SEQ ID NO: 15583 - DNA, 20 bp, Artificial Sequence
  Artificially Synthesized Primer Sequence
agacctctcccttctctccg

SEQ ID NO: 15584 - DNA, 20 bp, Artificial Sequence
  Artificially Synthesized Primer Sequence
gttgatggtgatgaggaggc

SEQ ID NO: 15585 - DNA, 20 bp, Artificial Sequence
  Artificially Synthesized Primer Sequence
ggaaggccaagattttcaca

SEQ ID NO: 15586 - DNA, 20 bp, Artificial Sequence
  Artificially Synthesized Primer Sequence
gtaagccaaggatgttggga

SEQ ID NO: 15587 - DNA, 20 bp, Artificial Sequence
  Artificially Synthesized Primer Sequence
atctacagcaccgcataccc

SEQ ID NO: 15588 - DNA, 20 bp, Artificial Sequence
  Artificially Synthesized Primer Sequence
tggagtacatgcccttctcc

SEQ ID NO: 15589 - DNA, 20 bp, Artificial Sequence
  Artificially Synthesized Primer Sequence
tcctcatggtcttattcggc

SEQ ID NO: 15590 - DNA, 20 bp, Artificial Sequence
  Artificially Synthesized Primer Sequence
attaaatcccgagatcgcct

SEQ ID NO: 15591 - DNA, 20 bp, Artificial Sequence
  Artificially Synthesized Primer Sequence
accacttcctctgtgatgcc

SEQ ID NO: 15592 - DNA, 20 bp, Artificial Sequence
  Artificially Synthesized Primer Sequence
cttgacgtttgaagaagggg

SEQ ID NO: 15593 - DNA, 20 bp, Artificial Sequence
  Artificially Synthesized Primer Sequence
caggaacctctccatcgtgt

SEQ ID NO: 15594 - DNA, 20 bp, Artificial Sequence
  Artificially Synthesized Primer Sequence
gtaggcggcataggttgtgt

SEQ ID NO: 15595 - DNA, 20 bp, Artificial Sequence
  Artificially Synthesized Primer Sequence
tcttgcgtctgatctcgatg

SEQ ID NO: 15596 - DNA, 20 bp, Artificial Sequence
  Artificially Synthesized Primer Sequence
acacaacctatgccgcctac

SEQ ID NO: 15597 - DNA, 20 bp, Artificial Sequence
  Artificially Synthesized Primer Sequence
tgttggcctacatcgacaaa

SEQ ID NO: 15598 - DNA, 20 bp, Artificial Sequence
  Artificially Synthesized Primer Sequence
cactcgttaagaacaggccc

SEQ ID NO: 15599 - DNA, 20 bp, Artificial Sequence
  Artificially Synthesized Primer Sequence
ccaaggtgcttcagctttct

SEQ ID NO: 15600 - DNA, 20 bp, Artificial Sequence
  Artificially Synthesized Primer Sequence
tgcaaagcagtccagatgac

SEQ ID NO: 15601 - DNA, 20 bp, Artificial Sequence
  Artificially Synthesized Primer Sequence
tgcagctgaaattatgcagg

SEQ ID NO: 15602 - DNA, 20 bp, Artificial Sequence
  Artificially Synthesized Primer Sequence
cagggctagcgaactgaaac

SEQ ID NO: 15603 - DNA, 20 bp, Artificial Sequence
  Artificially Synthesized Primer Sequence
ccaaaacattgcagggatct

SEQ ID NO: 15604 - DNA, 20 bp, Artificial Sequence
  Artificially Synthesized Primer Sequence
tctgtattccgccgctatct

SEQ ID NO: 15605 - DNA, 20 bp, Artificial Sequence
  Artificially Synthesized Primer Sequence
gcttcgtctgctactccacc

SEQ ID NO: 15606 - DNA, 20 bp, Artificial Sequence
  Artificially Synthesized Primer Sequence
cattcgacgaacgaagtcct

SEQ ID NO: 15607 - DNA, 20 bp, Artificial Sequence
  Artificially Synthesized Primer Sequence
gcgatgcaagaacgatgtta

SEQ ID NO: 15608 - DNA, 20 bp, Artificial Sequence
  Artificially Synthesized Primer Sequence
agacggagcacaagctcttc

SEQ ID NO: 15609 - DNA, 20 bp, Artificial Sequence
  Artificially Synthesized Primer Sequence
tgaacccaaagggagagatg

SEQ ID NO: 15610 - DNA, 20 bp, Artificial Sequence
  Artificially Synthesized Primer Sequence
ttggggaacggagataacag

SEQ ID NO: 15611 - DNA, 20 bp, Artificial Sequence
  Artificially Synthesized Primer Sequence
acgaaagctagcaggccata

SEQ ID NO: 15612 - DNA, 20 bp, Artificial Sequence
  Artificially Synthesized Primer Sequence
cgtctgaacaggcttccttc

SEQ ID NO: 15613 - DNA, 20 bp, Artificial Sequence
  Artificially Synthesized Primer Sequence
agaggctgctaacggatgaa

SEQ ID NO: 15614 - DNA, 20 bp, Artificial Sequence
  Artificially Synthesized Primer Sequence
cctatagcacccagctctgc

SEQ ID NO: 15615 - DNA, 20 bp, Artificial Sequence
  Artificially Synthesized Primer Sequence
tcttgcaccagagacacgac

SEQ ID NO: 15616 - DNA, 20 bp, Artificial Sequence
  Artificially Synthesized Primer Sequence
ggaggacatgaagggaaaca

SEQ ID NO: 15617 - DNA, 20 bp, Artificial Sequence
  Artificially Synthesized Primer Sequence
cgatgctgcaatgactgact

SEQ ID NO: 15618 - DNA, 20 bp, Artificial Sequence
  Artificially Synthesized Primer Sequence
ttgtcataaagggcaaaggc

SEQ ID NO: 15619 - DNA, 20 bp, Artificial Sequence
  Artificially Synthesized Primer Sequence
gatattcgaggccgcagtaa

SEQ ID NO: 15620 - DNA, 20 bp, Artificial Sequence
  Artificially Synthesized Primer Sequence
acaggctggaagacgaagaa

SEQ ID NO: 15621 - DNA, 10 bp, Artificial Sequence
  Artificially Synthesized Primer Sequence
  MISC_FEATURE (1)..(10): n stands for any base
nnnnnnnnnn

SEQ ID NO: 15622 - DNA, 10 bp, Artificial Sequence
  Artificially Synthesized Primer Sequence
  MISC_FEATURE (1)..(10): n stands for any base
nnnnnnnnnn

SEQ ID NO: 15623 - DNA, 20 bp, Artificial Sequence
  Artificially Synthesized Primer Sequence
acaaacagctgccacaacag

SEQ ID NO: 15624 - DNA, 20 bp, Artificial Sequence
  Artificially Synthesized Primer Sequence
agcaggagacgagcaagttc

SEQ ID NO: 15625 - DNA, 20 bp, Artificial Sequence
  Artificially Synthesized Primer Sequence
gtctaaccccaacgtgtcgt

SEQ ID NO: 15626 - DNA, 20 bp, Artificial Sequence
  Artificially Synthesized Primer Sequence
aaaagtccgtgccagagaga

SEQ ID NO: 15627 - DNA, 20 bp, Artificial Sequence
  Artificially Synthesized Primer Sequence
gtgacaaatgacaaatggcg

SEQ ID NO: 15628 - DNA, 20 bp, Artificial Sequence
  Artificially Synthesized Primer Sequence
gtctaaccccaacgtgtcgt

SEQ ID NO: 15629 - DNA, 20 bp, Artificial Sequence
  Artificially Synthesized Primer Sequence
agcatatggtaacggcgaac

SEQ ID NO: 15630 - DNA, 20 bp, Artificial Sequence
  Artificially Synthesized Primer Sequence
gttccgagggagaatgtgaa

SEQ ID NO: 15631 - DNA, 20 bp, Artificial Sequence
  Artificially Synthesized Primer Sequence
cgacggcaatctatccatct

SEQ ID NO: 15632 - DNA, 20 bp, Artificial Sequence
  Artificially Synthesized Primer Sequence
gggctgatcttcatcgtgtt

SEQ ID NO: 15633 - DNA, 20 bp, Artificial Sequence
  Artificially Synthesized Primer Sequence
gttgaccctagagggcatca

SEQ ID NO: 15634 - DNA, 20 bp, Artificial Sequence
  Artificially Synthesized Primer Sequence
gagcgaccaatacgatggat

SEQ ID NO: 15635 - DNA, 20 bp, Artificial Sequence
  Artificially Synthesized Primer Sequence
tgttttacatgggctggtca

SEQ ID NO: 15636 - DNA, 20 bp, Artificial Sequence
  Artificially Synthesized Primer Sequence
atgaatgagttcaggggtgg

SEQ ID NO: 15637 - DNA, 20 bp, Artificial Sequence
  Artificially Synthesized Primer Sequence
aaagactacgctgaagccca

SEQ ID NO: 15638 - DNA, 20 bp, Artificial Sequence
  Artificially Synthesized Primer Sequence
cagagacgtcaagaatgcca

SEQ ID NO: 15639 - DNA, 20 bp, Artificial Sequence
  Artificially Synthesized Primer Sequence
cagagacgtcaagaatgcca

SEQ ID NO: 15640 - DNA, 20 bp, Artificial Sequence
  Artificially Synthesized Primer Sequence
caaagactacgctgaagccc

SEQ ID NO: 15641 - DNA, 20 bp, Artificial Sequence
  Artificially Synthesized Primer Sequence
acgagggcacagagagagag

SEQ ID NO: 15642 - DNA, 20 bp, Artificial Sequence
  Artificially Synthesized Primer Sequence
gcacagagagagacgcagtg

SEQ ID NO: 15643 - DNA, 20 bp, Artificial Sequence
  Artificially Synthesized Primer Sequence
taaacgtccacacgttctgc

SEQ ID NO: 15644 - DNA, 20 bp, Artificial Sequence
  Artificially Synthesized Primer Sequence
gctgtacaggagcgctaagg

SEQ ID NO: 15645 - DNA, 20 bp, Artificial Sequence
  Artificially Synthesized Primer Sequence
tgttttgctctctggtgtgc

SEQ ID NO: 15646 - DNA, 20 bp, Artificial Sequence
  Artificially Synthesized Primer Sequence
tcactatagggcgaattggg

SEQ ID NO: 15647 - DNA, 20 bp, Artificial Sequence
  Artificially Synthesized Primer Sequence
caccgcatcactactcgcta

SEQ ID NO: 15648 - DNA, 20 bp, Artificial Sequence
  Artificially Synthesized Primer Sequence
tgccgacgctctacttgtta

SEQ ID NO: 15649 - DNA, 20 bp, Artificial Sequence
  Artificially Synthesized Primer Sequence
tgatatcttctgccaagggg

SEQ ID NO: 15650 - DNA, 20 bp, Artificial Sequence
  Artificially Synthesized Primer Sequence
atgaggattgggggataagg

SEQ ID NO: 15651 - DNA, 20 bp, Artificial Sequence
  Artificially Synthesized Primer Sequence
ccgcacggtagaaaaacaat

SEQ ID NO: 15652 - DNA, 20 bp, Artificial Sequence
  Artificially Synthesized Primer Sequence
cgcctaattactgtggggaa

SEQ ID NO: 15653 - DNA, 20 bp, Artificial Sequence
  Artificially Synthesized Primer Sequence
acagggccacaattgctaac

SEQ ID NO: 15654 - DNA, 20 bp, Artificial Sequence
  Artificially Synthesized Primer Sequence
caacactgccatgcttgagt

SEQ ID NO: 15655 - DNA, 20 bp, Artificial Sequence
  Artificially Synthesized Primer Sequence
ggtatgcaaaaccaggcagt

SEQ ID NO: 15656 - DNA, 20 bp, Artificial Sequence
  Artificially Synthesized Primer Sequence
cagtcttgttagtgccaccg

SEQ ID NO: 15657 - DNA, 20 bp, Artificial Sequence
  Artificially Synthesized Primer Sequence
tggctttgtgggcctattac

SEQ ID NO: 15658 - DNA, 20 bp, Artificial Sequence
  Artificially Synthesized Primer Sequence
acttgtgccaattcccactc

SEQ ID NO: 15659 - DNA, 20 bp, Artificial Sequence
  Artificially Synthesized Primer Sequence
aacgaatgacaaaatgggga

SEQ ID NO: 15660 - DNA, 20 bp, Artificial Sequence
  Artificially Synthesized Primer Sequence
gtgactgctgagctgactgc

SEQ ID NO: 15661 - DNA, 20 bp, Artificial Sequence
  Artificially Synthesized Primer Sequence
cacacaaacaccccctctct

SEQ ID NO: 15662 - DNA, 20 bp, Artificial Sequence
  Artificially Synthesized Primer Sequence
ggtgtgtgtggggagaaaac

SEQ ID NO: 15663 - DNA, 20 bp, Artificial Sequence
  Artificially Synthesized Primer Sequence
ccaggagaagttttggggtt

SEQ ID NO: 15664 - DNA, 20 bp, Artificial Sequence
  Artificially Synthesized Primer Sequence
agcaacaagctgtggcctat

SEQ ID NO: 15665 - DNA, 19 bp, Artificial Sequence
  Artificially Synthesized Primer Sequence
gtttcctcctccttctccg

SEQ ID NO: 15666 - DNA, 20 bp, Artificial Sequence
  Artificially Synthesized Primer Sequence
gctccataaactctggctgg

SEQ ID NO: 15667 - DNA, 20 bp, Artificial Sequence
  Artificially Synthesized Primer Sequence
gttggttttcaagtccccaa

SEQ ID NO: 15668 - DNA, 20 bp, Artificial Sequence
  Artificially Synthesized Primer Sequence
cttgctgttctggctgatga

SEQ ID NO: 15669 - DNA, 20 bp, Artificial Sequence
  Artificially Synthesized Primer Sequence
cttcagactgggacagcctc

SEQ ID NO: 15670 - DNA, 20 bp, Artificial Sequence
  Artificially Synthesized Primer Sequence
gcttgatgcacgggttaaat

SEQ ID NO: 15671 - DNA, 20 bp, Artificial Sequence
  Artificially Synthesized Primer Sequence
gacaggtagcaagccgttgt

SEQ ID NO: 15672 - DNA, 20 bp, Artificial Sequence
  Artificially Synthesized Primer Sequence
tccaagtggaccagtgtctg

SEQ ID NO: 15673 - DNA, 10 bp, Artificial Sequence
  Artificially Synthesized Primer Sequence
  MISC_FEATURE (1)..(10): n stands for any base
nnnnnnnnnn

SEQ ID NO: 15674 - DNA, 10 bp, Artificial Sequence
  Artificially Synthesized Primer Sequence
  MISC_FEATURE (1)..(10): n stands for any base
nnnnnnnnnn

SEQ ID NO: 15675 - DNA, 20 bp, Artificial Sequence
  Artificially Synthesized Primer Sequence
atctccatggaaggcaagtg

SEQ ID NO: 15676 - DNA, 20 bp, Artificial Sequence
  Artificially Synthesized Primer Sequence
gctctggaaagatgccattc

SEQ ID NO: 15677 - DNA, 20 bp, Artificial Sequence
  Artificially Synthesized Primer Sequence
agtggaccaatcagtctggg

SEQ ID NO: 15678 - DNA, 20 bp, Artificial Sequence
  Artificially Synthesized Primer Sequence
acatcgcgaatgttagaccc

SEQ ID NO: 15679 - DNA, 20 bp, Artificial Sequence
  Artificially Synthesized Primer Sequence
ggagagacggcagatttgag

SEQ ID NO: 15680 - DNA, 20 bp, Artificial Sequence
  Artificially Synthesized Primer Sequence
gtgtacaccgtcttctccgc

SEQ ID NO: 15681 - DNA, 20 bp, Artificial Sequence
  Artificially Synthesized Primer Sequence
cgaaaacccagatttggaga

SEQ ID NO: 15682 - DNA, 20 bp, Artificial Sequence
  Artificially Synthesized Primer Sequence
ctcccaagatgcattccagt

SEQ ID NO: 15683 - DNA, 20 bp, Artificial Sequence
  Artificially Synthesized Primer Sequence
gagccaaaatccagaaagca

SEQ ID NO: 15684 - DNA, 20 bp, Artificial Sequence
  Artificially Synthesized Primer Sequence
acgaatagcatgttgacccc

SEQ ID NO: 15685 - DNA, 20 bp, Artificial Sequence
  Artificially Synthesized Primer Sequence
ctacatcgtgatgcagtgcc

SEQ ID NO: 15686 - DNA, 20 bp, Artificial Sequence
  Artificially Synthesized Primer Sequence
ccacgctgtcttcttgttga

SEQ ID NO: 15687 - DNA, 20 bp, Artificial Sequence
  Artificially Synthesized Primer Sequence
gaccggaaagcattcaaaac

SEQ ID NO: 15688 - DNA, 20 bp, Artificial Sequence
  Artificially Synthesized Primer Sequence
ccgccatcatctacaacaag

SEQ ID NO: 15689 - DNA, 20 bp, Artificial Sequence
  Artificially Synthesized Primer Sequence
gatgttgttgctgctgctgt

SEQ ID NO: 15690 - DNA, 20 bp, Artificial Sequence
  Artificially Synthesized Primer Sequence
gtagagcgatgctctgggac

SEQ ID NO: 15691 - DNA, 20 bp, Artificial Sequence
  Artificially Synthesized Primer Sequence
ctggatctggggttgtcact

SEQ ID NO: 15692 - DNA, 20 bp, Artificial Sequence
  Artificially Synthesized Primer Sequence
atgtcaacagtgccagcaag

SEQ ID NO: 15693 - DNA, 20 bp, Artificial Sequence
  Artificially Synthesized Primer Sequence
gcaactccagctcaagaacc

SEQ ID NO: 15694 - DNA, 20 bp, Artificial Sequence
  Artificially Synthesized Primer Sequence
gttagcagtcgctccctttg

SEQ ID NO: 15695 - DNA, 20 bp, Artificial Sequence
  Artificially Synthesized Primer Sequence
tacctccactaggcatgcaa

SEQ ID NO: 15696 - DNA, 20 bp, Artificial Sequence
  Artificially Synthesized Primer Sequence
gggaagagcattcctgatga

SEQ ID NO: 15697 - DNA, 20 bp, Artificial Sequence
  Artificially Synthesized Primer Sequence
atgcagcgctcctctgttat

SEQ ID NO: 15698 - DNA, 20 bp, Artificial Sequence
  Artificially Synthesized Primer Sequence
aattcagtcaaacaaccggc

SEQ ID NO: 15699 - DNA, 20 bp, Artificial Sequence
  Artificially Synthesized Primer Sequence
agccgacgagaaggactaca

SEQ ID NO: 15700 - DNA, 20 bp, Artificial Sequence
  Artificially Synthesized Primer Sequence
atgtagaagacggccctggt

SEQ ID NO: 15701 - DNA, 20 bp, Artificial Sequence
  Artificially Synthesized Primer Sequence
agaggtcgatggtggaactg

SEQ ID NO: 15702 - DNA, 20 bp, Artificial Sequence
  Artificially Synthesized Primer Sequence
gttcaggtctgcaggggtta

SEQ ID NO: 15703 - DNA, 20 bp, Artificial Sequence
  Artificially Synthesized Primer Sequence
ggacacgagcttcgtttttc

SEQ ID NO: 15704 - DNA, 20 bp, Artificial Sequence
  Artificially Synthesized Primer Sequence
tagctgcattgctcaactgg

SEQ ID NO: 15705 - DNA, 20 bp, Artificial Sequence
  Artificially Synthesized Primer Sequence
gaccagaatgcaagcagtga

SEQ ID NO: 15706 - DNA, 20 bp, Artificial Sequence
  Artificially Synthesized Primer Sequence
gcaagcctcaatggagtagc

SEQ ID NO: 15707 - DNA, 20 bp, Artificial Sequence
  Artificially Synthesized Primer Sequence
gacacggcagcaaacaagta

SEQ ID NO: 15708 - DNA, 20 bp, Artificial Sequence
  Artificially Synthesized Primer Sequence
cggtaagacagagccgctac

SEQ ID NO: 15709 - DNA, 20 bp, Artificial Sequence
  Artificially Synthesized Primer Sequence
gactcctcgtccttgctgac

SEQ ID NO: 15710 - DNA, 20 bp, Artificial Sequence
  Artificially Synthesized Primer Sequence
tcatgcaccatgagcttctc

SEQ ID NO: 15711 - DNA, 20 bp, Artificial Sequence
  Artificially Synthesized Primer Sequence
tcgttccccaaataattcca

SEQ ID NO: 15712 - DNA, 20 bp, Artificial Sequence
  Artificially Synthesized Primer Sequence
gcatgagatggacgactcct

SEQ ID NO: 15713 - DNA, 20 bp, Artificial Sequence
  Artificially Synthesized Primer Sequence
ctctggtggaaggatgtggt

SEQ ID NO: 15714 - DNA, 20 bp, Artificial Sequence
  Artificially Synthesized Primer Sequence
gcaacagacgcaacttgaaa

SEQ ID NO: 15715 - DNA, 20 bp, Artificial Sequence
  Artificially Synthesized Primer Sequence
acgcatgccagtttagcttt

SEQ ID NO: 15716 - DNA, 20 bp, Artificial Sequence
  Artificially Synthesized Primer Sequence
cactattgctgatcatgccg

SEQ ID NO: 15717 - DNA, 20 bp, Artificial Sequence
  Artificially Synthesized Primer Sequence
tgtgttcatgaggtctccga

SEQ ID NO: 15718 - DNA, 20 bp, Artificial Sequence
  Artificially Synthesized Primer Sequence
caccccgaagaggagtgata

SEQ ID NO: 15719 - DNA, 20 bp, Artificial Sequence
  Artificially Synthesized Primer Sequence
accaggtaaatccacaacgc

SEQ ID NO: 15720 - DNA, 20 bp, Artificial Sequence
  Artificially Synthesized Primer Sequence
tggccgactgactaagaagg

SEQ ID NO: 15721 - DNA, 20 bp, Artificial Sequence
  Artificially Synthesized Primer Sequence
tgggggagatgtgggtaata

SEQ ID NO: 15722 - DNA, 20 bp, Artificial Sequence
  Artificially Synthesized Primer Sequence
aaaggagagaagagacgggc

SEQ ID NO: 15723 - DNA, 20 bp, Artificial Sequence
  Artificially Synthesized Primer Sequence
gctacaatgacagcacccaa

SEQ ID NO: 15724 - DNA, 20 bp, Artificial Sequence
  Artificially Synthesized Primer Sequence
agctcgacctgaacctgaga

SEQ ID NO: 15725 - DNA, 20 bp, Artificial Sequence
  Artificially Synthesized Primer Sequence
ttgatgtagcttgtggcgag

SEQ ID NO: 15726 - DNA, 20 bp, Artificial Sequence
  Artificially Synthesized Primer Sequence
ttgattgctcccccatactc

SEQ ID NO: 15727 - DNA, 20 bp, Artificial Sequence
  Artificially Synthesized Primer Sequence
gaaaacctgtcaagggcaaa

SEQ ID NO: 15728 - DNA, 20 bp, Artificial Sequence
  Artificially Synthesized Primer Sequence
ataggatcacatcttgggcg

SEQ ID NO: 15729 - DNA, 20 bp, Artificial Sequence
  Artificially Synthesized Primer Sequence
cacgagggacagaccaagat

SEQ ID NO: 15730 - DNA, 20 bp, Artificial Sequence
  Artificially Synthesized Primer Sequence
caaaaacccactgtctgcaa

SEQ ID NO: 15731 - DNA, 20 bp, Artificial Sequence
  Artificially Synthesized Primer Sequence
caaaaacccactgtctgcaa

SEQ ID NO: 15732 - DNA, 20 bp, Artificial Sequence
  Artificially Synthesized Primer Sequence
agatacttactgccacggcg

SEQ ID NO: 15733 - DNA, 20 bp, Artificial Sequence
  Artificially Synthesized Primer Sequence
gaaggaaagggatggaggag

SEQ ID NO: 15734 - DNA, 20 bp, Artificial Sequence
  Artificially Synthesized Primer Sequence
aaatccaacgtacagtcgcc

SEQ ID NO: 15735 - DNA, 20 bp, Artificial Sequence
  Artificially Synthesized Primer Sequence
agccctacaccatcaccaag

SEQ ID NO: 15736 - DNA, 20 bp, Artificial Sequence
  Artificially Synthesized Primer Sequence
ccaggaaggaaatgtgtcgt

SEQ ID NO: 15737 - DNA, 20 bp, Artificial Sequence
  Artificially Synthesized Primer Sequence
gacgatcaatccgaggaaaa

SEQ ID NO: 15738 - DNA, 20 bp, Artificial Sequence
  Artificially Synthesized Primer Sequence
aggtgactgagaagcccaga

SEQ ID NO: 15739 - DNA, 20 bp, Artificial Sequence
  Artificially Synthesized Primer Sequence
agggcaccggtctttctact

SEQ ID NO: 15740 - DNA, 20 bp, Artificial Sequence
  Artificially Synthesized Primer Sequence
gatgttgtggtggacaatcg

SEQ ID NO: 15741 - DNA, 20 bp, Artificial Sequence
  Artificially Synthesized Primer Sequence
cccaacgtcaactccaagat

SEQ ID NO: 15742 - DNA, 20 bp, Artificial Sequence
  Artificially Synthesized Primer Sequence
ttgatcatgtcggcaacagt

SEQ ID NO: 15743 - DNA, 20 bp, Artificial Sequence
  Artificially Synthesized Primer Sequence
gggcgataaaatgcagacat

SEQ ID NO: 15744 - DNA, 20 bp, Artificial Sequence
  Artificially Synthesized Primer Sequence
cccaacgtcaactccaagat

SEQ ID NO: 15745 - DNA, 20 bp, Artificial Sequence
  Artificially Synthesized Primer Sequence
cgacttggtagtcgtcggtt

SEQ ID NO: 15746 - DNA, 20 bp, Artificial Sequence
  Artificially Synthesized Primer Sequence
ttgtttggtgtgtggatgct

SEQ ID NO: 15747 - DNA, 21 bp, Artificial Sequence
  Artificially Synthesized Primer Sequence
agccctgtcatcaacatcatc

SEQ ID NO: 15748 - DNA, 20 bp, Artificial Sequence
  Artificially Synthesized Primer Sequence
accactccattgtccaaagc

SEQ ID NO: 15749 - DNA, 20 bp, Artificial Sequence
  Artificially Synthesized Primer Sequence
tctgccatttcgaattctcc

SEQ ID NO: 15750 - DNA, 20 bp, Artificial Sequence
  Artificially Synthesized Primer Sequence
ctcctcctccatcgaaatca

SEQ ID NO: 15751 - DNA, 20 bp, Artificial Sequence
  Artificially Synthesized Primer Sequence
tccaatccaaacaccaacaa

SEQ ID NO: 15752 - DNA, 20 bp, Artificial Sequence
  Artificially Synthesized Primer Sequence
gggatgtgattgggatgaac

SEQ ID NO: 15753 - DNA, 20 bp, Artificial Sequence
  Artificially Synthesized Primer Sequence
gaggatttctccgtcagggt

SEQ ID NO: 15754 - DNA, 20 bp, Artificial Sequence
  Artificially Synthesized Primer Sequence
gtggctggtactccaccact

SEQ ID NO: 15755 - DNA, 20 bp, Artificial Sequence
  Artificially Synthesized Primer Sequence
gtggctggtactccaccact

SEQ ID NO: 15756 - DNA, 20 bp, Artificial Sequence
  Artificially Synthesized Primer Sequence
cgtggatcactctatcgtgc

SEQ ID NO: 15757 - DNA, 20 bp, Artificial Sequence
  Artificially Synthesized Primer Sequence
tcctctctttgcttcttgcc

SEQ ID NO: 15758 - DNA, 20 bp, Artificial Sequence
  Artificially Synthesized Primer Sequence
cctgttgggtgtctcctagc

SEQ ID NO: 15759 - DNA, 20 bp, Artificial Sequence
  Artificially Synthesized Primer Sequence
ttctcccagtaatttccccc

SEQ ID NO: 15760 - DNA, 20 bp, Artificial Sequence
  Artificially Synthesized Primer Sequence
atacagcccctggaggattt

SEQ ID NO: 15761 - DNA, 20 bp, Artificial Sequence
  Artificially Synthesized Primer Sequence
ggtatcctgatgggctgaga

SEQ ID NO: 15762 - DNA, 20 bp, Artificial Sequence
  Artificially Synthesized Primer Sequence
tcagtcaactgcttgcatcc

SEQ ID NO: 15763 - DNA, 20 bp, Artificial Sequence
  Artificially Synthesized Primer Sequence
tgcaaaacaaacaggaagca

SEQ ID NO: 15764 - DNA, 20 bp, Artificial Sequence
  Artificially Synthesized Primer Sequence
gggtttgacctcattgttgg

SEQ ID NO: 15765 - DNA, 20 bp, Artificial Sequence
  Artificially Synthesized Primer Sequence
atcgagaagatgcaggagga

SEQ ID NO: 15766 - DNA, 20 bp, Artificial Sequence
  Artificially Synthesized Primer Sequence
cagattcagggaccaaggaa

SEQ ID NO: 15767 - DNA, 20 bp, Artificial Sequence
  Artificially Synthesized Primer Sequence
cacctctccccttgatttga

SEQ ID NO: 15768 - DNA, 20 bp, Artificial Sequence
  Artificially Synthesized Primer Sequence
gaagctgtgcagcatctacg

SEQ ID NO: 15769 - DNA, 20 bp, Artificial Sequence
  Artificially Synthesized Primer Sequence
taactgtgcttcagatggcg

SEQ ID NO: 15770 - DNA, 20 bp, Artificial Sequence
  Artificially Synthesized Primer Sequence
agcatatcccacagtcagcc

SEQ ID NO: 15771 - DNA, 20 bp, Artificial Sequence
  Artificially Synthesized Primer Sequence
acatttcaaacttcgccgac

SEQ ID NO: 15772 - DNA, 20 bp, Artificial Sequence
  Artificially Synthesized Primer Sequence
gtggtgatagctcaggggaa

SEQ ID NO: 15773 - DNA, 20 bp, Artificial Sequence
  Artificially Synthesized Primer Sequence
aatgagaaaactgcaggcgt

SEQ ID NO: 15774 - DNA, 20 bp, Artificial Sequence
  Artificially Synthesized Primer Sequence
aagcaccaaactcttcccct

SEQ ID NO: 15775 - DNA, 20 bp, Artificial Sequence
  Artificially Synthesized Primer Sequence
aatggtgcacgacaagttca

SEQ ID NO: 15776 - DNA, 20 bp, Artificial Sequence
  Artificially Synthesized Primer Sequence
ctcgagggacctgacttcat

SEQ ID NO: 15777 - DNA, 20 bp, Artificial Sequence
  Artificially Synthesized Primer Sequence
aactcggtggagtccaacac

SEQ ID NO: 15778 - DNA, 20 bp, Artificial Sequence
  Artificially Synthesized Primer Sequence
gcagaagctatgggcagaac

SEQ ID NO: 15779 - DNA, 20 bp, Artificial Sequence
  Artificially Synthesized Primer Sequence
ccatatgcttgcacatcacc

SEQ ID NO: 15780 - DNA, 20 bp, Artificial Sequence
  Artificially Synthesized Primer Sequence
accgatgtatttgcctttgg

SEQ ID NO: 15781 - DNA, 20 bp, Artificial Sequence
  Artificially Synthesized Primer Sequence
tttgctcgcacttctcttca

SEQ ID NO: 15782 - DNA, 20 bp, Artificial Sequence
  Artificially Synthesized Primer Sequence
caaacaaatttgcagcgaga

SEQ ID NO: 15783 - DNA, 20 bp, Artificial Sequence
  Artificially Synthesized Primer Sequence
gcactcctctacgcttggtc

SEQ ID NO: 15784 - DNA, 20 bp, Artificial Sequence
  Artificially Synthesized Primer Sequence
gtggaacacccgcagttagt

SEQ ID NO: 15785 - DNA, 20 bp, Artificial Sequence
  Artificially Synthesized Primer Sequence
gccaggaaacaatctaccca

SEQ ID NO: 15786 - DNA, 20 bp, Artificial Sequence
  Artificially Synthesized Primer Sequence
cgtgggatcgttctggtagt

SEQ ID NO: 15787 - DNA, 20 bp, Artificial Sequence
  Artificially Synthesized Primer Sequence
tgccctgtcatcaacatcat

SEQ ID NO: 15788 - DNA, 20 bp, Artificial Sequence
  Artificially Synthesized Primer Sequence
acctgttcaacaatgccacc

SEQ ID NO: 15789 - DNA, 20 bp, Artificial Sequence
  Artificially Synthesized Primer Sequence
agccctacaccatcaccaag

SEQ ID NO: 15790 - DNA, 20 bp, Artificial Sequence
  Artificially Synthesized Primer Sequence
ccaggaaggaaatgtgtcgt

SEQ ID NO: 15791 - DNA, 20 bp, Artificial Sequence
  Artificially Synthesized Primer Sequence
tggtcttccttcgtgggtaa

SEQ ID NO: 15792 - DNA, 20 bp, Artificial Sequence
  Artificially Synthesized Primer Sequence
tgagcatacagcatccctga

SEQ ID NO: 15793 - DNA, 20 bp, Artificial Sequence
  Artificially Synthesized Primer Sequence
tcaagccttttggaaccatc

SEQ ID NO: 15794 - DNA, 20 bp, Artificial Sequence
  Artificially Synthesized Primer Sequence
aggtagcagcaggctagcag

SEQ ID NO: 15795 - DNA, 20 bp, Artificial Sequence
  Artificially Synthesized Primer Sequence
tcccaggtgtacaggacaga

SEQ ID NO: 15796 - DNA, 20 bp, Artificial Sequence
  Artificially Synthesized Primer Sequence
tcggtgtgataaccatgctg

SEQ ID NO: 15797 - DNA, 20 bp, Artificial Sequence
  Artificially Synthesized Primer Sequence
tggagcactgttatcgcaag

SEQ ID NO: 15798 - DNA, 20 bp, Artificial Sequence
  Artificially Synthesized Primer Sequence
ccaggaccacaagaggacat

SEQ ID NO: 15799 - DNA, 20 bp, Artificial Sequence
  Artificially Synthesized Primer Sequence
cccaagccttacgaaacaga

SEQ ID NO: 15800 - DNA, 20 bp, Artificial Sequence
  Artificially Synthesized Primer Sequence
tccaatacagatggcaacca

SEQ ID NO: 15801 - DNA, 20 bp, Artificial Sequence
  Artificially Synthesized Primer Sequence
cccaacttcctctccagaaa

SEQ ID NO: 15802 - DNA, 20 bp, Artificial Sequence
  Artificially Synthesized Primer Sequence
agacgaaatcatcgaggacg

SEQ ID NO: 15803 - DNA, 20 bp, Artificial Sequence
  Artificially Synthesized Primer Sequence
gtacacccgatggagatgct

SEQ ID NO: 15804 - DNA, 20 bp, Artificial Sequence
  Artificially Synthesized Primer Sequence
tcacgacggtgcactacttc

SEQ ID NO: 15805 - DNA, 20 bp, Artificial Sequence
  Artificially Synthesized Primer Sequence
ggctatggaagcccatgata

SEQ ID NO: 15806 - DNA, 20 bp, Artificial Sequence
  Artificially Synthesized Primer Sequence
acggtagcaccacatcttcc

SEQ ID NO: 15807 - DNA, 20 bp, Artificial Sequence
  Artificially Synthesized Primer Sequence
acggtagcaccacatcttcc

SEQ ID NO: 15808 - DNA, 20 bp, Artificial Sequence
  Artificially Synthesized Primer Sequence
ggctatggaagcccatgata

SEQ ID NO: 15809 - DNA, 20 bp, Artificial Sequence
  Artificially Synthesized Primer Sequence
gatgctgtctgtgctgctgt

SEQ ID NO: 15810 - DNA, 20 bp, Artificial Sequence
  Artificially Synthesized Primer Sequence
aaggcaagcaagcatcagtt

SEQ ID NO: 15811 - DNA, 20 bp, Artificial Sequence
  Artificially Synthesized Primer Sequence
cccatacgaaggaagcaaag

SEQ ID NO: 15812 - DNA, 20 bp, Artificial Sequence
  Artificially Synthesized Primer Sequence
gagcgtgcatctgttcttga

SEQ ID NO: 15813 - DNA, 20 bp, Artificial Sequence
  Artificially Synthesized Primer Sequence
tttagaaggacatgctgggg

SEQ ID NO: 15814 - DNA, 20 bp, Artificial Sequence
  Artificially Synthesized Primer Sequence
cattcacccaatttatcccg

SEQ ID NO: 15815 - DNA, 20 bp, Artificial Sequence
  Artificially Synthesized Primer Sequence
gctagcttcaacgatcaggg

SEQ ID NO: 15816 - DNA, 20 bp, Artificial Sequence
  Artificially Synthesized Primer Sequence
ttcacgctcacatccaagtc

SEQ ID NO: 15817 - DNA, 20 bp, Artificial Sequence
  Artificially Synthesized Primer Sequence
agtacctggacgacattgcc

SEQ ID NO: 15818 - DNA, 20 bp, Artificial Sequence
  Artificially Synthesized Primer Sequence
agcatcctcaactcgcaact

SEQ ID NO: 15819 - DNA, 20 bp, Artificial Sequence
  Artificially Synthesized Primer Sequence
ctggcaggcacatcatattg

SEQ ID NO: 15820 - DNA, 20 bp, Artificial Sequence
  Artificially Synthesized Primer Sequence
ctgagatagtgaggagggcg

SEQ ID NO: 15821 - DNA, 20 bp, Artificial Sequence
  Artificially Synthesized Primer Sequence
gtacctgaacgtgggcatct

SEQ ID NO: 15822 - DNA, 20 bp, Artificial Sequence
  Artificially Synthesized Primer Sequence
tgaatgtgagcgtgaaggag

SEQ ID NO: 15823 - DNA, 20 bp, Artificial Sequence
  Artificially Synthesized Primer Sequence
tatgatccatgacccaccac

SEQ ID NO: 15824 - DNA, 20 bp, Artificial Sequence
  Artificially Synthesized Primer Sequence
gcggtgtcttcttcagcttc

SEQ ID NO: 15825 - DNA, 20 bp, Artificial Sequence
  Artificially Synthesized Primer Sequence
tgcaagataatgctgccaag

SEQ ID NO: 15826 - DNA, 20 bp, Artificial Sequence
  Artificially Synthesized Primer Sequence
gcggcttgctcatcttaaac

SEQ ID NO: 15827 - DNA, 20 bp, Artificial Sequence
  Artificially Synthesized Primer Sequence
acgactcacaggtgcttcaa

SEQ ID NO: 15828 - DNA, 20 bp, Artificial Sequence
  Artificially Synthesized Primer Sequence
gcctgcccactatcatgttc

SEQ ID NO: 15829 - DNA, 20 bp, Artificial Sequence
  Artificially Synthesized Primer Sequence
ggtggagttcttcctggaca

SEQ ID NO: 15830 - DNA, 20 bp, Artificial Sequence
  Artificially Synthesized Primer Sequence
atcctccatgaaagccacag

SEQ ID NO: 15831 - DNA, 20 bp, Artificial Sequence
  Artificially Synthesized Primer Sequence
acatcctccatgaaagccac

SEQ ID NO: 15832 - DNA, 20 bp, Artificial Sequence
  Artificially Synthesized Primer Sequence
ggtggagttcttcctggaca

SEQ ID NO: 15833 - DNA, 20 bp, Artificial Sequence
  Artificially Synthesized Primer Sequence
ccaaggcaaataggcaacat

SEQ ID NO: 15834 - DNA, 20 bp, Artificial Sequence
  Artificially Synthesized Primer Sequence
tttgcccagaaagttggttc

SEQ ID NO: 15835 - DNA, 20 bp, Artificial Sequence
  Artificially Synthesized Primer Sequence
atgaacattcacgaccagca

SEQ ID NO: 15836 - DNA, 20 bp, Artificial Sequence
  Artificially Synthesized Primer Sequence
caaaaggatatcttgcccca

SEQ ID NO: 15837 - DNA, 20 bp, Artificial Sequence
  Artificially Synthesized Primer Sequence
agaacaaattggcgtggaag

SEQ ID NO: 15838 - DNA, 20 bp, Artificial Sequence
  Artificially Synthesized Primer Sequence
tttttagccaaccggtcaac

SEQ ID NO: 15839 - DNA, 20 bp, Artificial Sequence
  Artificially Synthesized Primer Sequence
gccccttaccaaacaaatga

SEQ ID NO: 15840 - DNA, 20 bp, Artificial Sequence
  Artificially Synthesized Primer Sequence
tgcctgatggagcttacaga

SEQ ID NO: 15841 - DNA, 20 bp, Artificial Sequence
  Artificially Synthesized Primer Sequence
gttcctttccccaaaacaca

SEQ ID NO: 15842 - DNA, 20 bp, Artificial Sequence
  Artificially Synthesized Primer Sequence
agtaaaaacgatggcggttg

SEQ ID NO: 15843 - DNA, 20 bp, Artificial Sequence
  Artificially Synthesized Primer Sequence
gaaagcccaaaggaaacaca

SEQ ID NO: 15844 - DNA, 20 bp, Artificial Sequence
  Artificially Synthesized Primer Sequence
ctccaaaggaagctcgtcag

SEQ ID NO: 15845 - DNA, 20 bp, Artificial Sequence
  Artificially Synthesized Primer Sequence
caatggagccacaacctttt

SEQ ID NO: 15846 - DNA, 20 bp, Artificial Sequence
  Artificially Synthesized Primer Sequence
ttgggcttcttgttctgctt

SEQ ID NO: 15847 - DNA, 20 bp, Artificial Sequence
  Artificially Synthesized Primer Sequence
cgacaagtttcacagcagga

SEQ ID NO: 15848 - DNA, 20 bp, Artificial Sequence
  Artificially Synthesized Primer Sequence
ggtgttcaccatagcagcct

SEQ ID NO: 15849 - DNA, 20 bp, Artificial Sequence
  Artificially Synthesized Primer Sequence
gagtttgaggagtacgccga

SEQ ID NO: 15850 - DNA, 20 bp, Artificial Sequence
  Artificially Synthesized Primer Sequence
ggcacatatgtctgcaccac

SEQ ID NO: 15851 - DNA, 20 bp, Artificial Sequence
  Artificially Synthesized Primer Sequence
ccacgacaacgatgataagc

SEQ ID NO: 15852 - DNA, 20 bp, Artificial Sequence
  Artificially Synthesized Primer Sequence
gtttgaggagtacgccgaga

SEQ ID NO: 15853 - DNA, 20 bp, Artificial Sequence
  Artificially Synthesized Primer Sequence
gctgttcggcataatgtcct

SEQ ID NO: 15854 - DNA, 20 bp, Artificial Sequence
  Artificially Synthesized Primer Sequence
tggaccaataggaagccatc

SEQ ID NO: 15855 - DNA, 20 bp, Artificial Sequence
  Artificially Synthesized Primer Sequence
tggcaagccaaatgttacaa

SEQ ID NO: 15856 - DNA, 20 bp, Artificial Sequence
  Artificially Synthesized Primer Sequence
gctgttcggcataatgtcct

SEQ ID NO: 15857 - DNA, 20 bp, Artificial Sequence
  Artificially Synthesized Primer Sequence
atacgagggccagtgaattg

SEQ ID NO: 15858 - DNA, 20 bp, Artificial Sequence
  Artificially Synthesized Primer Sequence
tcacgccatcagaagtgaag

SEQ ID NO: 15859 - DNA, 20 bp, Artificial Sequence
  Artificially Synthesized Primer Sequence
aacgtaccgtcacccacttc

SEQ ID NO: 15860 - DNA, 20 bp, Artificial Sequence
  Artificially Synthesized Primer Sequence
aagcctgcagtgactttggt

SEQ ID NO: 15861 - DNA, 20 bp, Artificial Sequence
  Artificially Synthesized Primer Sequence
gtaatttttgccgtggcact

SEQ ID NO: 15862 - DNA, 20 bp, Artificial Sequence
  Artificially Synthesized Primer Sequence
cgtattgccggaatgtcttt

SEQ ID NO: 15863 - DNA, 20 bp, Artificial Sequence
  Artificially Synthesized Primer Sequence
cagtgctcttcactctcccc

SEQ ID NO: 15864 - DNA, 20 bp, Artificial Sequence
  Artificially Synthesized Primer Sequence
ctgaaggccactaccagagc

SEQ ID NO: 15865 - DNA, 20 bp, Artificial Sequence
  Artificially Synthesized Primer Sequence
acggatggagcaagacattc

SEQ ID NO: 15866 - DNA, 20 bp, Artificial Sequence
  Artificially Synthesized Primer Sequence
cctcaacgcttttctgaagg

SEQ ID NO: 15867 - DNA, 20 bp, Artificial Sequence
  Artificially Synthesized Primer Sequence
catcacgagaaagacaggca

SEQ ID NO: 15868 - DNA, 21 bp, Artificial Sequence
  Artificially Synthesized Primer Sequence
tggctcctgagacagaagaga

SEQ ID NO: 15869 - DNA, 20 bp, Artificial Sequence
  Artificially Synthesized Primer Sequence
tcaccttcgtcaacaacgag

SEQ ID NO: 15870 - DNA, 20 bp, Artificial Sequence
  Artificially Synthesized Primer Sequence
aaggccaaaactcatgatgc

SEQ ID NO: 15871 - DNA, 20 bp, Artificial Sequence
  Artificially Synthesized Primer Sequence
tgcttgtttcaggctagcaa

SEQ ID NO: 15872 - DNA, 20 bp, Artificial Sequence
  Artificially Synthesized Primer Sequence
atgtgaagaggaccgaggtg

SEQ ID NO: 15873 - DNA, 20 bp, Artificial Sequence
  Artificially Synthesized Primer Sequence
tgggggtatgaatggtagga

SEQ ID NO: 15874 - DNA, 20 bp, Artificial Sequence
  Artificially Synthesized Primer Sequence
aaattagctcgcgttgtcgt

SEQ ID NO: 15875 - DNA, 20 bp, Artificial Sequence
  Artificially Synthesized Primer Sequence
gtttcgtttggtccaggaaa

SEQ ID NO: 15876 - DNA, 20 bp, Artificial Sequence
  Artificially Synthesized Primer Sequence
tgatgaacatgaccgcagtt

SEQ ID NO: 15877 - DNA, 20 bp, Artificial Sequence
  Artificially Synthesized Primer Sequence
accctctccaacctccctta

SEQ ID NO: 15878 - DNA, 20 bp, Artificial Sequence
  Artificially Synthesized Primer Sequence
tcctgcagcttcttcctctc

SEQ ID NO: 15879 - DNA, 20 bp, Artificial Sequence
  Artificially Synthesized Primer Sequence
caagagagcatggagcttga

SEQ ID NO: 15880 - DNA, 20 bp, Artificial Sequence
  Artificially Synthesized Primer Sequence
ccctctccaacctcccttac

SEQ ID NO: 15881 - DNA, 20 bp, Artificial Sequence
  Artificially Synthesized Primer Sequence
gagatgcagtggcatagggt

SEQ ID NO: 15882 - DNA, 20 bp, Artificial Sequence
  Artificially Synthesized Primer Sequence
ttttctcaacatgcgagacg

SEQ ID NO: 15883 - DNA, 20 bp, Artificial Sequence
  Artificially Synthesized Primer Sequence
aaagtctggagcgcaaagag

SEQ ID NO: 15884 - DNA, 20 bp, Artificial Sequence
  Artificially Synthesized Primer Sequence
gaagaagctgtgaaatccgc

SEQ ID NO: 15885 - DNA, 20 bp, Artificial Sequence
  Artificially Synthesized Primer Sequence
atgcagtctcaattttcggg

SEQ ID NO: 15886 - DNA, 20 bp, Artificial Sequence
  Artificially Synthesized Primer Sequence
ctctcaccctcgctcatctc

SEQ ID NO: 15887 - DNA, 19 bp, Artificial Sequence
  Artificially Synthesized Primer Sequence
ctcaaggcgcatgttcagt

SEQ ID NO: 15888 - DNA, 20 bp, Artificial Sequence
  Artificially Synthesized Primer Sequence
gagccagggttggtaagaca

SEQ ID NO: 15889 - DNA, 20 bp, Artificial Sequence
  Artificially Synthesized Primer Sequence
cactgatgtgagccgaacag

SEQ ID NO: 15890 - DNA, 20 bp, Artificial Sequence
  Artificially Synthesized Primer Sequence
caagaagcaaaaacgcatca

SEQ ID NO: 15891 - DNA, 20 bp, Artificial Sequence
  Artificially Synthesized Primer Sequence
gcacctctcacctctccaaa

SEQ ID NO: 15892 - DNA, 18 bp, Artificial Sequence
  Artificially Synthesized Primer Sequence
aaggccaagatcacgcac

SEQ ID NO: 15893 - DNA, 20 bp, Artificial Sequence
  Artificially Synthesized Primer Sequence
tcttgaaggcgtcaaccttt

SEQ ID NO: 15894 - DNA, 20 bp, Artificial Sequence
  Artificially Synthesized Primer Sequence
aaccgatcaaattttgcagg

SEQ ID NO: 15895 - DNA, 20 bp, Artificial Sequence
  Artificially Synthesized Primer Sequence
atgtacgattgtcccttcgg

SEQ ID NO: 15896 - DNA, 20 bp, Artificial Sequence
  Artificially Synthesized Primer Sequence
tcttgaaggcgtcaaccttt

SEQ ID NO: 15897 - DNA, 20 bp, Artificial Sequence
  Artificially Synthesized Primer Sequence
ggggtctggtcaatcaagaa

SEQ ID NO: 15898 - DNA, 20 bp, Artificial Sequence
  Artificially Synthesized Primer Sequence
acatagaatgcaagggtggc

SEQ ID NO: 15899 - DNA, 20 bp, Artificial Sequence
  Artificially Synthesized Primer Sequence
cttgacacacgcacacacac

SEQ ID NO: 15900 - DNA, 20 bp, Artificial Sequence
  Artificially Synthesized Primer Sequence
gttgtggtctacgccttggt

SEQ ID NO: 15901 - DNA, 20 bp, Artificial Sequence
  Artificially Synthesized Primer Sequence
gtaccagaagagcacggagc

SEQ ID NO: 15902 - DNA, 20 bp, Artificial Sequence
  Artificially Synthesized Primer Sequence
caatcgcaaaccaaaaggat

SEQ ID NO: 15903 - DNA, 20 bp, Artificial Sequence
  Artificially Synthesized Primer Sequence
ggtaaccaactacgaccgga

SEQ ID NO: 15904 - DNA, 20 bp, Artificial Sequence
  Artificially Synthesized Primer Sequence
aagaagcctcaccgctacag

SEQ ID NO: 15905 - DNA, 20 bp, Artificial Sequence
  Artificially Synthesized Primer Sequence
cggtcttacagcgagaaagg

SEQ ID NO: 15906 - DNA, 20 bp, Artificial Sequence
  Artificially Synthesized Primer Sequence
ggggcatgaccaatatgaac

SEQ ID NO: 15907 - DNA, 20 bp, Artificial Sequence
  Artificially Synthesized Primer Sequence
catgcgacacctacgagaga

SEQ ID NO: 15908 - DNA, 20 bp, Artificial Sequence
  Artificially Synthesized Primer Sequence
gagagtcacagatggccaca

SEQ ID NO: 15909 - DNA, 20 bp, Artificial Sequence
  Artificially Synthesized Primer Sequence
ggcacgaggaagatcaagag

SEQ ID NO: 15910 - DNA, 20 bp, Artificial Sequence
  Artificially Synthesized Primer Sequence
caagctctataccccatcgc

SEQ ID NO: 15911 - DNA, 20 bp, Artificial Sequence
  Artificially Synthesized Primer Sequence
ttaaccccgcataaccactc

SEQ ID NO: 15912 - DNA, 19 bp, Artificial Sequence
  Artificially Synthesized Primer Sequence
agatcaagagcggccagat

SEQ ID NO: 15913 - DNA, 20 bp, Artificial Sequence
  Artificially Synthesized Primer Sequence
atgacagctgggtttggttc

SEQ ID NO: 15914 - DNA, 20 bp, Artificial Sequence
  Artificially Synthesized Primer Sequence
tgtccgatgagaaatggtca

SEQ ID NO: 15915 - DNA, 21 bp, Artificial Sequence
  Artificially Synthesized Primer Sequence
ccatcggctactctgttttca

SEQ ID NO: 15916 - DNA, 20 bp, Artificial Sequence
  Artificially Synthesized Primer Sequence
caaggcaacatgtgaagctg

SEQ ID NO: 15917 - DNA, 20 bp, Artificial Sequence
  Artificially Synthesized Primer Sequence
aacctgtgtggcaatgacaa

SEQ ID NO: 15918 - DNA, 20 bp, Artificial Sequence
  Artificially Synthesized Primer Sequence
aaataaacacgcggcaaaac

SEQ ID NO: 15919 - DNA, 20 bp, Artificial Sequence
  Artificially Synthesized Primer Sequence
catcttggggagaatgatgg

SEQ ID NO: 15920 - DNA, 20 bp, Artificial Sequence
  Artificially Synthesized Primer Sequence
tgggaacttgttcggatctc

SEQ ID NO: 15921 - DNA, 20 bp, Artificial Sequence
  Artificially Synthesized Primer Sequence
ccgcctcatcttcttcaact

SEQ ID NO: 15922 - DNA, 20 bp, Artificial Sequence
  Artificially Synthesized Primer Sequence
tcgctagccatgacagacac

SEQ ID NO: 15923 - DNA, 20 bp, Artificial Sequence
  Artificially Synthesized Primer Sequence
taggccaagacctcgaagaa

SEQ ID NO: 15924 - DNA, 21 bp, Artificial Sequence
  Artificially Synthesized Primer Sequence
tttgactaagtggtgcttccc

SEQ ID NO: 15925 - DNA, 20 bp, Artificial Sequence
  Artificially Synthesized Primer Sequence
tcccttccctcggttaagat

SEQ ID NO: 15926 - DNA, 20 bp, Artificial Sequence
  Artificially Synthesized Primer Sequence
agtcaagcccccttgaagat

SEQ ID NO: 15927 - DNA, 20 bp, Artificial Sequence
  Artificially Synthesized Primer Sequence
gcatggaccttgaagcaact

SEQ ID NO: 15928 - DNA, 20 bp, Artificial Sequence
  Artificially Synthesized Primer Sequence
aaatcctagcccagtgcaga

SEQ ID NO: 15929 - DNA, 20 bp, Artificial Sequence
  Artificially Synthesized Primer Sequence
atgtagcgggtgacctgttc

SEQ ID NO: 15930 - DNA, 20 bp, Artificial Sequence
  Artificially Synthesized Primer Sequence
tgggtagacctcgataacgc

SEQ ID NO: 15931 - DNA, 20 bp, Artificial Sequence
  Artificially Synthesized Primer Sequence
gggtagacctcgataacgca

SEQ ID NO: 15932 - DNA, 20 bp, Artificial Sequence
  Artificially Synthesized Primer Sequence
atgtagcgggtgacctgttc

SEQ ID NO: 15933 - DNA, 20 bp, Artificial Sequence
  Artificially Synthesized Primer Sequence
gttggcctactggacagcat

SEQ ID NO: 15934 - DNA, 20 bp, Artificial Sequence
  Artificially Synthesized Primer Sequence
gggattagaccgagggtgat

SEQ ID NO: 15935 - DNA, 20 bp, Artificial Sequence
  Artificially Synthesized Primer Sequence
caaaacaaacttggcacacg

SEQ ID NO: 15936 - DNA, 20 bp, Artificial Sequence
  Artificially Synthesized Primer Sequence
aggtacgcctcaactgcaac

SEQ ID NO: 15937 - DNA, 20 bp, Artificial Sequence
  Artificially Synthesized Primer Sequence
acctgaccgaagtgacaacc

SEQ ID NO: 15938 - DNA, 20 bp, Artificial Sequence
  Artificially Synthesized Primer Sequence
ctgccccattagccgtagta

SEQ ID NO: 15939 - DNA, 20 bp, Artificial Sequence
  Artificially Synthesized Primer Sequence
ggcaagtcaaatgtcatgga

SEQ ID NO: 15940 - DNA, 20 bp, Artificial Sequence
  Artificially Synthesized Primer Sequence
acctggagggaagagcttgt

SEQ ID NO: 15941 - DNA, 20 bp, Artificial Sequence
  Artificially Synthesized Primer Sequence
gtgcctctcctaattctgcg

SEQ ID NO: 15942 - DNA, 20 bp, Artificial Sequence
  Artificially Synthesized Primer Sequence
tccttatacctgccacggtc

SEQ ID NO: 15943 - DNA, 20 bp, Artificial Sequence
  Artificially Synthesized Primer Sequence
ggcttctgacagtcacctcc

SEQ ID NO: 15944 - DNA, 20 bp, Artificial Sequence
  Artificially Synthesized Primer Sequence
gaccgtggcaggtataagga

SEQ ID NO: 15945 - DNA, 20 bp, Artificial Sequence
  Artificially Synthesized Primer Sequence
gtgctgtttctgctgctacg

SEQ ID NO: 15946 - DNA, 20 bp, Artificial Sequence
  Artificially Synthesized Primer Sequence
agaaagatgcatacggccac

SEQ ID NO: 15947 - DNA, 20 bp, Artificial Sequence
  Artificially Synthesized Primer Sequence
ccacaaccggcgtaaaataa

SEQ ID NO: 15948 - DNA, 20 bp, Artificial Sequence
  Artificially Synthesized Primer Sequence
accctttgccaagatgtacg

SEQ ID NO: 15949 - DNA, 20 bp, Artificial Sequence
  Artificially Synthesized Primer Sequence
tagacctaggccccacattg

SEQ ID NO: 15950 - DNA, 20 bp, Artificial Sequence
  Artificially Synthesized Primer Sequence
tgcgttcaactgattcaagc

SEQ ID NO: 15951 - DNA, 20 bp, Artificial Sequence
  Artificially Synthesized Primer Sequence
agcaccatccttgacaaacc

SEQ ID NO: 15952 - DNA, 20 bp, Artificial Sequence
  Artificially Synthesized Primer Sequence
gcgtgggatataatgttcgg

SEQ ID NO: 15953 - DNA, 20 bp, Artificial Sequence
  Artificially Synthesized Primer Sequence
aactacgcagggaacgtgac

SEQ ID NO: 15954 - DNA, 20 bp, Artificial Sequence
  Artificially Synthesized Primer Sequence
gttgggaaaggtcgtccata

SEQ ID NO: 15955 - DNA, 21 bp, Artificial Sequence
  Artificially Synthesized Primer Sequence
tgaaggcaaactggagcttta

SEQ ID NO: 15956 - DNA, 20 bp, Artificial Sequence
  Artificially Synthesized Primer Sequence
ccgtgttttcaagacctcgt

SEQ ID NO: 15957 - DNA, 20 bp, Artificial Sequence
  Artificially Synthesized Primer Sequence
aagaagtgccacctacccct

SEQ ID NO: 15958 - DNA, 20 bp, Artificial Sequence
  Artificially Synthesized Primer Sequence
cgcaggattgctctaagtcc

SEQ ID NO: 15959 - DNA, 20 bp, Artificial Sequence
  Artificially Synthesized Primer Sequence
aatggtgaaagggtcgactg

SEQ ID NO: 15960 - DNA, 20 bp, Artificial Sequence
  Artificially Synthesized Primer Sequence
tcatcctgcttttgacatgc

SEQ ID NO: 15961 - DNA, 20 bp, Artificial Sequence
  Artificially Synthesized Primer Sequence
tttgactgcaacagagccac

SEQ ID NO: 15962 - DNA, 20 bp, Artificial Sequence
  Artificially Synthesized Primer Sequence
tgcttcacattgggtcaaaa

SEQ ID NO: 15963 - DNA, 20 bp, Artificial Sequence
  Artificially Synthesized Primer Sequence
caactgggccttagcaagag

SEQ ID NO: 15964 - DNA, 20 bp, Artificial Sequence
  Artificially Synthesized Primer Sequence
aaatccaggtcaagtccgtg

SEQ ID NO: 15965 - DNA, 20 bp, Artificial Sequence
  Artificially Synthesized Primer Sequence
caccagaccagttctcagca

SEQ ID NO: 15966 - DNA, 20 bp, Artificial Sequence
  Artificially Synthesized Primer Sequence
tacgattatgcagtgcagcc

SEQ ID NO: 15967 - DNA, 20 bp, Artificial Sequence
  Artificially Synthesized Primer Sequence
gaaaaaccccaatcacttgc

SEQ ID NO: 15968 - DNA, 20 bp, Artificial Sequence
  Artificially Synthesized Primer Sequence
tggcaacttcccatatcctc

SEQ ID NO: 15969 - DNA, 20 bp, Artificial Sequence
  Artificially Synthesized Primer Sequence
ggtgaagaatgacgacggtt

SEQ ID NO: 15970 - DNA, 20 bp, Artificial Sequence
  Artificially Synthesized Primer Sequence
gggaactgcaatacctccaa

SEQ ID NO: 15971 - DNA, 20 bp, Artificial Sequence
  Artificially Synthesized Primer Sequence
gggaactgcaatacctccaa

SEQ ID NO: 15972 - DNA, 20 bp, Artificial Sequence
  Artificially Synthesized Primer Sequence
ggtgaagaatgacgacggtt

SEQ ID NO: 15973 - DNA, 20 bp, Artificial Sequence
  Artificially Synthesized Primer Sequence
catttgttccgtcctttcgt

SEQ ID NO: 15974 - DNA, 20 bp, Artificial Sequence
  Artificially Synthesized Primer Sequence
acaggttgctaccgcagtct

SEQ ID NO: 15975 - DNA, 20 bp, Artificial Sequence
  Artificially Synthesized Primer Sequence
ccacacgacagggatttctc

SEQ ID NO: 15976 - DNA, 21 bp, Artificial Sequence
  Artificially Synthesized Primer Sequence
aactccagtggcagcagtaga

SEQ ID NO: 15977 - DNA, 20 bp, Artificial Sequence
  Artificially Synthesized Primer Sequence
cccccacaagtacctgaaga

SEQ ID NO: 15978 - DNA, 20 bp, Artificial Sequence
  Artificially Synthesized Primer Sequence
tcatcctcatcctcgtcctc

SEQ ID NO: 15979 - DNA, 20 bp, Artificial Sequence
  Artificially Synthesized Primer Sequence
aagaatacgccaacacgacc

SEQ ID NO: 15980 - DNA, 20 bp, Artificial Sequence
  Artificially Synthesized Primer Sequence
tgtgcaagctgaggattttg

SEQ ID NO: 15981 - DNA, 20 bp, Artificial Sequence
  Artificially Synthesized Primer Sequence
tggatggtggagaaaaatcc

SEQ ID NO: 15982 - DNA, 20 bp, Artificial Sequence
  Artificially Synthesized Primer Sequence
tgatggcagcattgctaaag

SEQ ID NO: 15983 - DNA, 20 bp, Artificial Sequence
  Artificially Synthesized Primer Sequence
aaggatttcctccaccatcc

SEQ ID NO: 15984 - DNA, 20 bp, Artificial Sequence
  Artificially Synthesized Primer Sequence
gaagggatgagcatgacgat

SEQ ID NO: 15985 - DNA, 20 bp, Artificial Sequence
  Artificially Synthesized Primer Sequence
tttctggaaagggtggaatg

SEQ ID NO: 15986 - DNA, 20 bp, Artificial Sequence
  Artificially Synthesized Primer Sequence
tcgactccctataaggcgaa

SEQ ID NO: 15987 - DNA, 20 bp, Artificial Sequence
  Artificially Synthesized Primer Sequence
tatcgctgaatgtgacgctc

SEQ ID NO: 15988 - DNA, 20 bp, Artificial Sequence
  Artificially Synthesized Primer Sequence
gatctcgatcgctgaccaat

SEQ ID NO: 15989 - DNA, 20 bp, Artificial Sequence
  Artificially Synthesized Primer Sequence
aattcctcgagcactgttgg

SEQ ID NO: 15990 - DNA, 20 bp, Artificial Sequence
  Artificially Synthesized Primer Sequence
cctcgtatgagtgcctcctc

SEQ ID NO: 15991 - DNA, 20 bp, Artificial Sequence
  Artificially Synthesized Primer Sequence
tgttgggttaacaacgatgg

SEQ ID NO: 15992 - DNA, 20 bp, Artificial Sequence
  Artificially Synthesized Primer Sequence
cctcatcatctgcactgtcg

SEQ ID NO: 15993 - DNA, 20 bp, Artificial Sequence
  Artificially Synthesized Primer Sequence
atcaggcttgcaatgagctt

SEQ ID NO: 15994 - DNA, 20 bp, Artificial Sequence
  Artificially Synthesized Primer Sequence
catgctgggtttgaacattg

SEQ ID NO: 15995 - DNA, 20 bp, Artificial Sequence
  Artificially Synthesized Primer Sequence
tccgttcggttagaacaagc

SEQ ID NO: 15996 - DNA, 20 bp, Artificial Sequence
  Artificially Synthesized Primer Sequence
atccgcagcaattgaatacc

SEQ ID NO: 15997 - DNA, 20 bp, Artificial Sequence
  Artificially Synthesized Primer Sequence
tcctccaagaagcagagcat

SEQ ID NO: 15998 - DNA, 20 bp, Artificial Sequence
  Artificially Synthesized Primer Sequence
ttcatctggacgctgaactg

SEQ ID NO: 15999 - DNA, 20 bp, Artificial Sequence
  Artificially Synthesized Primer Sequence
gtgagaaaacagggagagcg

SEQ ID NO: 16000 - DNA, 20 bp, Artificial Sequence
  Artificially Synthesized Primer Sequence
actacgactactgcgccgac

SEQ ID NO: 16001 - DNA, 20 bp, Artificial Sequence
  Artificially Synthesized Primer Sequence
agtgcagtagaggaggccaa

SEQ ID NO: 16002 - DNA, 20 bp, Artificial Sequence
  Artificially Synthesized Primer Sequence
gtgcagcaggaagttgatga

SEQ ID NO: 16003 - DNA, 20 bp, Artificial Sequence
  Artificially Synthesized Primer Sequence
tagttcggctcgaggacact

SEQ ID NO: 16004 - DNA, 20 bp, Artificial Sequence
  Artificially Synthesized Primer Sequence
ggcgacggaattgagtacat

SEQ ID NO: 16005 - DNA, 20 bp, Artificial Sequence
  Artificially Synthesized Primer Sequence
aattcctcgagcactgttgg

SEQ ID NO: 16006 - DNA, 20 bp, Artificial Sequence
  Artificially Synthesized Primer Sequence
aaaccccctcctttgaaaaa

SEQ ID NO: 16007 - DNA, 20 bp, Artificial Sequence
  Artificially Synthesized Primer Sequence
tgccatttcatttcagcatc

SEQ ID NO: 16008 - DNA, 20 bp, Artificial Sequence
  Artificially Synthesized Primer Sequence
acctgaggttccagtcctcc

SEQ ID NO: 16009 - DNA, 20 bp, Artificial Sequence
  Artificially Synthesized Primer Sequence
gaatggaggctcgaatacca

SEQ ID NO: 16010 - DNA, 20 bp, Artificial Sequence
  Artificially Synthesized Primer Sequence
ggtttctgctctgttttcgc

SEQ ID NO: 16011 - DNA, 20 bp, Artificial Sequence
  Artificially Synthesized Primer Sequence
gttcaatcgcacaaaccaaa

SEQ ID NO: 16012 - DNA, 20 bp, Artificial Sequence
  Artificially Synthesized Primer Sequence
cgaagaaagggcagtcaaag

SEQ ID NO: 16013 - DNA, 20 bp, Artificial Sequence
  Artificially Synthesized Primer Sequence
gcagagcaagtacccctacg

SEQ ID NO: 16014 - DNA, 20 bp, Artificial Sequence
  Artificially Synthesized Primer Sequence
gaggaaggaaaccgaggaac

SEQ ID NO: 16015 - DNA, 20 bp, Artificial Sequence
  Artificially Synthesized Primer Sequence
gaggaaggaaaccgaggaac

SEQ ID NO: 16016 - DNA, 20 bp, Artificial Sequence
  Artificially Synthesized Primer Sequence
gtacccctacgccaagatca

SEQ ID NO: 16017 - DNA, 20 bp, Artificial Sequence
  Artificially Synthesized Primer Sequence
tcttcagctacaacatggcg

SEQ ID NO: 16018 - DNA, 20 bp, Artificial Sequence
  Artificially Synthesized Primer Sequence
tggaacaccaggaacctttc

SEQ ID NO: 16019 - DNA, 20 bp, Artificial Sequence
  Artificially Synthesized Primer Sequence
acaccaagcaatctgggaag

SEQ ID NO: 16020 - DNA, 20 bp, Artificial Sequence
  Artificially Synthesized Primer Sequence
tgttgccacttgcgatagag

SEQ ID NO: 16021 - DNA, 20 bp, Artificial Sequence
  Artificially Synthesized Primer Sequence
acaagatctggaacaacggg

SEQ ID NO: 16022 - DNA, 20 bp, Artificial Sequence
  Artificially Synthesized Primer Sequence
gtggtacgtggagaggtcgt

SEQ ID NO: 16023 - DNA, 20 bp, Artificial Sequence
  Artificially Synthesized Primer Sequence
tcacaacaacaacagcagca

SEQ ID NO: 16024 - DNA, 20 bp, Artificial Sequence
  Artificially Synthesized Primer Sequence
gcatacaagcagatcaccga

SEQ ID NO: 16025 - DNA, 20 bp, Artificial Sequence
  Artificially Synthesized Primer Sequence
ctggtaaggtggtggctgat

SEQ ID NO: 16026 - DNA, 20 bp, Artificial Sequence
  Artificially Synthesized Primer Sequence
ggtacaagctaagggccaca

SEQ ID NO: 16027 - DNA, 20 bp, Artificial Sequence
  Artificially Synthesized Primer Sequence
gaattcgacgctgtttttcc

SEQ ID NO: 16028 - DNA, 20 bp, Artificial Sequence
  Artificially Synthesized Primer Sequence
aaggagcttgacatcgcagt

SEQ ID NO: 16029 - DNA, 20 bp, Artificial Sequence
  Artificially Synthesized Primer Sequence
actagaaaacatgcacgccc

SEQ ID NO: 16030 - DNA, 20 bp, Artificial Sequence
  Artificially Synthesized Primer Sequence
aaaaagcccttgttccaggt

SEQ ID NO: 16031 - DNA, 20 bp, Artificial Sequence
  Artificially Synthesized Primer Sequence
aggaggggccagtaagagag

SEQ ID NO: 16032 - DNA, 20 bp, Artificial Sequence
  Artificially Synthesized Primer Sequence
cggcatagtgaacaggcttc

SEQ ID NO: 16033 - DNA, 20 bp, Artificial Sequence
  Artificially Synthesized Primer Sequence
cttcggagtgccttcttgac

SEQ ID NO: 16034 - DNA, 20 bp, Artificial Sequence
  Artificially Synthesized Primer Sequence
ctcaggagcatggtagcctc

SEQ ID NO: 16035 - DNA, 20 bp, Artificial Sequence
  Artificially Synthesized Primer Sequence
gcagaccaagcttccaattc

SEQ ID NO: 16036 - DNA, 20 bp, Artificial Sequence
  Artificially Synthesized Primer Sequence
gaccaacgatgcttgaggtt

SEQ ID NO: 16037 - DNA, 20 bp, Artificial Sequence
  Artificially Synthesized Primer Sequence
gcttaaagcgagcagaatgg

SEQ ID NO: 16038 - DNA, 20 bp, Artificial Sequence
  Artificially Synthesized Primer Sequence
cgctgtggtataagggtcgt

SEQ ID NO: 16039 - DNA, 20 bp, Artificial Sequence
  Artificially Synthesized Primer Sequence
atgacaagtttcgccacctc

SEQ ID NO: 16040 - DNA, 20 bp, Artificial Sequence
  Artificially Synthesized Primer Sequence
ggtggttggactgctgagtt

SEQ ID NO: 16041 - DNA, 20 bp, Artificial Sequence
  Artificially Synthesized Primer Sequence
caggagatcgacttcttcgg

SEQ ID NO: 16042 - DNA, 20 bp, Artificial Sequence
  Artificially Synthesized Primer Sequence
aacatgtccaaagtccaggc

SEQ ID NO: 16043 - DNA, 20 bp, Artificial Sequence
  Artificially Synthesized Primer Sequence
ttccggagctctttctttca

SEQ ID NO: 16044 - DNA, 20 bp, Artificial Sequence
  Artificially Synthesized Primer Sequence
gactactccatttgcctcgg

SEQ ID NO: 16045 - DNA, 20 bp, Artificial Sequence
  Artificially Synthesized Primer Sequence
accgtcagattcttggcaac

SEQ ID NO: 16046 - DNA, 20 bp, Artificial Sequence
  Artificially Synthesized Primer Sequence
cattaaggctctggctctgg

SEQ ID NO: 16047 - DNA, 20 bp, Artificial Sequence
  Artificially Synthesized Primer Sequence
tgcagcaacccatgttttta

SEQ ID NO: 16048 - DNA, 20 bp, Artificial Sequence
  Artificially Synthesized Primer Sequence
gctttctgaaggtcaatggg

SEQ ID NO: 16049 - DNA, 20 bp, Artificial Sequence
  Artificially Synthesized Primer Sequence
tcaatgtcgtctgctggaag

SEQ ID NO: 16050 - DNA, 20 bp, Artificial Sequence
  Artificially Synthesized Primer Sequence
gcgatgatgtcgaattcctt

SEQ ID NO: 16051 - DNA, 20 bp, Artificial Sequence
  Artificially Synthesized Primer Sequence
acgaatcttttggctggaga

SEQ ID NO: 16052 - DNA, 20 bp, Artificial Sequence
  Artificially Synthesized Primer Sequence
ggatggattcagttgccagt

SEQ ID NO: 16053 - DNA, 20 bp, Artificial Sequence
  Artificially Synthesized Primer Sequence
gtggaaaccctgtctggtgt

SEQ ID NO: 16054 - DNA, 20 bp, Artificial Sequence
  Artificially Synthesized Primer Sequence
gatcatcgctcgactcatca

SEQ ID NO: 16055 - DNA, 20 bp, Artificial Sequence
  Artificially Synthesized Primer Sequence
taccaacgagggaggacatc

SEQ ID NO: 16056 - DNA, 20 bp, Artificial Sequence
  Artificially Synthesized Primer Sequence
agggttcagactgccacaag

SEQ ID NO: 16057 - DNA, 20 bp, Artificial Sequence
  Artificially Synthesized Primer Sequence
gcttctgagatgcctgatcc

SEQ ID NO: 16058 - DNA, 20 bp, Artificial Sequence
  Artificially Synthesized Primer Sequence
ttatggcacctgacggtgta

SEQ ID NO: 16059 - DNA, 21 bp, Artificial Sequence
  Artificially Synthesized Primer Sequence
cgctggaagaaatatcaccac

SEQ ID NO: 16060 - DNA, 20 bp, Artificial Sequence
  Artificially Synthesized Primer Sequence
cagaatgatggcgtctggta

SEQ ID NO: 16061 - DNA, 20 bp, Artificial Sequence
  Artificially Synthesized Primer Sequence
catcggcctccaagtaccta

SEQ ID NO: 16062 - DNA, 20 bp, Artificial Sequence
  Artificially Synthesized Primer Sequence
ggccctgaatttgctaatga

SEQ ID NO: 16063 - DNA, 20 bp, Artificial Sequence
  Artificially Synthesized Primer Sequence
agttgcattcttgcccaaac

SEQ ID NO: 16064 - DNA, 20 bp, Artificial Sequence
  Artificially Synthesized Primer Sequence
catcggcctccaagtaccta

SEQ ID NO: 16065 - DNA, 20 bp, Artificial Sequence
  Artificially Synthesized Primer Sequence
gtggccgtgttctatggtct

SEQ ID NO: 16066 - DNA, 20 bp, Artificial Sequence
  Artificially Synthesized Primer Sequence
gtaacacccagcagaggagc

SEQ ID NO: 16067 - DNA, 20 bp, Artificial Sequence
  Artificially Synthesized Primer Sequence
gtaacacccagcagaggagc

SEQ ID NO: 16068 - DNA, 20 bp, Artificial Sequence
  Artificially Synthesized Primer Sequence
gtggccgtgttctatggtct

SEQ ID NO: 16069 - DNA, 20 bp, Artificial Sequence
  Artificially Synthesized Primer Sequence
ggctgctgttgatctgttga

SEQ ID NO: 16070 - DNA, 20 bp, Artificial Sequence
  Artificially Synthesized Primer Sequence
gcttagtggtggctgaggtc

SEQ ID NO: 16071 - DNA, 20 bp, Artificial Sequence
  Artificially Synthesized Primer Sequence
ctcaatgcagcggtgaagta

SEQ ID NO: 16072 - DNA, 20 bp, Artificial Sequence
  Artificially Synthesized Primer Sequence
gttttgagagagagccgtcg

SEQ ID NO: 16073 - DNA, 20 bp, Artificial Sequence
  Artificially Synthesized Primer Sequence
acgggttgagtcctttgatg

SEQ ID NO: 16074 - DNA, 20 bp, Artificial Sequence
  Artificially Synthesized Primer Sequence
tgcacagagggcaagatatg

SEQ ID NO: 16075 - DNA, 20 bp, Artificial Sequence
  Artificially Synthesized Primer Sequence
gctcacaaaacgaaagggag

SEQ ID NO: 16076 - DNA, 20 bp, Artificial Sequence
  Artificially Synthesized Primer Sequence
gctccatatcttgccctctg

SEQ ID NO: 16077 - DNA, 20 bp, Artificial Sequence
  Artificially Synthesized Primer Sequence
ggtgcagtgtatgatgtggc

SEQ ID NO: 16078 - DNA, 20 bp, Artificial Sequence
  Artificially Synthesized Primer Sequence
tagggtcatcgtcctcttgg

SEQ ID NO: 16079 - DNA, 20 bp, Artificial Sequence
  Artificially Synthesized Primer Sequence
ttcgactacccatccgaatc

SEQ ID NO: 16080 - DNA, 20 bp, Artificial Sequence
  Artificially Synthesized Primer Sequence
cactttgctgcttgcttcag

SEQ ID NO: 16081 - DNA, 20 bp, Artificial Sequence
  Artificially Synthesized Primer Sequence
tgcttgatgaagccattgag

SEQ ID NO: 16082 - DNA, 20 bp, Artificial Sequence
  Artificially Synthesized Primer Sequence
tttttctgcggagttatggg

SEQ ID NO: 16083 - DNA, 20 bp, Artificial Sequence
  Artificially Synthesized Primer Sequence
agacagtccagtgcgactca

SEQ ID NO: 16084 - DNA, 20 bp, Artificial Sequence
  Artificially Synthesized Primer Sequence
ctttgaagggctacgaccag

SEQ ID NO: 16085 - DNA, 20 bp, Artificial Sequence
  Artificially Synthesized Primer Sequence
gaggcaaatggaaatctgga

SEQ ID NO: 16086 - DNA, 20 bp, Artificial Sequence
  Artificially Synthesized Primer Sequence
actgaatggaggctgttgct

SEQ ID NO: 16087 - DNA, 20 bp, Artificial Sequence
  Artificially Synthesized Primer Sequence
cattttgtcctccggcttta

SEQ ID NO: 16088 - DNA, 20 bp, Artificial Sequence
  Artificially Synthesized Primer Sequence
tctctgccaaagaagtggct

SEQ ID NO: 16089 - DNA, 20 bp, Artificial Sequence
  Artificially Synthesized Primer Sequence
acagggacaaggacaaccag

SEQ ID NO: 16090 - DNA, 20 bp, Artificial Sequence
  Artificially Synthesized Primer Sequence
gcctggttggtcacaaactt

SEQ ID NO: 16091 - DNA, 20 bp, Artificial Sequence
  Artificially Synthesized Primer Sequence
gggaactcaagatgcgagac

SEQ ID NO: 16092 - DNA, 20 bp, Artificial Sequence
  Artificially Synthesized Primer Sequence
acagggacaaggacaaccag

SEQ ID NO: 16093 - DNA, 20 bp, Artificial Sequence
  Artificially Synthesized Primer Sequence
caacgccctatatgcaaggt

SEQ ID NO: 16094 - DNA, 20 bp, Artificial Sequence
  Artificially Synthesized Primer Sequence
ggagctaagggcggtctact

SEQ ID NO: 16095 - DNA, 20 bp, Artificial Sequence
  Artificially Synthesized Primer Sequence
tatgtaagcaggcagcatcg

SEQ ID NO: 16096 - DNA, 20 bp, Artificial Sequence
  Artificially Synthesized Primer Sequence
caacgccctatatgcaaggt

SEQ ID NO: 16097 - DNA, 20 bp, Artificial Sequence
  Artificially Synthesized Primer Sequence
tgattcctcaggccaaaatc

SEQ ID NO: 16098 - DNA, 20 bp, Artificial Sequence
  Artificially Synthesized Primer Sequence
ccgaaaaatttcccagttga

SEQ ID NO: 16099 - DNA, 20 bp, Artificial Sequence
  Artificially Synthesized Primer Sequence
caagcgggaaaagttcacac

SEQ ID NO: 16100 - DNA, 20 bp, Artificial Sequence
  Artificially Synthesized Primer Sequence
gtggtgtcattgtgcctgaa

SEQ ID NO: 16101 - DNA, 20 bp, Artificial Sequence
  Artificially Synthesized Primer Sequence
ctcactcatggcagtggaga

SEQ ID NO: 16102 - DNA, 20 bp, Artificial Sequence
  Artificially Synthesized Primer Sequence
gaaacatagccaagatgccg

SEQ ID NO: 16103 - DNA, 20 bp, Artificial Sequence
  Artificially Synthesized Primer Sequence
acgcctagacggtgttcaat

SEQ ID NO: 16104 - DNA, 20 bp, Artificial Sequence
  Artificially Synthesized Primer Sequence
aggagctcatgcgctagaag

SEQ ID NO: 16105 - DNA, 20 bp, Artificial Sequence
  Artificially Synthesized Primer Sequence
aattcctcgagcactgttgg

SEQ ID NO: 16106 - DNA, 20 bp, Artificial Sequence
  Artificially Synthesized Primer Sequence
acgaagaggaagtcgcagtc

SEQ ID NO: 16107 - DNA, 20 bp, Artificial Sequence
  Artificially Synthesized Primer Sequence
attggatacttggccctcaa

SEQ ID NO: 16108 - DNA, 20 bp, Artificial Sequence
  Artificially Synthesized Primer Sequence
gaggagaaagaaggcgaggt

SEQ ID NO: 16109 - DNA, 20 bp, Artificial Sequence
  Artificially Synthesized Primer Sequence
tagccacgtctcctacaccc

SEQ ID NO: 16110 - DNA, 20 bp, Artificial Sequence
  Artificially Synthesized Primer Sequence
cgccctttcaggttatggta

SEQ ID NO: 16111 - DNA, 20 bp, Artificial Sequence
  Artificially Synthesized Primer Sequence
gtcttcacaatccaaggcgt

SEQ ID NO: 16112 - DNA, 20 bp, Artificial Sequence
  Artificially Synthesized Primer Sequence
tacatcgccctcttcttcgt

SEQ ID NO: 16113 - DNA, 10 bp, Artificial Sequence
  Artificially Synthesized Primer Sequence
  MISC_FEATURE (1)..(10): n stands for any base
nnnnnnnnnn

SEQ ID NO: 16114 - DNA, 10 bp, Artificial Sequence
  Artificially Synthesized Primer Sequence
  MISC_FEATURE (1)..(10): n stands for any base
nnnnnnnnnn

SEQ ID NO: 16115 - DNA, 20 bp, Artificial Sequence
  Artificially Synthesized Primer Sequence
aactgctgattgattgcacg

SEQ ID NO: 16116 - DNA, 19 bp, Artificial Sequence
  Artificially Synthesized Primer Sequence
agttcgccgtcgacaagtt

SEQ ID NO: 16117 - DNA, 20 bp, Artificial Sequence
  Artificially Synthesized Primer Sequence
ctctacctctacgccaagcg

SEQ ID NO: 16118 - DNA, 20 bp, Artificial Sequence
  Artificially Synthesized Primer Sequence
tgccaaaagactgtgactcg

SEQ ID NO: 16119 - DNA, 20 bp, Artificial Sequence
  Artificially Synthesized Primer Sequence
aatgccaaacatccctttgt

SEQ ID NO: 16120 - DNA, 20 bp, Artificial Sequence
  Artificially Synthesized Primer Sequence
gtcgtcgaactgatccatcc

SEQ ID NO: 16121 - DNA, 20 bp, Artificial Sequence
  Artificially Synthesized Primer Sequence
gcgcaaggttcgctatactc

SEQ ID NO: 16122 - DNA, 20 bp, Artificial Sequence
  Artificially Synthesized Primer Sequence
gtacgtccacatcagccctt

SEQ ID NO: 16123 - DNA, 20 bp, Artificial Sequence
  Artificially Synthesized Primer Sequence
ttgggcatagcaacatgaaa

SEQ ID NO: 16124 - DNA, 20 bp, Artificial Sequence
  Artificially Synthesized Primer Sequence
tgctgtgctgttcttcttgg

SEQ ID NO: 16125 - DNA, 20 bp, Artificial Sequence
  Artificially Synthesized Primer Sequence
aggaattctgcacgaggcta

SEQ ID NO: 16126 - DNA, 20 bp, Artificial Sequence
  Artificially Synthesized Primer Sequence
catccacatcaacagcaacc

SEQ ID NO: 16127 - DNA, 20 bp, Artificial Sequence
  Artificially Synthesized Primer Sequence
gtttctgctcaacctcctgc

SEQ ID NO: 16128 - DNA, 20 bp, Artificial Sequence
  Artificially Synthesized Primer Sequence
ccgagatgctctccaaaatc

SEQ ID NO: 16129 - DNA, 20 bp, Artificial Sequence
  Artificially Synthesized Primer Sequence
agattgcttcgcgtttcact

SEQ ID NO: 16130 - DNA, 20 bp, Artificial Sequence
  Artificially Synthesized Primer Sequence
tgaacgaaacaagacaagcg

SEQ ID NO: 16131 - DNA, 20 bp, Artificial Sequence
  Artificially Synthesized Primer Sequence
taacgccacaacaataggca

SEQ ID NO: 16132 - DNA, 20 bp, Artificial Sequence
  Artificially Synthesized Primer Sequence
cgagacaaccaaggagaagc

SEQ ID NO: 16133 - DNA, 20 bp, Artificial Sequence
  Artificially Synthesized Primer Sequence
agcctctacccactgctcaa

SEQ ID NO: 16134 - DNA, 20 bp, Artificial Sequence
  Artificially Synthesized Primer Sequence
ccaagaagcaaatggatggt

SEQ ID NO: 16135 - DNA, 20 bp, Artificial Sequence
  Artificially Synthesized Primer Sequence
cgagacatcaaatcgcacac

SEQ ID NO: 16136 - DNA, 20 bp, Artificial Sequence
  Artificially Synthesized Primer Sequence
ggatccaagctactgggaca

SEQ ID NO: 16137 - DNA, 20 bp, Artificial Sequence
  Artificially Synthesized Primer Sequence
gcaaaggtcaatttcccaga

SEQ ID NO: 16138 - DNA, 20 bp, Artificial Sequence
  Artificially Synthesized Primer Sequence
gccgttgaattactgccatt

SEQ ID NO: 16139 - DNA, 20 bp, Artificial Sequence
  Artificially Synthesized Primer Sequence
agggcatgtcatcaaaggtc

SEQ ID NO: 16140 - DNA, 20 bp, Artificial Sequence
  Artificially Synthesized Primer Sequence
atgaatgcagttgaggctcc

SEQ ID NO: 16141 - DNA, 20 bp, Artificial Sequence
  Artificially Synthesized Primer Sequence
tttccttctcatgaccagcc

SEQ ID NO: 16142 - DNA, 20 bp, Artificial Sequence
  Artificially Synthesized Primer Sequence
tccatagcagcaagggagac

SEQ ID NO: 16143 - DNA, 20 bp, Artificial Sequence
  Artificially Synthesized Primer Sequence
gccgttcaatccttccatta

SEQ ID NO: 16144 - DNA, 20 bp, Artificial Sequence
  Artificially Synthesized Primer Sequence
atggagcatcgctagaccac

SEQ ID NO: 16145 - DNA, 20 bp, Artificial Sequence
  Artificially Synthesized Primer Sequence
cattcgtcgagatacccgat

SEQ ID NO: 16146 - DNA, 20 bp, Artificial Sequence
  Artificially Synthesized Primer Sequence
tgctgagtcggttcagtgac

SEQ ID NO: 16147 - DNA, 20 bp, Artificial Sequence
  Artificially Synthesized Primer Sequence
gttgtatgtgtgccaatgcc

SEQ ID NO: 16148 - DNA, 20 bp, Artificial Sequence
  Artificially Synthesized Primer Sequence
cacctgaccacctcacattg

SEQ ID NO: 16149 - DNA, 20 bp, Artificial Sequence
  Artificially Synthesized Primer Sequence
agatggttgatgaggcgaac

SEQ ID NO: 16150 - DNA, 20 bp, Artificial Sequence
  Artificially Synthesized Primer Sequence
gtgtcagggtggtgtaaccc

SEQ ID NO: 16151 - DNA, 20 bp, Artificial Sequence
  Artificially Synthesized Primer Sequence
tgcgaaacagagtgagcaat

SEQ ID NO: 16152 - DNA, 20 bp, Artificial Sequence
  Artificially Synthesized Primer Sequence
gctcaaggagttcacaagcc

SEQ ID NO: 16153 - DNA, 20 bp, Artificial Sequence
  Artificially Synthesized Primer Sequence
acggccactttattctgcac

SEQ ID NO: 16154 - DNA, 20 bp, Artificial Sequence
  Artificially Synthesized Primer Sequence
ggaaagtgggagaaatgcaa

SEQ ID NO: 16155 - DNA, 22 bp, Artificial Sequence
  Artificially Synthesized Primer Sequence
tgtacatcaacgtacaaccgtg

SEQ ID NO: 16156 - DNA, 20 bp, Artificial Sequence
  Artificially Synthesized Primer Sequence
tcagagatccagcacattcg

SEQ ID NO: 16157 - DNA, 20 bp, Artificial Sequence
  Artificially Synthesized Primer Sequence
tgcacaagagaagatggtgg

SEQ ID NO: 16158 - DNA, 20 bp, Artificial Sequence
  Artificially Synthesized Primer Sequence
ttgtcagtgcttgagatcgg

SEQ ID NO: 16159 - DNA, 20 bp, Artificial Sequence
  Artificially Synthesized Primer Sequence
gttcgagccatcaaggaaag

SEQ ID NO: 16160 - DNA, 20 bp, Artificial Sequence
  Artificially Synthesized Primer Sequence
gcttcgactccaatccacat

SEQ ID NO: 16161 - DNA, 20 bp, Artificial Sequence
  Artificially Synthesized Primer Sequence
aacgcttgctcgtttcatct

SEQ ID NO: 16162 - DNA, 20 bp, Artificial Sequence
  Artificially Synthesized Primer Sequence
ccaaacagatgcaccttcct

SEQ ID NO: 16163 - DNA, 20 bp, Artificial Sequence
  Artificially Synthesized Primer Sequence
tcctgagtaacggggttctg

SEQ ID NO: 16164 - DNA, 19 bp, Artificial Sequence
  Artificially Synthesized Primer Sequence
acaatcagctgttcgtggc

SEQ ID NO: 16165 - DNA, 20 bp, Artificial Sequence
  Artificially Synthesized Primer Sequence
gacgccccttacttacacca

SEQ ID NO: 16166 - DNA, 20 bp, Artificial Sequence
  Artificially Synthesized Primer Sequence
tgactggatgagccctaacc

SEQ ID NO: 16167 - DNA, 20 bp, Artificial Sequence
  Artificially Synthesized Primer Sequence
ggcatctgaattagcttcgc

SEQ ID NO: 16168 - DNA, 20 bp, Artificial Sequence
  Artificially Synthesized Primer Sequence
gacgccccttacttacacca

SEQ ID NO: 16169 - DNA, 20 bp, Artificial Sequence
  Artificially Synthesized Primer Sequence
gagaggtggatgtctgggaa

SEQ ID NO: 16170 - DNA, 20 bp, Artificial Sequence
  Artificially Synthesized Primer Sequence
cgacggcccacttaaataga

SEQ ID NO: 16171 - DNA, 20 bp, Artificial Sequence
  Artificially Synthesized Primer Sequence
atccagctcgctcagttcat

SEQ ID NO: 16172 - DNA, 20 bp, Artificial Sequence
  Artificially Synthesized Primer Sequence
cagatttcgctggatggaat

SEQ ID NO: 16173 - DNA, 20 bp, Artificial Sequence
  Artificially Synthesized Primer Sequence
ctcgtcgtcttctcctccac

SEQ ID NO: 16174 - DNA, 20 bp, Artificial Sequence
  Artificially Synthesized Primer Sequence
gccgtcatcacagagtcaga

SEQ ID NO: 16175 - DNA, 20 bp, Artificial Sequence
  Artificially Synthesized Primer Sequence
gcatacatggtttgcacgaa

SEQ ID NO: 16176 - DNA, 20 bp, Artificial Sequence
  Artificially Synthesized Primer Sequence
tctgactctgtgatgacggc

SEQ ID NO: 16177 - DNA, 20 bp, Artificial Sequence
  Artificially Synthesized Primer Sequence
gctggctcaaggaacaaaag

SEQ ID NO: 16178 - DNA, 20 bp, Artificial Sequence
  Artificially Synthesized Primer Sequence
agcaccgtcaagtgcttctt

SEQ ID NO: 16179 - DNA, 20 bp, Artificial Sequence
  Artificially Synthesized Primer Sequence
agcaccgtcaagtgcttctt

SEQ ID NO: 16180 - DNA, 20 bp, Artificial Sequence
  Artificially Synthesized Primer Sequence
gctggctcaaggaacaaaag

SEQ ID NO: 16181 - DNA, 20 bp, Artificial Sequence
  Artificially Synthesized Primer Sequence
ttgcgggaactttaggtgac

SEQ ID NO: 16182 - DNA, 20 bp, Artificial Sequence
  Artificially Synthesized Primer Sequence
tgcagctcttaccacacctg

SEQ ID NO: 16183 - DNA, 20 bp, Artificial Sequence
  Artificially Synthesized Primer Sequence
gaacgctaaggtgtgaaggg

SEQ ID NO: 16184 - DNA, 20 bp, Artificial Sequence
  Artificially Synthesized Primer Sequence
gatgtccggcttcaggtagt

SEQ ID NO: 16185 - DNA, 20 bp, Artificial Sequence
  Artificially Synthesized Primer Sequence
acccactaatcacacgcctc

SEQ ID NO: 16186 - DNA, 20 bp, Artificial Sequence
  Artificially Synthesized Primer Sequence
caccagctccgatatcacct

SEQ ID NO: 16187 - DNA, 20 bp, Artificial Sequence
  Artificially Synthesized Primer Sequence
cttatgcaacctcagacgca

SEQ ID NO: 16188 - DNA, 20 bp, Artificial Sequence
  Artificially Synthesized Primer Sequence
cgggtctaccatgtaccagc

SEQ ID NO: 16189 - DNA, 20 bp, Artificial Sequence
  Artificially Synthesized Primer Sequence
catgaagaagcttggtgcaa

SEQ ID NO: 16190 - DNA, 20 bp, Artificial Sequence
  Artificially Synthesized Primer Sequence
aagggagaaaagggacgaaa

SEQ ID NO: 16191 - DNA, 20 bp, Artificial Sequence
  Artificially Synthesized Primer Sequence
caacccggtagcagcattat

SEQ ID NO: 16192 - DNA, 20 bp, Artificial Sequence
  Artificially Synthesized Primer Sequence
cagaggtcgaaacacaccaa

SEQ ID NO: 16193 - DNA, 20 bp, Artificial Sequence
  Artificially Synthesized Primer Sequence
tcatataaagggcaggccac

SEQ ID NO: 16194 - DNA, 20 bp, Artificial Sequence
  Artificially Synthesized Primer Sequence
tcatctgacatcgctgaagg

SEQ ID NO: 16195 - DNA, 20 bp, Artificial Sequence
  Artificially Synthesized Primer Sequence
tacggatacgcaaatgcaag

SEQ ID NO: 16196 - DNA, 20 bp, Artificial Sequence
  Artificially Synthesized Primer Sequence
gagacaaaaacagcaagggc

SEQ ID NO: 16197 - DNA, 20 bp, Artificial Sequence
  Artificially Synthesized Primer Sequence
aaatggtggattgagccttg

SEQ ID NO: 16198 - DNA, 20 bp, Artificial Sequence
  Artificially Synthesized Primer Sequence
ccctttcattcagaagctcg

SEQ ID NO: 16199 - DNA, 20 bp, Artificial Sequence
  Artificially Synthesized Primer Sequence
atggaactggactacggtgg

SEQ ID NO: 16200 - DNA, 20 bp, Artificial Sequence
  Artificially Synthesized Primer Sequence
ctaaaacggactccgagcag

SEQ ID NO: 16201 - DNA, 20 bp, Artificial Sequence
  Artificially Synthesized Primer Sequence
ttaccccactatgcagggag

SEQ ID NO: 16202 - DNA, 20 bp, Artificial Sequence
  Artificially Synthesized Primer Sequence
cagcaagagcaagtgagcag

SEQ ID NO: 16203 - DNA, 19 bp, Artificial Sequence
  Artificially Synthesized Primer Sequence
gcgccacctttcattatca

SEQ ID NO: 16204 - DNA, 19 bp, Artificial Sequence
  Artificially Synthesized Primer Sequence
cattggaatcctggagcct

SEQ ID NO: 16205 - DNA, 10 bp, Artificial Sequence
  Artificially Synthesized Primer Sequence
  MISC_FEATURE (1)..(10): n stands for any base
nnnnnnnnnn

SEQ ID NO: 16206 - DNA, 10 bp, Artificial Sequence
  Artificially Synthesized Primer Sequence
  MISC_FEATURE (1)..(10): n stands for any base
nnnnnnnnnn

SEQ ID NO: 16207 - DNA, 20 bp, Artificial Sequence
  Artificially Synthesized Primer Sequence
tcaccacaagcacacagaca

SEQ ID NO: 16208 - DNA, 20 bp, Artificial Sequence
  Artificially Synthesized Primer Sequence
ggttcatacggtggtgggta

SEQ ID NO: 16209 - DNA, 20 bp, Artificial Sequence
  Artificially Synthesized Primer Sequence
gtgcccctgtagcatacgat

SEQ ID NO: 16210 - DNA, 20 bp, Artificial Sequence
  Artificially Synthesized Primer Sequence
aaaagagaaggaggcggaag

SEQ ID NO: 16211 - DNA, 20 bp, Artificial Sequence
  Artificially Synthesized Primer Sequence
atcgtatgctacaggggcac

SEQ ID NO: 16212 - DNA, 20 bp, Artificial Sequence
  Artificially Synthesized Primer Sequence
actctgaccgtcgagctgat

SEQ ID NO: 16213 - DNA, 20 bp, Artificial Sequence
  Artificially Synthesized Primer Sequence
ctggagcatagaggatggga

SEQ ID NO: 16214 - DNA, 20 bp, Artificial Sequence
  Artificially Synthesized Primer Sequence
ctctgggtgctgagacatga

SEQ ID NO: 16215 - DNA, 20 bp, Artificial Sequence
  Artificially Synthesized Primer Sequence
gctgaaatcgcacaagtgaa

SEQ ID NO: 16216 - DNA, 20 bp, Artificial Sequence
  Artificially Synthesized Primer Sequence
ccaaaaggtggaaccagaga

SEQ ID NO: 16217 - DNA, 20 bp, Artificial Sequence
  Artificially Synthesized Primer Sequence
cacgcctcatcttctcttcc

SEQ ID NO: 16218 - DNA, 20 bp, Artificial Sequence
  Artificially Synthesized Primer Sequence
caccagctccgatatcacct

SEQ ID NO: 16219 - DNA, 20 bp, Artificial Sequence
  Artificially Synthesized Primer Sequence
ccagccatgtactcacgcta

SEQ ID NO: 16220 - DNA, 20 bp, Artificial Sequence
  Artificially Synthesized Primer Sequence
gctctcctccttcaagctcc

SEQ ID NO: 16221 - DNA, 20 bp, Artificial Sequence
  Artificially Synthesized Primer Sequence
actgttggcctactggatgg

SEQ ID NO: 16222 - DNA, 20 bp, Artificial Sequence
  Artificially Synthesized Primer Sequence
ccttgagttttccccaacag

SEQ ID NO: 16223 - DNA, 20 bp, Artificial Sequence
  Artificially Synthesized Primer Sequence
cgtcagaaaattaggcctcg

SEQ ID NO: 16224 - DNA, 20 bp, Artificial Sequence
  Artificially Synthesized Primer Sequence
acgttcaacgagatcctgct

SEQ ID NO: 16225 - DNA, 20 bp, Artificial Sequence
  Artificially Synthesized Primer Sequence
gtgactcggaagagagcacc

SEQ ID NO: 16226 - DNA, 20 bp, Artificial Sequence
  Artificially Synthesized Primer Sequence
gatctcgtccagtgccattt

SEQ ID NO: 16227 - DNA, 20 bp, Artificial Sequence
  Artificially Synthesized Primer Sequence
gagtctcacaggctccgttc

SEQ ID NO: 16228 - DNA, 20 bp, Artificial Sequence
  Artificially Synthesized Primer Sequence
gtgggagaggcagaagtttg

SEQ ID NO: 16229 - DNA, 20 bp, Artificial Sequence
  Artificially Synthesized Primer Sequence
ctacaaggcgaagctcatcc

SEQ ID NO: 16230 - DNA, 20 bp, Artificial Sequence
  Artificially Synthesized Primer Sequence
aggtcaacacctcacgaacc

SEQ ID NO: 16231 - DNA, 20 bp, Artificial Sequence
  Artificially Synthesized Primer Sequence
ccttgagcagacaacaccaa

SEQ ID NO: 16232 - DNA, 18 bp, Artificial Sequence
  Artificially Synthesized Primer Sequence
agcccaatgcctgatacg

SEQ ID NO: 16233 - DNA, 20 bp, Artificial Sequence
  Artificially Synthesized Primer Sequence
tcacactcctcacctacccc

SEQ ID NO: 16234 - DNA, 20 bp, Artificial Sequence
  Artificially Synthesized Primer Sequence
gtgaaatggaaatggggatg

SEQ ID NO: 16235 - DNA, 21 bp, Artificial Sequence
  Artificially Synthesized Primer Sequence
ccactctcaaaactgcaagga

SEQ ID NO: 16236 - DNA, 20 bp, Artificial Sequence
  Artificially Synthesized Primer Sequence
actgcgttgatggatgttga

SEQ ID NO: 16237 - DNA, 20 bp, Artificial Sequence
  Artificially Synthesized Primer Sequence
cagctgaccctgagaccttc

SEQ ID NO: 16238 - DNA, 20 bp, Artificial Sequence
  Artificially Synthesized Primer Sequence
ctgcacaaagaagccaaaca

SEQ ID NO: 16239 - DNA, 20 bp, Artificial Sequence
  Artificially Synthesized Primer Sequence
ctgcacaaagaagccaaaca

SEQ ID NO: 16240 - DNA, 20 bp, Artificial Sequence
  Artificially Synthesized Primer Sequence
cggatgtgtcttccctgagt

SEQ ID NO: 16241 - DNA, 20 bp, Artificial Sequence
  Artificially Synthesized Primer Sequence
gccaagtggagaaagcaaag

SEQ ID NO: 16242 - DNA, 20 bp, Artificial Sequence
  Artificially Synthesized Primer Sequence
agcgtgtgcctagcaagaat

SEQ ID NO: 16243 - DNA, 20 bp, Artificial Sequence
  Artificially Synthesized Primer Sequence
catccaatctcaaatccgct

SEQ ID NO: 16244 - DNA, 20 bp, Artificial Sequence
  Artificially Synthesized Primer Sequence
ggcaaagcaatgcaaaaatc

SEQ ID NO: 16245 - DNA, 20 bp, Artificial Sequence
  Artificially Synthesized Primer Sequence
actgggtcaagccatctcac

SEQ ID NO: 16246 - DNA, 20 bp, Artificial Sequence
  Artificially Synthesized Primer Sequence
gttctttgcgagggtctcag

SEQ ID NO: 16247 - DNA, 20 bp, Artificial Sequence
  Artificially Synthesized Primer Sequence
acatagcagaccatcctgcc

SEQ ID NO: 16248 - DNA, 20 bp, Artificial Sequence
  Artificially Synthesized Primer Sequence
cgagatcgttgacccacttt

SEQ ID NO: 16249 - DNA, 20 bp, Artificial Sequence
  Artificially Synthesized Primer Sequence
gaatggtgccaaccaagact

SEQ ID NO: 16250 - DNA, 20 bp, Artificial Sequence
  Artificially Synthesized Primer Sequence
agaatcatcatcagtccgcc

SEQ ID NO: 16251 - DNA, 20 bp, Artificial Sequence
  Artificially Synthesized Primer Sequence
gccaacatctgcttccattt

SEQ ID NO: 16252 - DNA, 20 bp, Artificial Sequence
  Artificially Synthesized Primer Sequence
gctgctgctatgaaggaacc

SEQ ID NO: 16253 - DNA, 20 bp, Artificial Sequence
  Artificially Synthesized Primer Sequence
gaggactccgacaattccaa

SEQ ID NO: 16254 - DNA, 20 bp, Artificial Sequence
  Artificially Synthesized Primer Sequence
tgcttgaggcttttgacctt

SEQ ID NO: 16255 - DNA, 20 bp, Artificial Sequence
  Artificially Synthesized Primer Sequence
gcacctaatccactcccaaa

SEQ ID NO: 16256 - DNA, 20 bp, Artificial Sequence
  Artificially Synthesized Primer Sequence
aagcgggagtttggaaagat

SEQ ID NO: 16257 - DNA, 20 bp, Artificial Sequence
  Artificially Synthesized Primer Sequence
accccatggtccatacagaa

SEQ ID NO: 16258 - DNA, 20 bp, Artificial Sequence
  Artificially Synthesized Primer Sequence
tcacggtacactttagcccc

SEQ ID NO: 16259 - DNA, 20 bp, Artificial Sequence
  Artificially Synthesized Primer Sequence
attgcacacacacgggttta

SEQ ID NO: 16260 - DNA, 20 bp, Artificial Sequence
  Artificially Synthesized Primer Sequence
cttaccgcttgaagacgagg

SEQ ID NO: 16261 - DNA, 20 bp, Artificial Sequence
  Artificially Synthesized Primer Sequence
gcacagagcttggacaatca

SEQ ID NO: 16262 - DNA, 20 bp, Artificial Sequence
  Artificially Synthesized Primer Sequence
gatgccactcacatccaatg

SEQ ID NO: 16263 - DNA, 20 bp, Artificial Sequence
  Artificially Synthesized Primer Sequence
cacaagcatcctcactctcg

SEQ ID NO: 16264 - DNA, 20 bp, Artificial Sequence
  Artificially Synthesized Primer Sequence
tgtttccatgaccaccactg

SEQ ID NO: 16265 - DNA, 20 bp, Artificial Sequence
  Artificially Synthesized Primer Sequence
gactgctaggaattcggcac

SEQ ID NO: 16266 - DNA, 20 bp, Artificial Sequence
  Artificially Synthesized Primer Sequence
gctcgtcgttggagagagtc

SEQ ID NO: 16267 - DNA, 20 bp, Artificial Sequence
  Artificially Synthesized Primer Sequence
cccgtcacatgtatcactgc

SEQ ID NO: 16268 - DNA, 20 bp, Artificial Sequence
  Artificially Synthesized Primer Sequence
cgtggacattgagagggagt

SEQ ID NO: 16269 - DNA, 20 bp, Artificial Sequence
  Artificially Synthesized Primer Sequence
tggccgtcaataactgttca

SEQ ID NO: 16270 - DNA, 20 bp, Artificial Sequence
  Artificially Synthesized Primer Sequence
gaaaaatcggaacggagtga

SEQ ID NO: 16271 - DNA, 20 bp, Artificial Sequence
  Artificially Synthesized Primer Sequence
acacacgatcggcgataaat

SEQ ID NO: 16272 - DNA, 20 bp, Artificial Sequence
  Artificially Synthesized Primer Sequence
gcaggggcaacaactacttc

SEQ ID NO: 16273 - DNA, 20 bp, Artificial Sequence
  Artificially Synthesized Primer Sequence
ggcagttgtctggactggat

SEQ ID NO: 16274 - DNA, 20 bp, Artificial Sequence
  Artificially Synthesized Primer Sequence
tcttggtcggattcatctcc

SEQ ID NO: 16275 - DNA, 20 bp, Artificial Sequence
  Artificially Synthesized Primer Sequence
agctcgtggagaacactcgt

SEQ ID NO: 16276 - DNA, 20 bp, Artificial Sequence
  Artificially Synthesized Primer Sequence
ggagatgaatccgaccaaga

SEQ ID NO: 16277 - DNA, 20 bp, Artificial Sequence
  Artificially Synthesized Primer Sequence
ggcacgagggagagagaact

SEQ ID NO: 16278 - DNA, 19 bp, Artificial Sequence
  Artificially Synthesized Primer Sequence
ggggtttttccttgggttt

SEQ ID NO: 16279 - DNA, 20 bp, Artificial Sequence
  Artificially Synthesized Primer Sequence
cctctgtacacggacccact

SEQ ID NO: 16280 - DNA, 20 bp, Artificial Sequence
  Artificially Synthesized Primer Sequence
cgacataggcaacgacacac

SEQ ID NO: 16281 - DNA, 20 bp, Artificial Sequence
  Artificially Synthesized Primer Sequence
tctttcatatccgccctcac

SEQ ID NO: 16282 - DNA, 20 bp, Artificial Sequence
  Artificially Synthesized Primer Sequence
gggtaccacagtctggagga

SEQ ID NO: 16283 - DNA, 20 bp, Artificial Sequence
  Artificially Synthesized Primer Sequence
atacgcatccccactttctg

SEQ ID NO: 16284 - DNA, 20 bp, Artificial Sequence
  Artificially Synthesized Primer Sequence
ggtgagagatggggcattac

SEQ ID NO: 16285 - DNA, 20 bp, Artificial Sequence
  Artificially Synthesized Primer Sequence
caatcacatggaaaacgacg

SEQ ID NO: 16286 - DNA, 20 bp, Artificial Sequence
  Artificially Synthesized Primer Sequence
tagatgccagtcagagcacg

SEQ ID NO: 16287 - DNA, 20 bp, Artificial Sequence
  Artificially Synthesized Primer Sequence
tgcattgcatgcctgtagtt

SEQ ID NO: 16288 - DNA, 20 bp, Artificial Sequence
  Artificially Synthesized Primer Sequence
gtagctggaccaagggtgtg

SEQ ID NO: 16289 - DNA, 20 bp, Artificial Sequence
  Artificially Synthesized Primer Sequence
gggtcagctgaaacgagtgt

SEQ ID NO: 16290 - DNA, 20 bp, Artificial Sequence
  Artificially Synthesized Primer Sequence
tcttttccccaaaacacagg

SEQ ID NO: 16291 - DNA, 20 bp, Artificial Sequence
  Artificially Synthesized Primer Sequence
gcctcattttccagagagca

SEQ ID NO: 16292 - DNA, 20 bp, Artificial Sequence
  Artificially Synthesized Primer Sequence
catactggctcgtgtcgtgt

SEQ ID NO: 16293 - DNA, 20 bp, Artificial Sequence
  Artificially Synthesized Primer Sequence
gtgggcgagtatgatgtgtg

SEQ ID NO: 16294 - DNA, 20 bp, Artificial Sequence
  Artificially Synthesized Primer Sequence
actatcgggcaatcaaccag

SEQ ID NO: 16295 - DNA, 20 bp, Artificial Sequence
  Artificially Synthesized Primer Sequence
ttccttccgtctgctcaact

SEQ ID NO: 16296 - DNA, 20 bp, Artificial Sequence
  Artificially Synthesized Primer Sequence
tgatgttcttcgtggttgga

SEQ ID NO: 16297 - DNA, 20 bp, Artificial Sequence
  Artificially Synthesized Primer Sequence
cttccgaagctggtctgaac

SEQ ID NO: 16298 - DNA, 20 bp, Artificial Sequence
  Artificially Synthesized Primer Sequence
agccttggttatacccccac

SEQ ID NO: 16299 - DNA, 20 bp, Artificial Sequence
  Artificially Synthesized Primer Sequence
acagcaagggtaggtggatg

SEQ ID NO: 16300 - DNA, 20 bp, Artificial Sequence
  Artificially Synthesized Primer Sequence
agagttaagggccggtttgt

SEQ ID NO: 16301 - DNA, 20 bp, Artificial Sequence
  Artificially Synthesized Primer Sequence
cgaggtctccctcttatccc

SEQ ID NO: 16302 - DNA, 20 bp, Artificial Sequence
  Artificially Synthesized Primer Sequence
tgaccaacaaccccttcttc

SEQ ID NO: 16303 - DNA, 20 bp, Artificial Sequence
  Artificially Synthesized Primer Sequence
aacaaaactccggattgcag

SEQ ID NO: 16304 - DNA, 20 bp, Artificial Sequence
  Artificially Synthesized Primer Sequence
aagaatggaaagcaaccagc

SEQ ID NO: 16305 - DNA, 20 bp, Artificial Sequence
  Artificially Synthesized Primer Sequence
cttatgccaccaaggcaaat

SEQ ID NO: 16306 - DNA, 20 bp, Artificial Sequence
  Artificially Synthesized Primer Sequence
taatgggccataccacaggt

SEQ ID NO: 16307 - DNA, 20 bp, Artificial Sequence
  Artificially Synthesized Primer Sequence
caaaaggagacccacaagga

SEQ ID NO: 16308 - DNA, 20 bp, Artificial Sequence
  Artificially Synthesized Primer Sequence
attcaacaaagccagggatg

SEQ ID NO: 16309 - DNA, 20 bp, Artificial Sequence
  Artificially Synthesized Primer Sequence
ggattttctcttcttggccc

SEQ ID NO: 16310 - DNA, 20 bp, Artificial Sequence
  Artificially Synthesized Primer Sequence
cctccgggaagattatccat

SEQ ID NO: 16311 - DNA, 20 bp, Artificial Sequence
  Artificially Synthesized Primer Sequence
ttcatggagaaagctagccc

SEQ ID NO: 16312 - DNA, 20 bp, Artificial Sequence
  Artificially Synthesized Primer Sequence
gtcggtgtctgggataggac

SEQ ID NO: 16313 - DNA, 20 bp, Artificial Sequence
  Artificially Synthesized Primer Sequence
ggaacaactgggaggaaaca

SEQ ID NO: 16314 - DNA, 20 bp, Artificial Sequence
  Artificially Synthesized Primer Sequence
cagtcaggtgctcacaagga

SEQ ID NO: 16315 - DNA, 20 bp, Artificial Sequence
  Artificially Synthesized Primer Sequence
taaacacctcatggtgccaa

SEQ ID NO: 16316 - DNA, 20 bp, Artificial Sequence
  Artificially Synthesized Primer Sequence
atttccgattccttgtgagc

SEQ ID NO: 16317 - DNA, 20 bp, Artificial Sequence
  Artificially Synthesized Primer Sequence
gcccaccaaacagaagtcat

SEQ ID NO: 16318 - DNA, 20 bp, Artificial Sequence
  Artificially Synthesized Primer Sequence
ccacacatgtgggtcagttc

SEQ ID NO: 16319 - DNA, 20 bp, Artificial Sequence
  Artificially Synthesized Primer Sequence
gtgttacacacgcaaatggg

SEQ ID NO: 16320 - DNA, 20 bp, Artificial Sequence
  Artificially Synthesized Primer Sequence
tgcatgatgatgtgtacgga

SEQ ID NO: 16321 - DNA, 20 bp, Artificial Sequence
  Artificially Synthesized Primer Sequence
cgtgaacagctatgaaggca

SEQ ID NO: 16322 - DNA, 20 bp, Artificial Sequence
  Artificially Synthesized Primer Sequence
aagaaatggacgcttcgaga

SEQ ID NO: 16323 - DNA, 20 bp, Artificial Sequence
  Artificially Synthesized Primer Sequence
tgcctttgctttctccagat

SEQ ID NO: 16324 - DNA, 20 bp, Artificial Sequence
  Artificially Synthesized Primer Sequence
agaaatgcttatgcatgggg

SEQ ID NO: 16325 - DNA, 20 bp, Artificial Sequence
  Artificially Synthesized Primer Sequence
cgaggagtctacggtcaagc

SEQ ID NO: 16326 - DNA, 20 bp, Artificial Sequence
  Artificially Synthesized Primer Sequence
caagtgttggagcgatagca

SEQ ID NO: 16327 - DNA, 20 bp, Artificial Sequence
  Artificially Synthesized Primer Sequence
acaccaggagcaaacaaacc

SEQ ID NO: 16328 - DNA, 20 bp, Artificial Sequence
  Artificially Synthesized Primer Sequence
tcctccgagcagaagactgt

SEQ ID NO: 16329 - DNA, 20 bp, Artificial Sequence
  Artificially Synthesized Primer Sequence
tatgcgccaccaaatcaata

SEQ ID NO: 16330 - DNA, 20 bp, Artificial Sequence
  Artificially Synthesized Primer Sequence
ttaggggagagctgagacca

SEQ ID NO: 16331 - DNA, 20 bp, Artificial Sequence
  Artificially Synthesized Primer Sequence
acctacctgattccgaaacg

SEQ ID NO: 16332 - DNA, 20 bp, Artificial Sequence
  Artificially Synthesized Primer Sequence
agtcatctggatcgcttgct

SEQ ID NO: 16333 - DNA, 20 bp, Artificial Sequence
  Artificially Synthesized Primer Sequence
cccttatcgacagtggcatt

SEQ ID NO: 16334 - DNA, 20 bp, Artificial Sequence
  Artificially Synthesized Primer Sequence
cgacgctcctcaaggtactc

SEQ ID NO: 16335 - DNA, 20 bp, Artificial Sequence
  Artificially Synthesized Primer Sequence
ccatagaccagcatccccta

SEQ ID NO: 16336 - DNA, 20 bp, Artificial Sequence
  Artificially Synthesized Primer Sequence
catgtcgagcaagaagacga

SEQ ID NO: 16337 - DNA, 20 bp, Artificial Sequence
  Artificially Synthesized Primer Sequence
acagggagaaagagatggca

SEQ ID NO: 16338 - DNA, 20 bp, Artificial Sequence
  Artificially Synthesized Primer Sequence
ccctacttaacctcccgctc

SEQ ID NO: 16339 - DNA, 20 bp, Artificial Sequence
  Artificially Synthesized Primer Sequence
ccaacccattccaaatatcg

SEQ ID NO: 16340 - DNA, 20 bp, Artificial Sequence
  Artificially Synthesized Primer Sequence
tgtagggagtgtgtccacca

SEQ ID NO: 16341 - DNA, 20 bp, Artificial Sequence
  Artificially Synthesized Primer Sequence
cgtgtttcccaagtcgaaat

SEQ ID NO: 16342 - DNA, 20 bp, Artificial Sequence
  Artificially Synthesized Primer Sequence
tttgggctaaggttttccct

SEQ ID NO: 16343 - DNA, 20 bp, Artificial Sequence
  Artificially Synthesized Primer Sequence
ggtgaaaactggcacttggt

SEQ ID NO: 16344 - DNA, 20 bp, Artificial Sequence
  Artificially Synthesized Primer Sequence
gctagttcaggcatttccca

SEQ ID NO: 16345 - DNA, 20 bp, Artificial Sequence
  Artificially Synthesized Primer Sequence
tcacaggacagagcaaccag

SEQ ID NO: 16346 - DNA, 20 bp, Artificial Sequence
  Artificially Synthesized Primer Sequence
cagcgtcatgacaagcatct

SEQ ID NO: 16347 - DNA, 20 bp, Artificial Sequence
  Artificially Synthesized Primer Sequence
cccaataagttcccatccct

SEQ ID NO: 16348 - DNA, 20 bp, Artificial Sequence
  Artificially Synthesized Primer Sequence
ttgcagttggcagtaatgga

SEQ ID NO: 16349 - DNA, 20 bp, Artificial Sequence
  Artificially Synthesized Primer Sequence
ttgctgctgttacttgcgtc

SEQ ID NO: 16350 - DNA, 20 bp, Artificial Sequence
  Artificially Synthesized Primer Sequence
aaaggcatgacaacccaaag

SEQ ID NO: 16351 - DNA, 20 bp, Artificial Sequence
  Artificially Synthesized Primer Sequence
gttcaaaattggggagctga

SEQ ID NO: 16352 - DNA, 20 bp, Artificial Sequence
  Artificially Synthesized Primer Sequence
tgcttccgatgcaagtacag

SEQ ID NO: 16353 - DNA, 20 bp, Artificial Sequence
  Artificially Synthesized Primer Sequence
cctttcctccctttttcgtt

SEQ ID NO: 16354 - DNA, 20 bp, Artificial Sequence
  Artificially Synthesized Primer Sequence
acgggggaaaagacaagagt

SEQ ID NO: 16355 - DNA, 20 bp, Artificial Sequence
  Artificially Synthesized Primer Sequence
tgtttgcagcaactcaggtc

SEQ ID NO: 16356 - DNA, 20 bp, Artificial Sequence
  Artificially Synthesized Primer Sequence
gtgctcttgatttggggaaa

SEQ ID NO: 16357 - DNA, 20 bp, Artificial Sequence
  Artificially Synthesized Primer Sequence
ctcaggaacttcttgcctgg

SEQ ID NO: 16358 - DNA, 20 bp, Artificial Sequence
  Artificially Synthesized Primer Sequence
acatcacctccgtatccagc

SEQ ID NO: 16359 - DNA, 20 bp, Artificial Sequence
  Artificially Synthesized Primer Sequence
tggtttcttctctcacgcct

SEQ ID NO: 16360 - DNA, 20 bp, Artificial Sequence
  Artificially Synthesized Primer Sequence
tcattgtgaataacgctcgg

SEQ ID NO: 16361 - DNA, 20 bp, Artificial Sequence
  Artificially Synthesized Primer Sequence
agcgctatgatcgaggaaga

SEQ ID NO: 16362 - DNA, 20 bp, Artificial Sequence
  Artificially Synthesized Primer Sequence
agcttcaggttgtggttgct

SEQ ID NO: 16363 - DNA, 20 bp, Artificial Sequence
  Artificially Synthesized Primer Sequence
accatgcttcatcgtcttcc

SEQ ID NO: 16364 - DNA, 20 bp, Artificial Sequence
  Artificially Synthesized Primer Sequence
atttcaaactcccatgtgcc

SEQ ID NO: 16365 - DNA, 20 bp, Artificial Sequence
  Artificially Synthesized Primer Sequence
gagtaccttgaggagcgtcg

SEQ ID NO: 16366 - DNA, 20 bp, Artificial Sequence
  Artificially Synthesized Primer Sequence
ggccttgaactcaagctgac

SEQ ID NO: 16367 - DNA, 20 bp, Artificial Sequence
  Artificially Synthesized Primer Sequence
ccatagaccagcatccccta

SEQ ID NO: 16368 - DNA, 20 bp, Artificial Sequence
  Artificially Synthesized Primer Sequence
catgtcgagcaagaagacga

SEQ ID NO: 16369 - DNA, 20 bp, Artificial Sequence
  Artificially Synthesized Primer Sequence
tgacagaggtgaagcgattg

SEQ ID NO: 16370 - DNA, 20 bp, Artificial Sequence
  Artificially Synthesized Primer Sequence
cttattcccctccatcagca

SEQ ID NO: 16371 - DNA, 20 bp, Artificial Sequence
  Artificially Synthesized Primer Sequence
aaatccgtttcaacacgctc

SEQ ID NO: 16372 - DNA, 20 bp, Artificial Sequence
  Artificially Synthesized Primer Sequence
gcttcggttgcttagacagc

SEQ ID NO: 16373 - DNA, 20 bp, Artificial Sequence
  Artificially Synthesized Primer Sequence
atgcaaatagtgggacctcg

SEQ ID NO: 16374 - DNA, 20 bp, Artificial Sequence
  Artificially Synthesized Primer Sequence
cggaagtgggggtacataga

SEQ ID NO: 16375 - DNA, 20 bp, Artificial Sequence
  Artificially Synthesized Primer Sequence
tggagctttgctgggaatac

SEQ ID NO: 16376 - DNA, 20 bp, Artificial Sequence
  Artificially Synthesized Primer Sequence
gtggagctggcaaggttaaa

SEQ ID NO: 16377 - DNA, 20 bp, Artificial Sequence
  Artificially Synthesized Primer Sequence
cactgttggcctactgggtt

SEQ ID NO: 16378 - DNA, 20 bp, Artificial Sequence
  Artificially Synthesized Primer Sequence
cgacttcgaccttcttctgc

SEQ ID NO: 16379 - DNA, 21 bp, Artificial Sequence
  Artificially Synthesized Primer Sequence
cagctataccccaacaaacca

SEQ ID NO: 16380 - DNA, 20 bp, Artificial Sequence
  Artificially Synthesized Primer Sequence
cgtcgagtactacgtgtccg

SEQ ID NO: 16381 - DNA, 20 bp, Artificial Sequence
  Artificially Synthesized Primer Sequence
cattgatgctgatgaccctg

SEQ ID NO: 16382 - DNA, 20 bp, Artificial Sequence
  Artificially Synthesized Primer Sequence
atctagatcgtcgtcggtgg

SEQ ID NO: 16383 - DNA, 20 bp, Artificial Sequence
  Artificially Synthesized Primer Sequence
ttcacaagctcactggatcg

SEQ ID NO: 16384 - DNA, 20 bp, Artificial Sequence
  Artificially Synthesized Primer Sequence
aatcctgtgcaacttcaccc

SEQ ID NO: 16385 - DNA, 20 bp, Artificial Sequence
  Artificially Synthesized Primer Sequence
gctcacttcctttgtcctcg

SEQ ID NO: 16386 - DNA, 20 bp, Artificial Sequence
  Artificially Synthesized Primer Sequence
aggagtgttatccccatccc

SEQ ID NO: 16387 - DNA, 20 bp, Artificial Sequence
  Artificially Synthesized Primer Sequence
cagaacgaggactaccgctc

SEQ ID NO: 16388 - DNA, 20 bp, Artificial Sequence
  Artificially Synthesized Primer Sequence
ccagtaggtgcccatcttgt

SEQ ID NO: 16389 - DNA, 20 bp, Artificial Sequence
  Artificially Synthesized Primer Sequence
cagccccattttacaggaga

SEQ ID NO: 16390 - DNA, 20 bp, Artificial Sequence
  Artificially Synthesized Primer Sequence
gttcaaagcactcagccctc

SEQ ID NO: 16391 - DNA, 20 bp, Artificial Sequence
  Artificially Synthesized Primer Sequence
aaccttggtgttccatcagc

SEQ ID NO: 16392 - DNA, 20 bp, Artificial Sequence
  Artificially Synthesized Primer Sequence
tggtgaaattcaaaggaggg

SEQ ID NO: 16393 - DNA, 20 bp, Artificial Sequence
  Artificially Synthesized Primer Sequence
tctctggaatttccccctct

SEQ ID NO: 16394 - DNA, 20 bp, Artificial Sequence
  Artificially Synthesized Primer Sequence
gcagcaagatcccttctttg

SEQ ID NO: 16395 - DNA, 20 bp, Artificial Sequence
  Artificially Synthesized Primer Sequence
atgcgcacagaagaaacctt

SEQ ID NO: 16396 - DNA, 20 bp, Artificial Sequence
  Artificially Synthesized Primer Sequence
aaacatgcaacgatgagcag

SEQ ID NO: 16397 - DNA, 10 bp, Artificial Sequence
  Artificially Synthesized Primer Sequence
  MISC_FEATURE (1)..(10): n stands for any base
nnnnnnnnnn

SEQ ID NO: 16398 - DNA, 10 bp, Artificial Sequence
  Artificially Synthesized Primer Sequence
  MISC_FEATURE (1)..(10): n stands for any base
nnnnnnnnnn

SEQ ID NO: 16399 - DNA, 20 bp, Artificial Sequence
  Artificially Synthesized Primer Sequence
gaaaaaggcttgaaggaccc

SEQ ID NO: 16400 - DNA, 20 bp, Artificial Sequence
  Artificially Synthesized Primer Sequence
cagactccccggattgttta

SEQ ID NO: 16401 - DNA, 20 bp, Artificial Sequence
  Artificially Synthesized Primer Sequence
gctaagggaagtcagcatcg

SEQ ID NO: 16402 - DNA, 20 bp, Artificial Sequence
  Artificially Synthesized Primer Sequence
acacctccacgcttttgaac

SEQ ID NO: 16403 - DNA, 20 bp, Artificial Sequence
  Artificially Synthesized Primer Sequence
caagcagtcgcatctctcaa

SEQ ID NO: 16404 - DNA, 20 bp, Artificial Sequence
  Artificially Synthesized Primer Sequence
gcagatcttcagctgcatca

SEQ ID NO: 16405 - DNA, 20 bp, Artificial Sequence
  Artificially Synthesized Primer Sequence
ggcgcctagaggtgtatgag

SEQ ID NO: 16406 - DNA, 20 bp, Artificial Sequence
  Artificially Synthesized Primer Sequence
aaacagggtagagcggaggt

SEQ ID NO: 16407 - DNA, 20 bp, Artificial Sequence
  Artificially Synthesized Primer Sequence
tactcctcgcataaggtggg

SEQ ID NO: 16408 - DNA, 20 bp, Artificial Sequence
  Artificially Synthesized Primer Sequence
catctgcagaacctcctggt

SEQ ID NO: 16409 - DNA, 20 bp, Artificial Sequence
  Artificially Synthesized Primer Sequence
cctgtggtaggccaacatct

SEQ ID NO: 16410 - DNA, 20 bp, Artificial Sequence
  Artificially Synthesized Primer Sequence
tatcccgggtaaccaacaaa

SEQ ID NO: 16411 - DNA, 20 bp, Artificial Sequence
  Artificially Synthesized Primer Sequence
gagactatgcgcaaccaatg

SEQ ID NO: 16412 - DNA, 20 bp, Artificial Sequence
  Artificially Synthesized Primer Sequence
tgacgagaagcagaagctga

SEQ ID NO: 16413 - DNA, 20 bp, Artificial Sequence
  Artificially Synthesized Primer Sequence
ccaactggcatgagtaccct

SEQ ID NO: 16414 - DNA, 20 bp, Artificial Sequence
  Artificially Synthesized Primer Sequence
ttgaagcagaagcagaagca

SEQ ID NO: 16415 - DNA, 20 bp, Artificial Sequence
  Artificially Synthesized Primer Sequence
ttgaagcagaagcagaagca

SEQ ID NO: 16416 - DNA, 20 bp, Artificial Sequence
  Artificially Synthesized Primer Sequence
ccaactggcatgagtaccct

SEQ ID NO: 16417 - DNA, 20 bp, Artificial Sequence
  Artificially Synthesized Primer Sequence
gcattgtgtttgacccacag

SEQ ID NO: 16418 - DNA, 20 bp, Artificial Sequence
  Artificially Synthesized Primer Sequence
aagatgccaagtacccgatg

SEQ ID NO: 16419 - DNA, 20 bp, Artificial Sequence
  Artificially Synthesized Primer Sequence
ctgaacccaaacccagatgt

SEQ ID NO: 16420 - DNA, 20 bp, Artificial Sequence
  Artificially Synthesized Primer Sequence
cagagaaggaggctcaccag

SEQ ID NO: 16421 - DNA, 20 bp, Artificial Sequence
  Artificially Synthesized Primer Sequence
cagttcagctcagggtctcc

SEQ ID NO: 16422 - DNA, 20 bp, Artificial Sequence
  Artificially Synthesized Primer Sequence
caagctttttcacagccaca

SEQ ID NO: 16423 - DNA, 20 bp, Artificial Sequence
  Artificially Synthesized Primer Sequence
accacaagaaatacgggcaa

SEQ ID NO: 16424 - DNA, 20 bp, Artificial Sequence
  Artificially Synthesized Primer Sequence
tagatcacacgatgccaagg

SEQ ID NO: 16425 - DNA, 20 bp, Artificial Sequence
  Artificially Synthesized Primer Sequence
tacgtcgccttaatcagggt

SEQ ID NO: 16426 - DNA, 20 bp, Artificial Sequence
  Artificially Synthesized Primer Sequence
ggttgaattgggtggaaaaa

SEQ ID NO: 16427 - DNA, 20 bp, Artificial Sequence
  Artificially Synthesized Primer Sequence
accgctttctccaccttttt

SEQ ID NO: 16428 - DNA, 20 bp, Artificial Sequence
  Artificially Synthesized Primer Sequence
atttcgtggtggcactaagg

SEQ ID NO: 16429 - DNA, 20 bp, Artificial Sequence
  Artificially Synthesized Primer Sequence
tcttcccgcaattattcgtc

SEQ ID NO: 16430 - DNA, 20 bp, Artificial Sequence
  Artificially Synthesized Primer Sequence
gaaaaggaatggaaggggag

SEQ ID NO: 16431 - DNA, 20 bp, Artificial Sequence
  Artificially Synthesized Primer Sequence
cgtaacaagggcacatcaaa

SEQ ID NO: 16432 - DNA, 22 bp, Artificial Sequence
  Artificially Synthesized Primer Sequence
tgttggtaggacaatgagaacg

SEQ ID NO: 16433 - DNA, 20 bp, Artificial Sequence
  Artificially Synthesized Primer Sequence
gccttacccttccaaaggag

SEQ ID NO: 16434 - DNA, 20 bp, Artificial Sequence
  Artificially Synthesized Primer Sequence
aagacgtgtcaaacccaagg

SEQ ID NO: 16435 - DNA, 20 bp, Artificial Sequence
  Artificially Synthesized Primer Sequence
aatttagcgcggtcttgatg

SEQ ID NO: 16436 - DNA, 20 bp, Artificial Sequence
  Artificially Synthesized Primer Sequence
gtaaagtggatggggaagcc

SEQ ID NO: 16437 - DNA, 20 bp, Artificial Sequence
  Artificially Synthesized Primer Sequence
ttgctgctgctagagaacga

SEQ ID NO: 16438 - DNA, 20 bp, Artificial Sequence
  Artificially Synthesized Primer Sequence
atggaacacaccaaggggta

SEQ ID NO: 16439 - DNA, 20 bp, Artificial Sequence
  Artificially Synthesized Primer Sequence
atggaacacaccaaggggta

SEQ ID NO: 16440 - DNA, 20 bp, Artificial Sequence
  Artificially Synthesized Primer Sequence
ttgctgctgctagagaacga

SEQ ID NO: 16441 - DNA, 20 bp, Artificial Sequence
  Artificially Synthesized Primer Sequence
accaccaaggaagaatcacg

SEQ ID NO: 16442 - DNA, 20 bp, Artificial Sequence
  Artificially Synthesized Primer Sequence
atatggtaaaacccgcacca

SEQ ID NO: 16443 - DNA, 20 bp, Artificial Sequence
  Artificially Synthesized Primer Sequence
ttcggaaagactatccctgg

SEQ ID NO: 16444 - DNA, 20 bp, Artificial Sequence
  Artificially Synthesized Primer Sequence
cagcagacccagtcttcctc

SEQ ID NO: 16445 - DNA, 20 bp, Artificial Sequence
  Artificially Synthesized Primer Sequence
ttcaggcgaagatgacagtg

SEQ ID NO: 16446 - DNA, 20 bp, Artificial Sequence
  Artificially Synthesized Primer Sequence
aagaactgcaagccaaagga

SEQ ID NO: 16447 - DNA, 20 bp, Artificial Sequence
  Artificially Synthesized Primer Sequence
agaactgcagccaaaggaga

SEQ ID NO: 16448 - DNA, 20 bp, Artificial Sequence
  Artificially Synthesized Primer Sequence
ttcaggcgaagatgacagtg

SEQ ID NO: 16449 - DNA, 20 bp, Artificial Sequence
  Artificially Synthesized Primer Sequence
attattcccctcacgaaccc

SEQ ID NO: 16450 - DNA, 20 bp, Artificial Sequence
  Artificially Synthesized Primer Sequence
gtgagaactgaggggtgctc

SEQ ID NO: 16451 - DNA, 20 bp, Artificial Sequence
  Artificially Synthesized Primer Sequence
acggtttccatcaacattcc

SEQ ID NO: 16452 - DNA, 21 bp, Artificial Sequence
  Artificially Synthesized Primer Sequence
tgatgctgcagactttgtttg

SEQ ID NO: 16453 - DNA, 20 bp, Artificial Sequence
  Artificially Synthesized Primer Sequence
ctacgcagttccggtacaca

SEQ ID NO: 16454 - DNA, 20 bp, Artificial Sequence
  Artificially Synthesized Primer Sequence
gggcaggttctgaagatgaa

SEQ ID NO: 16455 - DNA, 20 bp, Artificial Sequence
  Artificially Synthesized Primer Sequence
gctgcacaaagcataggaca

SEQ ID NO: 16456 - DNA, 20 bp, Artificial Sequence
  Artificially Synthesized Primer Sequence
aaggcacatgacgagaggag

SEQ ID NO: 16457 - DNA, 20 bp, Artificial Sequence
  Artificially Synthesized Primer Sequence
ggccacacattcaacttcct

SEQ ID NO: 16458 - DNA, 20 bp, Artificial Sequence
  Artificially Synthesized Primer Sequence
tgtaaggtttcggtcttgcc

SEQ ID NO: 16459 - DNA, 20 bp, Artificial Sequence
  Artificially Synthesized Primer Sequence
caaaacaaggtccaggcaat

SEQ ID NO: 16460 - DNA, 20 bp, Artificial Sequence
  Artificially Synthesized Primer Sequence
ggcaagaccgaaaccttaca

SEQ ID NO: 16461 - DNA, 20 bp, Artificial Sequence
  Artificially Synthesized Primer Sequence
cgccatggtaggacaacttt

SEQ ID NO: 16462 - DNA, 20 bp, Artificial Sequence
  Artificially Synthesized Primer Sequence
tgaaatatcacggaccacca

SEQ ID NO: 16463 - DNA, 20 bp, Artificial Sequence
  Artificially Synthesized Primer Sequence
atagggaaccattgctccag

SEQ ID NO: 16464 - DNA, 21 bp, Artificial Sequence
  Artificially Synthesized Primer Sequence
caacctttccaagatgtgctc

SEQ ID NO: 16465 - DNA, 20 bp, Artificial Sequence
  Artificially Synthesized Primer Sequence
cggtctcatctcagtcccat

SEQ ID NO: 16466 - DNA, 20 bp, Artificial Sequence
  Artificially Synthesized Primer Sequence
aacgaaaaattcaccgcatc

SEQ ID NO: 16467 - DNA, 20 bp, Artificial Sequence
  Artificially Synthesized Primer Sequence
tctgtccacagccaaagatg

SEQ ID NO: 16468 - DNA, 20 bp, Artificial Sequence
  Artificially Synthesized Primer Sequence
actttcaatggctaatgcgg

SEQ ID NO: 16469 - DNA, 20 bp, Artificial Sequence
  Artificially Synthesized Primer Sequence
acaccttcccctgtttcctt

SEQ ID NO: 16470 - DNA, 20 bp, Artificial Sequence
  Artificially Synthesized Primer Sequence
gtgctccgatgaggtaggag

SEQ ID NO: 16471 - DNA, 20 bp, Artificial Sequence
  Artificially Synthesized Primer Sequence
ttgaagttcagatcgagggg

SEQ ID NO: 16472 - DNA, 20 bp, Artificial Sequence
  Artificially Synthesized Primer Sequence
ctggttctctgttgttcgca

SEQ ID NO: 16473 - DNA, 20 bp, Artificial Sequence
  Artificially Synthesized Primer Sequence
cgtgacaaacttgaggcaga

SEQ ID NO: 16474 - DNA, 20 bp, Artificial Sequence
  Artificially Synthesized Primer Sequence
ctaaagcgcttcgtaggtgg

SEQ ID NO: 16475 - DNA, 20 bp, Artificial Sequence
  Artificially Synthesized Primer Sequence
atcccgataaacaccaacca

SEQ ID NO: 16476 - DNA, 20 bp, Artificial Sequence
  Artificially Synthesized Primer Sequence
cacatccacttggaggaaca

SEQ ID NO: 16477 - DNA, 20 bp, Artificial Sequence
  Artificially Synthesized Primer Sequence
tggcctactggttccaattc

SEQ ID NO: 16478 - DNA, 20 bp, Artificial Sequence
  Artificially Synthesized Primer Sequence
tggaagacattcatgaccca

SEQ ID NO: 16479 - DNA, 20 bp, Artificial Sequence
  Artificially Synthesized Primer Sequence
tttttgaagcaaagccaacc

SEQ ID NO: 16480 - DNA, 20 bp, Artificial Sequence
  Artificially Synthesized Primer Sequence
gaggaagatccaggaaagca

SEQ ID NO: 16481 - DNA, 20 bp, Artificial Sequence
  Artificially Synthesized Primer Sequence
agagtgggggcgttttagtt

SEQ ID NO: 16482 - DNA, 20 bp, Artificial Sequence
  Artificially Synthesized Primer Sequence
ctcaatggcggtttcatttt

SEQ ID NO: 16483 - DNA, 20 bp, Artificial Sequence
  Artificially Synthesized Primer Sequence
ccttcttctaggggtcggtc

SEQ ID NO: 16484 - DNA, 20 bp, Artificial Sequence
  Artificially Synthesized Primer Sequence
ggagacgaggagctgtatgc

SEQ ID NO: 16485 - DNA, 20 bp, Artificial Sequence
  Artificially Synthesized Primer Sequence
taccctttgaccaccgagtc

SEQ ID NO: 16486 - DNA, 20 bp, Artificial Sequence
  Artificially Synthesized Primer Sequence
gcagcgatatggtaggcaat

SEQ ID NO: 16487 - DNA, 20 bp, Artificial Sequence
  Artificially Synthesized Primer Sequence
gccacgtcaagagcatcata

SEQ ID NO: 16488 - DNA, 20 bp, Artificial Sequence
  Artificially Synthesized Primer Sequence
caaggctgtgaagtctgggt

SEQ ID NO: 16489 - DNA, 20 bp, Artificial Sequence
  Artificially Synthesized Primer Sequence
gaattcggcacgaggataaa

SEQ ID NO: 16490 - DNA, 20 bp, Artificial Sequence
  Artificially Synthesized Primer Sequence
acggtcttccaccgtatctg

SEQ ID NO: 16491 - DNA, 20 bp, Artificial Sequence
  Artificially Synthesized Primer Sequence
ctcctacaggggtatggcag

SEQ ID NO: 16492 - DNA, 20 bp, Artificial Sequence
  Artificially Synthesized Primer Sequence
acacaggattgggcagactc

SEQ ID NO: 16493 - DNA, 20 bp, Artificial Sequence
  Artificially Synthesized Primer Sequence
cgcttattccagaaacctgc

SEQ ID NO: 16494 - DNA, 20 bp, Artificial Sequence
  Artificially Synthesized Primer Sequence
ataaggagggagagggcaaa

SEQ ID NO: 16495 - DNA, 20 bp, Artificial Sequence
  Artificially Synthesized Primer Sequence
gcaggtttctggaataagcg

SEQ ID NO: 16496 - DNA, 20 bp, Artificial Sequence
  Artificially Synthesized Primer Sequence
aagaagaagcgcatgaggag

SEQ ID NO: 16497 - DNA, 20 bp, Artificial Sequence
  Artificially Synthesized Primer Sequence
ctctcaaaaccctcgtctcg

SEQ ID NO: 16498 - DNA, 20 bp, Artificial Sequence
  Artificially Synthesized Primer Sequence
aacccatttgtcccaatcaa

SEQ ID NO: 16499 - DNA, 20 bp, Artificial Sequence
  Artificially Synthesized Primer Sequence
tatgccaacagacggtacga

SEQ ID NO: 16500 - DNA, 20 bp, Artificial Sequence
  Artificially Synthesized Primer Sequence
tatgcctggaatggaaggtt

SEQ ID NO: 16501 - DNA, 20 bp, Artificial Sequence
  Artificially Synthesized Primer Sequence
aacgaggagctgttcaagga

SEQ ID NO: 16502 - DNA, 20 bp, Artificial Sequence
  Artificially Synthesized Primer Sequence
aaccacaggttgaaacggag

SEQ ID NO: 16503 - DNA, 20 bp, Artificial Sequence
  Artificially Synthesized Primer Sequence
ggcaccaggtgaggagatta

SEQ ID NO: 16504 - DNA, 20 bp, Artificial Sequence
  Artificially Synthesized Primer Sequence
tgcactttctgcctatgtgc

SEQ ID NO: 16505 - DNA, 20 bp, Artificial Sequence
  Artificially Synthesized Primer Sequence
ccttttctctttacgcgtgc

SEQ ID NO: 16506 - DNA, 20 bp, Artificial Sequence
  Artificially Synthesized Primer Sequence
tggcacggactgtttcataa

SEQ ID NO: 16507 - DNA, 20 bp, Artificial Sequence
  Artificially Synthesized Primer Sequence
aacgatggtgagcaacagtg

SEQ ID NO: 16508 - DNA, 20 bp, Artificial Sequence
  Artificially Synthesized Primer Sequence
aaatggttgacctagcacgc

SEQ ID NO: 16509 - DNA, 20 bp, Artificial Sequence
  Artificially Synthesized Primer Sequence
gtgtctttaggatggggcaa

SEQ ID NO: 16510 - DNA, 20 bp, Artificial Sequence
  Artificially Synthesized Primer Sequence
ttcaacctagccccatgaac

SEQ ID NO: 16511 - DNA, 20 bp, Artificial Sequence
  Artificially Synthesized Primer Sequence
atttcagcccgtatgactcg

SEQ ID NO: 16512 - DNA, 20 bp, Artificial Sequence
  Artificially Synthesized Primer Sequence
tatggttgcttcgtgatgga

SEQ ID NO: 16513 - DNA, 20 bp, Artificial Sequence
  Artificially Synthesized Primer Sequence
ctcttttcaaggccaacgag

SEQ ID NO: 16514 - DNA, 20 bp, Artificial Sequence
  Artificially Synthesized Primer Sequence
tggtgaagaacttgactgcg

SEQ ID NO: 16515 - DNA, 20 bp, Artificial Sequence
  Artificially Synthesized Primer Sequence
ggatgcggctacaatgaaat

SEQ ID NO: 16516 - DNA, 20 bp, Artificial Sequence
  Artificially Synthesized Primer Sequence
cgcagtcaagttcttcacca

SEQ ID NO: 16517 - DNA, 20 bp, Artificial Sequence
  Artificially Synthesized Primer Sequence
agcagcagatcaaggggtta

SEQ ID NO: 16518 - DNA, 20 bp, Artificial Sequence
  Artificially Synthesized Primer Sequence
gtttcatgtacacgcatggc

SEQ ID NO: 16519 - DNA, 20 bp, Artificial Sequence
  Artificially Synthesized Primer Sequence
gtttcatgtacacgcatggc

SEQ ID NO: 16520 - DNA, 20 bp, Artificial Sequence
  Artificially Synthesized Primer Sequence
agcagcagatcaaggggtta

SEQ ID NO: 16521 - DNA, 20 bp, Artificial Sequence
  Artificially Synthesized Primer Sequence
tgggtggactgaagatgaca

SEQ ID NO: 16522 - DNA, 20 bp, Artificial Sequence
  Artificially Synthesized Primer Sequence
ctttgaccccatccagaaaa

SEQ ID NO: 16523 - DNA, 20 bp, Artificial Sequence
  Artificially Synthesized Primer Sequence
caacccaaatctaaagggca

SEQ ID NO: 16524 - DNA, 20 bp, Artificial Sequence
  Artificially Synthesized Primer Sequence
tgggtggactgaagatgaca

SEQ ID NO: 16525 - DNA, 20 bp, Artificial Sequence
  Artificially Synthesized Primer Sequence
tccaacagacgagtgcaaac

SEQ ID NO: 16526 - DNA, 20 bp, Artificial Sequence
  Artificially Synthesized Primer Sequence
gcgatcaattcatcatccct

SEQ ID NO: 16527 - DNA, 20 bp, Artificial Sequence
  Artificially Synthesized Primer Sequence
agctgcatacagtggggttt

SEQ ID NO: 16528 - DNA, 20 bp, Artificial Sequence
  Artificially Synthesized Primer Sequence
ttgacatcaggaaatgcagg

SEQ ID NO: 16529 - DNA, 20 bp, Artificial Sequence
  Artificially Synthesized Primer Sequence
catcgtgctatttgcttcca

SEQ ID NO: 16530 - DNA, 20 bp, Artificial Sequence
  Artificially Synthesized Primer Sequence
tagagaatggcgaactggct

SEQ ID NO: 16531 - DNA, 20 bp, Artificial Sequence
  Artificially Synthesized Primer Sequence
tgcacagccaagatcacttc

SEQ ID NO: 16532 - DNA, 20 bp, Artificial Sequence
  Artificially Synthesized Primer Sequence
attgtgatcccagcgaaaac

SEQ ID NO: 16533 - DNA, 20 bp, Artificial Sequence
  Artificially Synthesized Primer Sequence
ctcaagtcgggtgaccaagt

SEQ ID NO: 16534 - DNA, 20 bp, Artificial Sequence
  Artificially Synthesized Primer Sequence
gctgttcttcaaagggcttg

SEQ ID NO: 16535 - DNA, 20 bp, Artificial Sequence
  Artificially Synthesized Primer Sequence
aatcggttgagcttgtcgat

SEQ ID NO: 16536 - DNA, 20 bp, Artificial Sequence
  Artificially Synthesized Primer Sequence
aggggtggtggtgatattga

SEQ ID NO: 16537 - DNA, 20 bp, Artificial Sequence
  Artificially Synthesized Primer Sequence
ttgggtttgctggtaactcc

SEQ ID NO: 16538 - DNA, 20 bp, Artificial Sequence
  Artificially Synthesized Primer Sequence
aaatccagcagaaaggctga

SEQ ID NO: 16539 - DNA, 20 bp, Artificial Sequence
  Artificially Synthesized Primer Sequence
acaaacatgcacctggaaca

SEQ ID NO: 16540 - DNA, 21 bp, Artificial Sequence
  Artificially Synthesized Primer Sequence
ggtcaatgtagtcacccatcc

SEQ ID NO: 16541 - DNA, 20 bp, Artificial Sequence
  Artificially Synthesized Primer Sequence
atcaggaagagcgtcagcat

SEQ ID NO: 16542 - DNA, 20 bp, Artificial Sequence
  Artificially Synthesized Primer Sequence
ggagcagtaacaggccgtag

SEQ ID NO: 16543 - DNA, 20 bp, Artificial Sequence
  Artificially Synthesized Primer Sequence
aagaaggtcgagccacagaa

SEQ ID NO: 16544 - DNA, 20 bp, Artificial Sequence
  Artificially Synthesized Primer Sequence
atgaatcggttggttcaagc

SEQ ID NO: 16545 - DNA, 20 bp, Artificial Sequence
  Artificially Synthesized Primer Sequence
ccgataggccagaatttcaa

SEQ ID NO: 16546 - DNA, 20 bp, Artificial Sequence
  Artificially Synthesized Primer Sequence
actgtaagggaacaaggggg

SEQ ID NO: 16547 - DNA, 20 bp, Artificial Sequence
  Artificially Synthesized Primer Sequence
cggatgatgtacccttgcat

SEQ ID NO: 16548 - DNA, 20 bp, Artificial Sequence
  Artificially Synthesized Primer Sequence
gcttcttcaccgacgagttc

SEQ ID NO: 16549 - DNA, 20 bp, Artificial Sequence
  Artificially Synthesized Primer Sequence
ttggacaagatagggcaagg

SEQ ID NO: 16550 - DNA, 20 bp, Artificial Sequence
  Artificially Synthesized Primer Sequence
agggcaccattatgtcaagc

SEQ ID NO: 16551 - DNA, 20 bp, Artificial Sequence
  Artificially Synthesized Primer Sequence
atcctcaaaagagggtgggt

SEQ ID NO: 16552 - DNA, 20 bp, Artificial Sequence
  Artificially Synthesized Primer Sequence
ctcgtctggacaagggaaag

SEQ ID NO: 16553 - DNA, 20 bp, Artificial Sequence
  Artificially Synthesized Primer Sequence
ccactccgttaaggcacatt

SEQ ID NO: 16554 - DNA, 20 bp, Artificial Sequence
  Artificially Synthesized Primer Sequence
ggagtatcagcctttgcagc

SEQ ID NO: 16555 - DNA, 20 bp, Artificial Sequence
  Artificially Synthesized Primer Sequence
tgtaagcccaaccatgttca

SEQ ID NO: 16556 - DNA, 20 bp, Artificial Sequence
  Artificially Synthesized Primer Sequence
gctgcaaaggctgatactcc

SEQ ID NO: 16557 - DNA, 20 bp, Artificial Sequence
  Artificially Synthesized Primer Sequence
cctcccgtacaagcaaaaac

SEQ ID NO: 16558 - DNA, 20 bp, Artificial Sequence
  Artificially Synthesized Primer Sequence
cggttcggttggttttagtg

SEQ ID NO: 16559 - DNA, 20 bp, Artificial Sequence
  Artificially Synthesized Primer Sequence
acaaatggcaaacacagcaa

SEQ ID NO: 16560 - DNA, 20 bp, Artificial Sequence
  Artificially Synthesized Primer Sequence
actgggatgggctctttctt

SEQ ID NO: 16561 - DNA, 20 bp, Artificial Sequence
  Artificially Synthesized Primer Sequence
ttgatgagaggctgctcctt

SEQ ID NO: 16562 - DNA, 20 bp, Artificial Sequence
  Artificially Synthesized Primer Sequence
gcactcacagatccagcaaa

SEQ ID NO: 16563 - DNA, 20 bp, Artificial Sequence
  Artificially Synthesized Primer Sequence
tctcaggttttcgagttggc

SEQ ID NO: 16564 - DNA, 20 bp, Artificial Sequence
  Artificially Synthesized Primer Sequence
tgattccttggttagctggc

SEQ ID NO: 16565 - DNA, 20 bp, Artificial Sequence
  Artificially Synthesized Primer Sequence
gcgactggtggatttcattt

SEQ ID NO: 16566 - DNA, 20 bp, Artificial Sequence
  Artificially Synthesized Primer Sequence
ttgtcaggaccacggtaaca

SEQ ID NO: 16567 - DNA, 20 bp, Artificial Sequence
  Artificially Synthesized Primer Sequence
ccaatcaatcaacattcccc

SEQ ID NO: 16568 - DNA, 20 bp, Artificial Sequence
  Artificially Synthesized Primer Sequence
gcaagcaatggtgcaagata

SEQ ID NO: 16569 - DNA, 20 bp, Artificial Sequence
  Artificially Synthesized Primer Sequence
gtcttctcctgcctcacctg

SEQ ID NO: 16570 - DNA, 20 bp, Artificial Sequence
  Artificially Synthesized Primer Sequence
tttcaacttgctccttggct

SEQ ID NO: 16571 - DNA, 20 bp, Artificial Sequence
  Artificially Synthesized Primer Sequence
gacggtggccagataacagt

SEQ ID NO: 16572 - DNA, 20 bp, Artificial Sequence
  Artificially Synthesized Primer Sequence
aacagcaggaaggagctgaa

SEQ ID NO: 16573 - DNA, 20 bp, Artificial Sequence
  Artificially Synthesized Primer Sequence
gcaggactgttctcctcgtc

SEQ ID NO: 16574 - DNA, 20 bp, Artificial Sequence
  Artificially Synthesized Primer Sequence
tgttatggtggtggtgatgg

SEQ ID NO: 16575 - DNA, 20 bp, Artificial Sequence
  Artificially Synthesized Primer Sequence
gcgaccacacccgatattta

SEQ ID NO: 16576 - DNA, 20 bp, Artificial Sequence
  Artificially Synthesized Primer Sequence
aaggacgaggcacgaagtta

SEQ ID NO: 16577 - DNA, 20 bp, Artificial Sequence
  Artificially Synthesized Primer Sequence
cagagcagcctatcgaggtc

SEQ ID NO: 16578 - DNA, 20 bp, Artificial Sequence
  Artificially Synthesized Primer Sequence
ggaacggagggagtacatca

SEQ ID NO: 16579 - DNA, 20 bp, Artificial Sequence
  Artificially Synthesized Primer Sequence
ggaacggagggagtacatca

SEQ ID NO: 16580 - DNA, 20 bp, Artificial Sequence
  Artificially Synthesized Primer Sequence
cagagcagcctatcgaggtc

SEQ ID NO: 16581 - DNA, 20 bp, Artificial Sequence
  Artificially Synthesized Primer Sequence
cgtgtgccataacatccttg

SEQ ID NO: 16582 - DNA, 20 bp, Artificial Sequence
  Artificially Synthesized Primer Sequence
aggacagaggcacttctcca

SEQ ID NO: 16583 - DNA, 20 bp, Artificial Sequence
  Artificially Synthesized Primer Sequence
aggacagaggcacttctcca

SEQ ID NO: 16584 - DNA, 20 bp, Artificial Sequence
  Artificially Synthesized Primer Sequence
cgtgtgccataacatccttg

SEQ ID NO: 16585 - DNA, 20 bp, Artificial Sequence
  Artificially Synthesized Primer Sequence
gtgatgaaaaggctggagga

SEQ ID NO: 16586 - DNA, 20 bp, Artificial Sequence
  Artificially Synthesized Primer Sequence
catggtatggtggctgagtg

SEQ ID NO: 16587 - DNA, 20 bp, Artificial Sequence
  Artificially Synthesized Primer Sequence
aacgtagcaacgaccaaacc

SEQ ID NO: 16588 - DNA, 20 bp, Artificial Sequence
  Artificially Synthesized Primer Sequence
ctccgtgaagaacttccagc

SEQ ID NO: 16589 - DNA, 20 bp, Artificial Sequence
  Artificially Synthesized Primer Sequence
gatggatccgtacatcaccc

SEQ ID NO: 16590 - DNA, 20 bp, Artificial Sequence
  Artificially Synthesized Primer Sequence
cgtcggatagacatctcggt

SEQ ID NO: 16591 - DNA, 20 bp, Artificial Sequence
  Artificially Synthesized Primer Sequence
agcccacactgtacccaaag

SEQ ID NO: 16592 - DNA, 20 bp, Artificial Sequence
  Artificially Synthesized Primer Sequence
gacagaggagataccagcgg

SEQ ID NO: 16593 - DNA, 20 bp, Artificial Sequence
  Artificially Synthesized Primer Sequence
aattcctcgagcactgttgg

SEQ ID NO: 16594 - DNA, 20 bp, Artificial Sequence
  Artificially Synthesized Primer Sequence
tcaagcccctgataccattc

SEQ ID NO: 16595 - DNA, 20 bp, Artificial Sequence
  Artificially Synthesized Primer Sequence
tatgaactggccatgtggaa

SEQ ID NO: 16596 - DNA, 20 bp, Artificial Sequence
  Artificially Synthesized Primer Sequence
ctgcgcttcagttaggtgtg

SEQ ID NO: 16597 - DNA, 20 bp, Artificial Sequence
  Artificially Synthesized Primer Sequence
tggttttgtggttctgtgga

SEQ ID NO: 16598 - DNA, 20 bp, Artificial Sequence
  Artificially Synthesized Primer Sequence
ctaaacctcgccaagcactc

SEQ ID NO: 16599 - DNA, 20 bp, Artificial Sequence
  Artificially Synthesized Primer Sequence
gagccgtcaaaatgacacaa

SEQ ID NO: 16600 - DNA, 20 bp, Artificial Sequence
  Artificially Synthesized Primer Sequence
ggctacttcaacttccagcg

SEQ ID NO: 16601 - DNA, 20 bp, Artificial Sequence
  Artificially Synthesized Primer Sequence
tctatgtgggagctgcaatg

SEQ ID NO: 16602 - DNA, 20 bp, Artificial Sequence
  Artificially Synthesized Primer Sequence
acccagattgaaagcacacc

SEQ ID NO: 16603 - DNA, 21 bp, Artificial Sequence
  Artificially Synthesized Primer Sequence
catttcattcggaagtgtcgt

SEQ ID NO: 16604 - DNA, 20 bp, Artificial Sequence
  Artificially Synthesized Primer Sequence
aaaagaagcccgaagctacc

SEQ ID NO: 16605 - DNA, 20 bp, Artificial Sequence
  Artificially Synthesized Primer Sequence
aagggtaagggaggcaagaa

SEQ ID NO: 16606 - DNA, 20 bp, Artificial Sequence
  Artificially Synthesized Primer Sequence
atgtcctcgtcctcgaattg

SEQ ID NO: 16607 - DNA, 20 bp, Artificial Sequence
  Artificially Synthesized Primer Sequence
caccgaccgatacagacaga

SEQ ID NO: 16608 - DNA, 19 bp, Artificial Sequence
  Artificially Synthesized Primer Sequence
ggcaagatgcacaagaagg

SEQ ID NO: 16609 - DNA, 18 bp, Artificial Sequence
  Artificially Synthesized Primer Sequence
ctcccgatgacgctcaag

SEQ ID NO: 16610 - DNA, 20 bp, Artificial Sequence
  Artificially Synthesized Primer Sequence
acgacaccacgttgtacgag

SEQ ID NO: 16611 - DNA, 20 bp, Artificial Sequence
  Artificially Synthesized Primer Sequence
cgacgacacagccagtagaa

SEQ ID NO: 16612 - DNA, 20 bp, Artificial Sequence
  Artificially Synthesized Primer Sequence
aagtagatccatggcaaccg

SEQ ID NO: 16613 - DNA, 20 bp, Artificial Sequence
  Artificially Synthesized Primer Sequence
cacgagacatgagcgaggta

SEQ ID NO: 16614 - DNA, 20 bp, Artificial Sequence
  Artificially Synthesized Primer Sequence
tatctggatagcggattcgg

SEQ ID NO: 16615 - DNA, 20 bp, Artificial Sequence
  Artificially Synthesized Primer Sequence
cccttccaaagagcttctcc

SEQ ID NO: 16616 - DNA, 20 bp, Artificial Sequence
  Artificially Synthesized Primer Sequence
tgtgctgttggatgatgtcc

SEQ ID NO: 16617 - DNA, 20 bp, Artificial Sequence
  Artificially Synthesized Primer Sequence
gctcctcgaggtgtacaagg

SEQ ID NO: 16618 - DNA, 20 bp, Artificial Sequence
  Artificially Synthesized Primer Sequence
agaggggacgaaaatatggg

SEQ ID NO: 16619 - DNA, 20 bp, Artificial Sequence
  Artificially Synthesized Primer Sequence
ggaggaaaaccaagccaaag

SEQ ID NO: 16620 - DNA, 20 bp, Artificial Sequence
  Artificially Synthesized Primer Sequence
gacgctgctcaagaactgct

SEQ ID NO: 16621 - DNA, 20 bp, Artificial Sequence
  Artificially Synthesized Primer Sequence
tactccaggataaaacggcg

SEQ ID NO: 16622 - DNA, 20 bp, Artificial Sequence
  Artificially Synthesized Primer Sequence
tctcgagatgaactgacccc

SEQ ID NO: 16623 - DNA, 20 bp, Artificial Sequence
  Artificially Synthesized Primer Sequence
attcaggaaagcgtacggaa

SEQ ID NO: 16624 - DNA, 20 bp, Artificial Sequence
  Artificially Synthesized Primer Sequence
ccctggccattgtaagaaaa

SEQ ID NO: 16625 - DNA, 20 bp, Artificial Sequence
  Artificially Synthesized Primer Sequence
aactgcgagaccgactttgt

SEQ ID NO: 16626 - DNA, 20 bp, Artificial Sequence
  Artificially Synthesized Primer Sequence
gagagcatcaagggaagcac

SEQ ID NO: 16627 - DNA, 20 bp, Artificial Sequence
  Artificially Synthesized Primer Sequence
gtctcaatatgcgtggcctt

SEQ ID NO: 16628 - DNA, 20 bp, Artificial Sequence
  Artificially Synthesized Primer Sequence
cccaaatggccatagagaaa

SEQ ID NO: 16629 - DNA, 20 bp, Artificial Sequence
  Artificially Synthesized Primer Sequence
ttcaaattggggagctatcg

SEQ ID NO: 16630 - DNA, 20 bp, Artificial Sequence
  Artificially Synthesized Primer Sequence
gaagcagtgacgaaagggag

SEQ ID NO: 16631 - DNA, 20 bp, Artificial Sequence
  Artificially Synthesized Primer Sequence
tgtcccagcatggtatcaaa

SEQ ID NO: 16632 - DNA, 20 bp, Artificial Sequence
  Artificially Synthesized Primer Sequence
gctttatgcaaatctgcggt

SEQ ID NO: 16633 - DNA, 20 bp, Artificial Sequence
  Artificially Synthesized Primer Sequence
cttggcaaaatggaaggtgt

SEQ ID NO: 16634 - DNA, 20 bp, Artificial Sequence
  Artificially Synthesized Primer Sequence
ggtgcatataccatccgacc

SEQ ID NO: 16635 - DNA, 20 bp, Artificial Sequence
  Artificially Synthesized Primer Sequence
ggtcttcttgcctgtcttcg

SEQ ID NO: 16636 - DNA, 20 bp, Artificial Sequence
  Artificially Synthesized Primer Sequence
gttgaactcagggttggcat

SEQ ID NO: 16637 - DNA, 20 bp, Artificial Sequence
  Artificially Synthesized Primer Sequence
actgtcgactgatggggaag

SEQ ID NO: 16638 - DNA, 20 bp, Artificial Sequence
  Artificially Synthesized Primer Sequence
cctcaaacttctctggcagg

SEQ ID NO: 16639 - DNA, 20 bp, Artificial Sequence
  Artificially Synthesized Primer Sequence
cggctacaaacaaacggaat

SEQ ID NO: 16640 - DNA, 20 bp, Artificial Sequence
  Artificially Synthesized Primer Sequence
caccatgctcctgaagaagg

SEQ ID NO: 16641 - DNA, 20 bp, Artificial Sequence
  Artificially Synthesized Primer Sequence
ggagtggagatgaactggga

SEQ ID NO: 16642 - DNA, 20 bp, Artificial Sequence
  Artificially Synthesized Primer Sequence
atccgcttatgttgattgcc

SEQ ID NO: 16643 - DNA, 20 bp, Artificial Sequence
  Artificially Synthesized Primer Sequence
tcgactacccaccacacaaa

SEQ ID NO: 16644 - DNA, 20 bp, Artificial Sequence
  Artificially Synthesized Primer Sequence
cccttgcttgggaagaataa

SEQ ID NO: 16645 - DNA, 20 bp, Artificial Sequence
  Artificially Synthesized Primer Sequence
acaacccctcactcaactgg

SEQ ID NO: 16646 - DNA, 20 bp, Artificial Sequence
  Artificially Synthesized Primer Sequence
tcgccgaacttccttagaga

SEQ ID NO: 16647 - DNA, 20 bp, Artificial Sequence
  Artificially Synthesized Primer Sequence
ccatcagaaatcgaaaccgt

SEQ ID NO: 16648 - DNA, 20 bp, Artificial Sequence
  Artificially Synthesized Primer Sequence
cgtgctctggaacttggagt

SEQ ID NO: 16649 - DNA, 20 bp, Artificial Sequence
  Artificially Synthesized Primer Sequence
ggaggccacacaatacgagt

SEQ ID NO: 16650 - DNA, 20 bp, Artificial Sequence
  Artificially Synthesized Primer Sequence
gaaagacacgtcgatgcaga

SEQ ID NO: 16651 - DNA, 20 bp, Artificial Sequence
  Artificially Synthesized Primer Sequence
cgggcaattttgcatattct

SEQ ID NO: 16652 - DNA, 20 bp, Artificial Sequence
  Artificially Synthesized Primer Sequence
ttacgtgcgaacagcttgag

SEQ ID NO: 16653 - DNA, 20 bp, Artificial Sequence
  Artificially Synthesized Primer Sequence
agctttctccggatggattt

SEQ ID NO: 16654 - DNA, 20 bp, Artificial Sequence
  Artificially Synthesized Primer Sequence
ccttttatcaatctcgggca

SEQ ID NO: 16655 - DNA, 20 bp, Artificial Sequence
  Artificially Synthesized Primer Sequence
tccggagaaagctaactgga

SEQ ID NO: 16656 - DNA, 20 bp, Artificial Sequence
  Artificially Synthesized Primer Sequence
gcagcgtctgagaagttgtg

SEQ ID NO: 16657 - DNA, 20 bp, Artificial Sequence
  Artificially Synthesized Primer Sequence
ccaacttcaagctcgtcctc

SEQ ID NO: 16658 - DNA, 20 bp, Artificial Sequence
  Artificially Synthesized Primer Sequence
gtcatgtcccctgacagctt

SEQ ID NO: 16659 - DNA, 20 bp, Artificial Sequence
  Artificially Synthesized Primer Sequence
gttgtcatcatcgtcatccg

SEQ ID NO: 16660 - DNA, 20 bp, Artificial Sequence
  Artificially Synthesized Primer Sequence
ccggctgacctacaagaatg

SEQ ID NO: 16661 - DNA, 20 bp, Artificial Sequence
  Artificially Synthesized Primer Sequence
ctgcaacaaaggtcatcacg

SEQ ID NO: 16662 - DNA, 20 bp, Artificial Sequence
  Artificially Synthesized Primer Sequence
cccttcggtttattccgatt

SEQ ID NO: 16663 - DNA, 20 bp, Artificial Sequence
  Artificially Synthesized Primer Sequence
cccttcggtttattccgatt

SEQ ID NO: 16664 - DNA, 20 bp, Artificial Sequence
  Artificially Synthesized Primer Sequence
atcaggatcagaagacggca

SEQ ID NO: 16665 - DNA, 20 bp, Artificial Sequence
  Artificially Synthesized Primer Sequence
aaattgcccagggaaaaact

SEQ ID NO: 16666 - DNA, 20 bp, Artificial Sequence
  Artificially Synthesized Primer Sequence
ctcgacagggctacaagagg

SEQ ID NO: 16667 - DNA, 20 bp, Artificial Sequence
  Artificially Synthesized Primer Sequence
taaaacgcacaatccagcag

SEQ ID NO: 16668 - DNA, 20 bp, Artificial Sequence
  Artificially Synthesized Primer Sequence
tgtttgcttaaagttggggg

SEQ ID NO: 16669 - DNA, 20 bp, Artificial Sequence
  Artificially Synthesized Primer Sequence
ctaaaccgaagccacctacg

SEQ ID NO: 16670 - DNA, 20 bp, Artificial Sequence
  Artificially Synthesized Primer Sequence
gacctgctcggtcaacgtat

SEQ ID NO: 16671 - DNA, 20 bp, Artificial Sequence
  Artificially Synthesized Primer Sequence
gtgcataccagccctaggaa

SEQ ID NO: 16672 - DNA, 20 bp, Artificial Sequence
  Artificially Synthesized Primer Sequence
agacatgaccttggggactg

SEQ ID NO: 16673 - DNA, 20 bp, Artificial Sequence
  Artificially Synthesized Primer Sequence
tcactatagggcgaattggg

SEQ ID NO: 16674 - DNA, 20 bp, Artificial Sequence
  Artificially Synthesized Primer Sequence
ctcaggtccaaacccaagaa

SEQ ID NO: 16675 - DNA, 20 bp, Artificial Sequence
  Artificially Synthesized Primer Sequence
cgcacacagaccatttgcta

SEQ ID NO: 16676 - DNA, 20 bp, Artificial Sequence
  Artificially Synthesized Primer Sequence
ggctgaacaccaaaatcacc

SEQ ID NO: 16677 - DNA, 20 bp, Artificial Sequence
  Artificially Synthesized Primer Sequence
tcggagcgtggatctctagt

SEQ ID NO: 16678 - DNA, 20 bp, Artificial Sequence
  Artificially Synthesized Primer Sequence
gaagcagcatctgaaggacc

SEQ ID NO: 16679 - DNA, 20 bp, Artificial Sequence
  Artificially Synthesized Primer Sequence
cacatgtgctcaagtccacc

SEQ ID NO: 16680 - DNA, 20 bp, Artificial Sequence
  Artificially Synthesized Primer Sequence
atccacccatcgtgtgttct

SEQ ID NO: 16681 - DNA, 20 bp, Artificial Sequence
  Artificially Synthesized Primer Sequence
attcaccaggtccaaggatg

SEQ ID NO: 16682 - DNA, 20 bp, Artificial Sequence
  Artificially Synthesized Primer Sequence
gaagtcctcgaacgtgaagc

SEQ ID NO: 16683 - DNA, 20 bp, Artificial Sequence
  Artificially Synthesized Primer Sequence
gagggtttatttgggtcggt

SEQ ID NO: 16684 - DNA, 20 bp, Artificial Sequence
  Artificially Synthesized Primer Sequence
atgtggagggatcaagatgg

SEQ ID NO: 16685 - DNA, 20 bp, Artificial Sequence
  Artificially Synthesized Primer Sequence
ggcctccaatgtctagtcca

SEQ ID NO: 16686 - DNA, 20 bp, Artificial Sequence
  Artificially Synthesized Primer Sequence
gttgaaacaaaccatccgct

SEQ ID NO: 16687 - DNA, 20 bp, Artificial Sequence
  Artificially Synthesized Primer Sequence
atgatgcacacaggcatagg

SEQ ID NO: 16688 - DNA, 20 bp, Artificial Sequence
  Artificially Synthesized Primer Sequence
agacaagcgggtgaacaatc

SEQ ID NO: 16689 - DNA, 20 bp, Artificial Sequence
  Artificially Synthesized Primer Sequence
ccaacacaccagtcatggag

SEQ ID NO: 16690 - DNA, 20 bp, Artificial Sequence
  Artificially Synthesized Primer Sequence
gacatggctgaaaccacctt

SEQ ID NO: 16691 - DNA, 20 bp, Artificial Sequence
  Artificially Synthesized Primer Sequence
tggaagtgttgactccctca

SEQ ID NO: 16692 - DNA, 20 bp, Artificial Sequence
  Artificially Synthesized Primer Sequence
gaaggtggtttcagccatgt

SEQ ID NO: 16693 - DNA, 20 bp, Artificial Sequence
  Artificially Synthesized Primer Sequence
gggagagactgctttgaacg

SEQ ID NO: 16694 - DNA, 20 bp, Artificial Sequence
  Artificially Synthesized Primer Sequence
ccccttgttgctgtttttgt

SEQ ID NO: 16695 - DNA, 20 bp, Artificial Sequence
  Artificially Synthesized Primer Sequence
taccaaaataatcgccgagg

SEQ ID NO: 16696 - DNA, 20 bp, Artificial Sequence
  Artificially Synthesized Primer Sequence
gctttgcaaccaaaggagaa

SEQ ID NO: 16697 - DNA, 20 bp, Artificial Sequence
  Artificially Synthesized Primer Sequence
ttgccaaaataaagatgggc

SEQ ID NO: 16698 - DNA, 20 bp, Artificial Sequence
  Artificially Synthesized Primer Sequence
aggggaaaaacaaggaagga

SEQ ID NO: 16699 - DNA, 20 bp, Artificial Sequence
  Artificially Synthesized Primer Sequence
tgcaaccttcatgcctagag

SEQ ID NO: 16700 - DNA, 20 bp, Artificial Sequence
  Artificially Synthesized Primer Sequence
cctccccaacaatggagtaa

SEQ ID NO: 16701 - DNA, 20 bp, Artificial Sequence
  Artificially Synthesized Primer Sequence
ctccagatcgctctcttcgt

SEQ ID NO: 16702 - DNA, 20 bp, Artificial Sequence
  Artificially Synthesized Primer Sequence
ggagcaagattgagtcgagg

SEQ ID NO: 16703 - DNA, 20 bp, Artificial Sequence
  Artificially Synthesized Primer Sequence
caatagcgtgaggagaaccc

SEQ ID NO: 16704 - DNA, 20 bp, Artificial Sequence
  Artificially Synthesized Primer Sequence
ccccaacaatggagtaatcg

SEQ ID NO: 16705 - DNA, 20 bp, Artificial Sequence
  Artificially Synthesized Primer Sequence
ttgaggagaccaagcgaagt

SEQ ID NO: 16706 - DNA, 20 bp, Artificial Sequence
  Artificially Synthesized Primer Sequence
acttggcacagtcgatttcc

SEQ ID NO: 16707 - DNA, 20 bp, Artificial Sequence
  Artificially Synthesized Primer Sequence
gtgaaggcacatcacaaagc

SEQ ID NO: 16708 - DNA, 20 bp, Artificial Sequence
  Artificially Synthesized Primer Sequence
tgagcagtatgcaatcaggg

SEQ ID NO: 16709 - DNA, 20 bp, Artificial Sequence
  Artificially Synthesized Primer Sequence
ttgtcgtaaaagggtttggc

SEQ ID NO: 16710 - DNA, 20 bp, Artificial Sequence
  Artificially Synthesized Primer Sequence
gctgtgcatacgcgctataa

SEQ ID NO: 16711 - DNA, 20 bp, Artificial Sequence
  Artificially Synthesized Primer Sequence
ctgcacagcaaaattcatgg

SEQ ID NO: 16712 - DNA, 20 bp, Artificial Sequence
  Artificially Synthesized Primer Sequence
tctcattcaaggtgtgcgag

SEQ ID NO: 16713 - DNA, 20 bp, Artificial Sequence
  Artificially Synthesized Primer Sequence
tcagcgaaacatgatgtggt

SEQ ID NO: 16714 - DNA, 20 bp, Artificial Sequence
  Artificially Synthesized Primer Sequence
tccagatcagagatcggctt

SEQ ID NO: 16715 - DNA, 22 bp, Artificial Sequence
  Artificially Synthesized Primer Sequence
gaaatgaaaactagctcccagc

SEQ ID NO: 16716 - DNA, 20 bp, Artificial Sequence
  Artificially Synthesized Primer Sequence
tcagcgaaacatgatgtggt

SEQ ID NO: 16717 - DNA, 20 bp, Artificial Sequence
  Artificially Synthesized Primer Sequence
atacctacgcaaccactggc

SEQ ID NO: 16718 - DNA, 20 bp, Artificial Sequence
  Artificially Synthesized Primer Sequence
ggtaccaatgacaaggtggg

SEQ ID NO: 16719 - DNA, 20 bp, Artificial Sequence
  Artificially Synthesized Primer Sequence
gattggccttatggtagcga

SEQ ID NO: 16720 - DNA, 20 bp, Artificial Sequence
  Artificially Synthesized Primer Sequence
ggagcgttcttttgacagga

SEQ ID NO: 16721 - DNA, 20 bp, Artificial Sequence
  Artificially Synthesized Primer Sequence
tccctgatcagtgggttagc

SEQ ID NO: 16722 - DNA, 20 bp, Artificial Sequence
  Artificially Synthesized Primer Sequence
gaatgagtcacaaaacgcga

SEQ ID NO: 16723 - DNA, 20 bp, Artificial Sequence
  Artificially Synthesized Primer Sequence
cgccaacaatttcagcttct

SEQ ID NO: 16724 - DNA, 20 bp, Artificial Sequence
  Artificially Synthesized Primer Sequence
ttcggcacaactacctcaca

SEQ ID NO: 16725 - DNA, 20 bp, Artificial Sequence
  Artificially Synthesized Primer Sequence
ttgaggagaccaagcgaagt

SEQ ID NO: 16726 - DNA, 20 bp, Artificial Sequence
  Artificially Synthesized Primer Sequence
catcaatactcggaaggcgt

SEQ ID NO: 16727 - DNA, 20 bp, Artificial Sequence
  Artificially Synthesized Primer Sequence
tgtggtccaaaaccatagca

SEQ ID NO: 16728 - DNA, 20 bp, Artificial Sequence
  Artificially Synthesized Primer Sequence
acgccttccgagtattgatg

SEQ ID NO: 16729 - DNA, 20 bp, Artificial Sequence
  Artificially Synthesized Primer Sequence
accattccagaaccaactgc

SEQ ID NO: 16730 - DNA, 20 bp, Artificial Sequence
  Artificially Synthesized Primer Sequence
ggagatcgttcttggctcag

SEQ ID NO: 16731 - DNA, 20 bp, Artificial Sequence
  Artificially Synthesized Primer Sequence
ggagatcgttcttggctcag

SEQ ID NO: 16732 - DNA, 20 bp, Artificial Sequence
  Artificially Synthesized Primer Sequence
accattccagaaccaactgc

SEQ ID NO: 16733 - DNA, 20 bp, Artificial Sequence
  Artificially Synthesized Primer Sequence
atgtgagggtggagaattgc

SEQ ID NO: 16734 - DNA, 20 bp, Artificial Sequence
  Artificially Synthesized Primer Sequence
aaaatggccgactaccacag

SEQ ID NO: 16735 - DNA, 20 bp, Artificial Sequence
  Artificially Synthesized Primer Sequence
atggtgacaacaaccgacaa

SEQ ID NO: 16736 - DNA, 20 bp, Artificial Sequence
  Artificially Synthesized Primer Sequence
cagcactttgaacaggaggg

SEQ ID NO: 16737 - DNA, 20 bp, Artificial Sequence
  Artificially Synthesized Primer Sequence
tctttgaaagggcattcgac

SEQ ID NO: 16738 - DNA, 20 bp, Artificial Sequence
  Artificially Synthesized Primer Sequence
tatttttgcaagggagccac

SEQ ID NO: 16739 - DNA, 20 bp, Artificial Sequence
  Artificially Synthesized Primer Sequence
ccaggtaccaaatgggagaa

SEQ ID NO: 16740 - DNA, 20 bp, Artificial Sequence
  Artificially Synthesized Primer Sequence
aagaagcagaaggcaaacga

SEQ ID NO: 16741 - DNA, 20 bp, Artificial Sequence
  Artificially Synthesized Primer Sequence
gcctatgaaagggcacaaaa

SEQ ID NO: 16742 - DNA, 20 bp, Artificial Sequence
  Artificially Synthesized Primer Sequence
aaccgggtaggtgagaaggt

SEQ ID NO: 16743 - DNA, 20 bp, Artificial Sequence
  Artificially Synthesized Primer Sequence
agaatagggggcaggtgttt

SEQ ID NO: 16744 - DNA, 20 bp, Artificial Sequence
  Artificially Synthesized Primer Sequence
tgtggtatgagcaccttgga

SEQ ID NO: 16745 - DNA, 20 bp, Artificial Sequence
  Artificially Synthesized Primer Sequence
tggataccaaggaggaggtg

SEQ ID NO: 16746 - DNA, 20 bp, Artificial Sequence
  Artificially Synthesized Primer Sequence
ggcgtacctcataacggtgt

SEQ ID NO: 16747 - DNA, 20 bp, Artificial Sequence
  Artificially Synthesized Primer Sequence
ggctttcttgcatacctgga

SEQ ID NO: 16748 - DNA, 20 bp, Artificial Sequence
  Artificially Synthesized Primer Sequence
cgtcgctggtaaatctggag

SEQ ID NO: 16749 - DNA, 20 bp, Artificial Sequence
  Artificially Synthesized Primer Sequence
gcactgttggcctactggat

SEQ ID NO: 16750 - DNA, 20 bp, Artificial Sequence
  Artificially Synthesized Primer Sequence
agcagtcgtggaagaagagg

SEQ ID NO: 16751 - DNA, 20 bp, Artificial Sequence
  Artificially Synthesized Primer Sequence
ctttccaaggcatcaaccat

SEQ ID NO: 16752 - DNA, 20 bp, Artificial Sequence
  Artificially Synthesized Primer Sequence
aacgcctactaccggaacct

SEQ ID NO: 16753 - DNA, 20 bp, Artificial Sequence
  Artificially Synthesized Primer Sequence
gcgatgaaagctatgcacaa

SEQ ID NO: 16754 - DNA, 20 bp, Artificial Sequence
  Artificially Synthesized Primer Sequence
catgaccacaccaagtcctg

SEQ ID NO: 16755 - DNA, 20 bp, Artificial Sequence
  Artificially Synthesized Primer Sequence
atcatcagggtgagatgcaa

SEQ ID NO: 16756 - DNA, 20 bp, Artificial Sequence
  Artificially Synthesized Primer Sequence
gcagcaagtgatttcgatga

SEQ ID NO: 16757 - DNA, 20 bp, Artificial Sequence
  Artificially Synthesized Primer Sequence
tctctttgaagcttgcgaca

SEQ ID NO: 16758 - DNA, 20 bp, Artificial Sequence
  Artificially Synthesized Primer Sequence
tagtcagccattcttcggct

SEQ ID NO: 16759 - DNA, 20 bp, Artificial Sequence
  Artificially Synthesized Primer Sequence
acacgagccctcttgctatc

SEQ ID NO: 16760 - DNA, 20 bp, Artificial Sequence
  Artificially Synthesized Primer Sequence
tgagagcataccaggggaac

SEQ ID NO: 16761 - DNA, 20 bp, Artificial Sequence
  Artificially Synthesized Primer Sequence
gtcatcgacattggcaacac

SEQ ID NO: 16762 - DNA, 20 bp, Artificial Sequence
  Artificially Synthesized Primer Sequence
cgcagttttctcacgaacaa

SEQ ID NO: 16763 - DNA, 20 bp, Artificial Sequence
  Artificially Synthesized Primer Sequence
tgatgccgttttgaatacca

SEQ ID NO: 16764 - DNA, 20 bp, Artificial Sequence
  Artificially Synthesized Primer Sequence
tgaccgccaaacataactca

SEQ ID NO: 16765 - DNA, 20 bp, Artificial Sequence
  Artificially Synthesized Primer Sequence
gaggggtcatcgaaatgcta

SEQ ID NO: 16766 - DNA, 20 bp, Artificial Sequence
  Artificially Synthesized Primer Sequence
agtgctttttgtccacaccc

SEQ ID NO: 16767 - DNA, 20 bp, Artificial Sequence
  Artificially Synthesized Primer Sequence
tgctaagagacggtgcattg

SEQ ID NO: 16768 - DNA, 20 bp, Artificial Sequence
  Artificially Synthesized Primer Sequence
aatcaggccagacaatttgc

SEQ ID NO: 16769 - DNA, 20 bp, Artificial Sequence
  Artificially Synthesized Primer Sequence
tggcaccatgttttcgtcta

SEQ ID NO: 16770 - DNA, 20 bp, Artificial Sequence
  Artificially Synthesized Primer Sequence
ggtcatcaatgtccctgctt

SEQ ID NO: 16771 - DNA, 20 bp, Artificial Sequence
  Artificially Synthesized Primer Sequence
tacattggtggacttcgctg

SEQ ID NO: 16772 - DNA, 20 bp, Artificial Sequence
  Artificially Synthesized Primer Sequence
agccaggctattgcttcaaa

SEQ ID NO: 16773 - DNA, 20 bp, Artificial Sequence
  Artificially Synthesized Primer Sequence
aaagtgtgcgggtagtgtcc

SEQ ID NO: 16774 - DNA, 20 bp, Artificial Sequence
  Artificially Synthesized Primer Sequence
cacacgacgcgcttactaaa

SEQ ID NO: 16775 - DNA, 20 bp, Artificial Sequence
  Artificially Synthesized Primer Sequence
caggctccttaaataggcga

SEQ ID NO: 16776 - DNA, 20 bp, Artificial Sequence
  Artificially Synthesized Primer Sequence
tgaaagacacggtggatgac

SEQ ID NO: 16777 - DNA, 20 bp, Artificial Sequence
  Artificially Synthesized Primer Sequence
cacttcggtcccttacctca

SEQ ID NO: 16778 - DNA, 20 bp, Artificial Sequence
  Artificially Synthesized Primer Sequence
gacatgaaccagcccacttt

SEQ ID NO: 16779 - DNA, 20 bp, Artificial Sequence
  Artificially Synthesized Primer Sequence
ggccctttgatatgttgcac

SEQ ID NO: 16780 - DNA, 20 bp, Artificial Sequence
  Artificially Synthesized Primer Sequence
gtccctctacccccaaccta

SEQ ID NO: 16781 - DNA, 20 bp, Artificial Sequence
  Artificially Synthesized Primer Sequence
atcattctgcctatggcgac

SEQ ID NO: 16782 - DNA, 20 bp, Artificial Sequence
  Artificially Synthesized Primer Sequence
gttgtcgaacgagaacccat

SEQ ID NO: 16783 - DNA, 21 bp, Artificial Sequence
  Artificially Synthesized Primer Sequence
tccgttgcttcttctacctca

SEQ ID NO: 16784 - DNA, 21 bp, Artificial Sequence
  Artificially Synthesized Primer Sequence
ccttccaccaagagctctacc

SEQ ID NO: 16785 - DNA, 20 bp, Artificial Sequence
  Artificially Synthesized Primer Sequence
gtccacggagcttatcttgc

SEQ ID NO: 16786 - DNA, 20 bp, Artificial Sequence
  Artificially Synthesized Primer Sequence
cgacgcccaaagtgttttat

SEQ ID NO: 16787 - DNA, 20 bp, Artificial Sequence
  Artificially Synthesized Primer Sequence
gcacgaaagaaagctggaac

SEQ ID NO: 16788 - DNA, 20 bp, Artificial Sequence
  Artificially Synthesized Primer Sequence
ttctgatgaacaaggccctc

SEQ ID NO: 16789 - DNA, 20 bp, Artificial Sequence
  Artificially Synthesized Primer Sequence
agtcacaaccggaggacatc

SEQ ID NO: 16790 - DNA, 20 bp, Artificial Sequence
  Artificially Synthesized Primer Sequence
caaacccatatgaaggggtg

SEQ ID NO: 16791 - DNA, 20 bp, Artificial Sequence
  Artificially Synthesized Primer Sequence
ccatgttccaaactccaggt

SEQ ID NO: 16792 - DNA, 20 bp, Artificial Sequence
  Artificially Synthesized Primer Sequence
taccaatccttcaagccgtc

SEQ ID NO: 16793 - DNA, 20 bp, Artificial Sequence
  Artificially Synthesized Primer Sequence
gggcctgtttagtagggagc

SEQ ID NO: 16794 - DNA, 20 bp, Artificial Sequence
  Artificially Synthesized Primer Sequence
ggacagaaaggatccgacaa

SEQ ID NO: 16795 - DNA, 20 bp, Artificial Sequence
  Artificially Synthesized Primer Sequence
gctccctactaaacaggccc

SEQ ID NO: 16796 - DNA, 20 bp, Artificial Sequence
  Artificially Synthesized Primer Sequence
gagccctggagaccatgata

SEQ ID NO: 16797 - DNA, 20 bp, Artificial Sequence
  Artificially Synthesized Primer Sequence
caccaaaggaagtgaccgtt

SEQ ID NO: 16798 - DNA, 20 bp, Artificial Sequence
  Artificially Synthesized Primer Sequence
tcatgagcttgcaaaacctg

SEQ ID NO: 16799 - DNA, 20 bp, Artificial Sequence
  Artificially Synthesized Primer Sequence
tcatgagcttgcaaaacctg

SEQ ID NO: 16800 - DNA, 20 bp, Artificial Sequence
  Artificially Synthesized Primer Sequence
gatgttaccggagagccctt

SEQ ID NO: 16801 - DNA, 20 bp, Artificial Sequence
  Artificially Synthesized Primer Sequence
ctccatgaaccacgacacac

SEQ ID NO: 16802 - DNA, 20 bp, Artificial Sequence
  Artificially Synthesized Primer Sequence
ggcaccagggtaacgttcta

SEQ ID NO: 16803 - DNA, 20 bp, Artificial Sequence
  Artificially Synthesized Primer Sequence
aagcatcctctgtttcaccg

SEQ ID NO: 16804 - DNA, 19 bp, Artificial Sequence
  Artificially Synthesized Primer Sequence
aggcgcttgacatgaacac

SEQ ID NO: 16805 - DNA, 20 bp, Artificial Sequence
  Artificially Synthesized Primer Sequence
acatgctacacgaagacccc

SEQ ID NO: 16806 - DNA, 20 bp, Artificial Sequence
  Artificially Synthesized Primer Sequence
tagtgccctcgctgaatctt

SEQ ID NO: 16807 - DNA, 20 bp, Artificial Sequence
  Artificially Synthesized Primer Sequence
ttcgcttacatcaacttgcg

SEQ ID NO: 16808 - DNA, 20 bp, Artificial Sequence
  Artificially Synthesized Primer Sequence
gaggctgtggttaagcttgc

SEQ ID NO: 16809 - DNA, 20 bp, Artificial Sequence
  Artificially Synthesized Primer Sequence
gaagaggcagaagaggagcc

SEQ ID NO: 16810 - DNA, 20 bp, Artificial Sequence
  Artificially Synthesized Primer Sequence
gaaaacctcatccgcaacat

SEQ ID NO: 16811 - DNA, 20 bp, Artificial Sequence
  Artificially Synthesized Primer Sequence
acacgaacaaaaggactgcc

SEQ ID NO: 16812 - DNA, 20 bp, Artificial Sequence
  Artificially Synthesized Primer Sequence
gacaaggccaggagaaacaa

SEQ ID NO: 16813 - DNA, 20 bp, Artificial Sequence
  Artificially Synthesized Primer Sequence
acaaaacctcagtgcatccc

SEQ ID NO: 16814 - DNA, 20 bp, Artificial Sequence
  Artificially Synthesized Primer Sequence
gcgtaagaggcagatccaag

SEQ ID NO: 16815 - DNA, 20 bp, Artificial Sequence
  Artificially Synthesized Primer Sequence
tctgaagaggctccggataa

SEQ ID NO: 16816 - DNA, 20 bp, Artificial Sequence
  Artificially Synthesized Primer Sequence
cagctctaagggagcaatgg

SEQ ID NO: 16817 - DNA, 20 bp, Artificial Sequence
  Artificially Synthesized Primer Sequence
ttggcatctttcatggatca

SEQ ID NO: 16818 - DNA, 20 bp, Artificial Sequence
  Artificially Synthesized Primer Sequence
caaacggctgatacccatct

SEQ ID NO: 16819 - DNA, 20 bp, Artificial Sequence
  Artificially Synthesized Primer Sequence
cgatcatcattgcctcattg

SEQ ID NO: 16820 - DNA, 21 bp, Artificial Sequence
  Artificially Synthesized Primer Sequence
gcacaacctctcctttgacag

SEQ ID NO: 16821 - DNA, 20 bp, Artificial Sequence
  Artificially Synthesized Primer Sequence
tctgcaaagcagaaagctca

SEQ ID NO: 16822 - DNA, 20 bp, Artificial Sequence
  Artificially Synthesized Primer Sequence
tctctccatctggggatgac

SEQ ID NO: 16823 - DNA, 20 bp, Artificial Sequence
  Artificially Synthesized Primer Sequence
ctgaatttgagcagtccggt

SEQ ID NO: 16824 - DNA, 20 bp, Artificial Sequence
  Artificially Synthesized Primer Sequence
gcaaagactccgaaaacagg

SEQ ID NO: 16825 - DNA, 20 bp, Artificial Sequence
  Artificially Synthesized Primer Sequence
gtttggcgattcatcagtcc

SEQ ID NO: 16826 - DNA, 20 bp, Artificial Sequence
  Artificially Synthesized Primer Sequence
aggttgcactcgttcttgct

SEQ ID NO: 16827 - DNA, 20 bp, Artificial Sequence
  Artificially Synthesized Primer Sequence
ggccctagccaagctaaaaa

SEQ ID NO: 16828 - DNA, 20 bp, Artificial Sequence
  Artificially Synthesized Primer Sequence
agtggaaaccactctgcacc

SEQ ID NO: 16829 - DNA, 20 bp, Artificial Sequence
  Artificially Synthesized Primer Sequence
ggcgaaaatggctgttatgt

SEQ ID NO: 16830 - DNA, 20 bp, Artificial Sequence
  Artificially Synthesized Primer Sequence
atcggtcgcataccaatagc

SEQ ID NO: 16831 - DNA, 20 bp, Artificial Sequence
  Artificially Synthesized Primer Sequence
tcatgcggaacaagagtttg

SEQ ID NO: 16832 - DNA, 20 bp, Artificial Sequence
  Artificially Synthesized Primer Sequence
tgatcccaccaagtcattca

SEQ ID NO: 16833 - DNA, 20 bp, Artificial Sequence
  Artificially Synthesized Primer Sequence
cgtcgactactgcagaacca

SEQ ID NO: 16834 - DNA, 20 bp, Artificial Sequence
  Artificially Synthesized Primer Sequence
ctaaacgagggctcgtcatc

SEQ ID NO: 16835 - DNA, 20 bp, Artificial Sequence
  Artificially Synthesized Primer Sequence
tcattatcggcagggaaatc

SEQ ID NO: 16836 - DNA, 20 bp, Artificial Sequence
  Artificially Synthesized Primer Sequence
gaaacttcgtggatgttcgg

SEQ ID NO: 16837 - DNA, 20 bp, Artificial Sequence
  Artificially Synthesized Primer Sequence
tggtgatacaaccgtcagga

SEQ ID NO: 16838 - DNA, 20 bp, Artificial Sequence
  Artificially Synthesized Primer Sequence
gcgtggtagtggggaagtta

SEQ ID NO: 16839 - DNA, 20 bp, Artificial Sequence
  Artificially Synthesized Primer Sequence
tcctgacggttgtatcacca

SEQ ID NO: 16840 - DNA, 20 bp, Artificial Sequence
  Artificially Synthesized Primer Sequence
gatgttgccgatgctcttct

SEQ ID NO: 16841 - DNA, 20 bp, Artificial Sequence
  Artificially Synthesized Primer Sequence
tgttgggtggtttgaagaca

SEQ ID NO: 16842 - DNA, 20 bp, Artificial Sequence
  Artificially Synthesized Primer Sequence
tgcccctatatgatggtggt

SEQ ID NO: 16843 - DNA, 21 bp, Artificial Sequence
  Artificially Synthesized Primer Sequence
catcacgtaaatcaagtgcca

SEQ ID NO: 16844 - DNA, 20 bp, Artificial Sequence
  Artificially Synthesized Primer Sequence
ttatgcacctccaatgcgta

SEQ ID NO: 16845 - DNA, 20 bp, Artificial Sequence
  Artificially Synthesized Primer Sequence
accatgaacatgtgctccaa

SEQ ID NO: 16846 - DNA, 20 bp, Artificial Sequence
  Artificially Synthesized Primer Sequence
gatcttgtcgagcttctccg

SEQ ID NO: 16847 - DNA, 20 bp, Artificial Sequence
  Artificially Synthesized Primer Sequence
caataccattaccgttccgc

SEQ ID NO: 16848 - DNA, 19 bp, Artificial Sequence
  Artificially Synthesized Primer Sequence
gcagcacctgcagaaagag

SEQ ID NO: 16849 - DNA, 20 bp, Artificial Sequence
  Artificially Synthesized Primer Sequence
gccaactgtaaccttgccat

SEQ ID NO: 16850 - DNA, 20 bp, Artificial Sequence
  Artificially Synthesized Primer Sequence
gcgtatttgcagcattttga

SEQ ID NO: 16851 - DNA, 22 bp, Artificial Sequence
  Artificially Synthesized Primer Sequence
tttacagggtagaactggcctt

SEQ ID NO: 16852 - DNA, 20 bp, Artificial Sequence
  Artificially Synthesized Primer Sequence
gccactcttgctctgcttct

SEQ ID NO: 16853 - DNA, 20 bp, Artificial Sequence
  Artificially Synthesized Primer Sequence
gagtgggaaggtcgaatgaa

SEQ ID NO: 16854 - DNA, 20 bp, Artificial Sequence
  Artificially Synthesized Primer Sequence
atttccttttcagcccaggt

SEQ ID NO: 16855 - DNA, 20 bp, Artificial Sequence
  Artificially Synthesized Primer Sequence
cgccacttcagagaaactga

SEQ ID NO: 16856 - DNA, 20 bp, Artificial Sequence
  Artificially Synthesized Primer Sequence
acctgggctgaaaaggaaat

SEQ ID NO: 16857 - DNA, 20 bp, Artificial Sequence
  Artificially Synthesized Primer Sequence
ttgatgatagacgctcgcac

SEQ ID NO: 16858 - DNA, 20 bp, Artificial Sequence
  Artificially Synthesized Primer Sequence
gtcctggatcagggttctca

SEQ ID NO: 16859 - DNA, 20 bp, Artificial Sequence
  Artificially Synthesized Primer Sequence
agttcaggatgccagatgct

SEQ ID NO: 16860 - DNA, 20 bp, Artificial Sequence
  Artificially Synthesized Primer Sequence
atgttgccgatgctcttctt

SEQ ID NO: 16861 - DNA, 20 bp, Artificial Sequence
  Artificially Synthesized Primer Sequence
acagcgctagggaacttgaa

SEQ ID NO: 16862 - DNA, 20 bp, Artificial Sequence
  Artificially Synthesized Primer Sequence
agatagaccagcacatgccc

SEQ ID NO: 16863 - DNA, 20 bp, Artificial Sequence
  Artificially Synthesized Primer Sequence
agcagaatacaatgccaggg

SEQ ID NO: 16864 - DNA, 20 bp, Artificial Sequence
  Artificially Synthesized Primer Sequence
cgagcgtgcttatttcatca

SEQ ID NO: 16865 - DNA, 20 bp, Artificial Sequence
  Artificially Synthesized Primer Sequence
gtggttgctgctgcaataga

SEQ ID NO: 16866 - DNA, 20 bp, Artificial Sequence
  Artificially Synthesized Primer Sequence
cgcaagtccaaagtcacaaa

SEQ ID NO: 16867 - DNA, 20 bp, Artificial Sequence
  Artificially Synthesized Primer Sequence
cagcgttcagatgtcttgct

SEQ ID NO: 16868 - DNA, 20 bp, Artificial Sequence
  Artificially Synthesized Primer Sequence
gcactgagtccgtttccatt

SEQ ID NO: 16869 - DNA, 20 bp, Artificial Sequence
  Artificially Synthesized Primer Sequence
atcttcctcaaggtcggctt

SEQ ID NO: 16870 - DNA, 20 bp, Artificial Sequence
  Artificially Synthesized Primer Sequence
tactaccggcattctttgcc

SEQ ID NO: 16871 - DNA, 20 bp, Artificial Sequence
  Artificially Synthesized Primer Sequence
tactaccggcattctttgcc

SEQ ID NO: 16872 - DNA, 20 bp, Artificial Sequence
  Artificially Synthesized Primer Sequence
atcttcctcaaggtcggctt

SEQ ID NO: 16873 - DNA, 20 bp, Artificial Sequence
  Artificially Synthesized Primer Sequence
ttggcaatctggttagaggg

SEQ ID NO: 16874 - DNA, 20 bp, Artificial Sequence
  Artificially Synthesized Primer Sequence
ttaccagcccacaaggtttc

SEQ ID NO: 16875 - DNA, 20 bp, Artificial Sequence
  Artificially Synthesized Primer Sequence
gagaagcccatacaagcagc

SEQ ID NO: 16876 - DNA, 20 bp, Artificial Sequence
  Artificially Synthesized Primer Sequence
ctcatgaacatgccgcttac

SEQ ID NO: 16877 - DNA, 20 bp, Artificial Sequence
  Artificially Synthesized Primer Sequence
tcctccttcaccatggtctc

SEQ ID NO: 16878 - DNA, 20 bp, Artificial Sequence
  Artificially Synthesized Primer Sequence
aggaccatgtcatttctggc

SEQ ID NO: 16879 - DNA, 20 bp, Artificial Sequence
  Artificially Synthesized Primer Sequence
aggaccatgtcatttctggc

SEQ ID NO: 16880 - DNA, 19 bp, Artificial Sequence
  Artificially Synthesized Primer Sequence
gcgtcttcaccttcgtgtg

SEQ ID NO: 16881 - DNA, 20 bp, Artificial Sequence
  Artificially Synthesized Primer Sequence
atggaccctcttcattgcac

SEQ ID NO: 16882 - DNA, 20 bp, Artificial Sequence
  Artificially Synthesized Primer Sequence
tgctacacagggtgaacagc

SEQ ID NO: 16883 - DNA, 20 bp, Artificial Sequence
  Artificially Synthesized Primer Sequence
aagcccatacaggcagtgtc

SEQ ID NO: 16884 - DNA, 20 bp, Artificial Sequence
  Artificially Synthesized Primer Sequence
cattgcacatctcaagacgg

SEQ ID NO: 16885 - DNA, 20 bp, Artificial Sequence
  Artificially Synthesized Primer Sequence
gtgttggagggacgtcagtt

SEQ ID NO: 16886 - DNA, 20 bp, Artificial Sequence
  Artificially Synthesized Primer Sequence
gcaagagtctcgacagggtc

SEQ ID NO: 16887 - DNA, 20 bp, Artificial Sequence
  Artificially Synthesized Primer Sequence
agcaacagcaacatgagcag

SEQ ID NO: 16888 - DNA, 20 bp, Artificial Sequence
  Artificially Synthesized Primer Sequence
tcaactatgacctcccgacc

SEQ ID NO: 16889 - DNA, 20 bp, Artificial Sequence
  Artificially Synthesized Primer Sequence
gacatcggtgacgacttcct

SEQ ID NO: 16890 - DNA, 20 bp, Artificial Sequence
  Artificially Synthesized Primer Sequence
ccccataacgctaatgtgct

SEQ ID NO: 16891 - DNA, 20 bp, Artificial Sequence
  Artificially Synthesized Primer Sequence
gatcacatctgacgtcctcg

SEQ ID NO: 16892 - DNA, 20 bp, Artificial Sequence
  Artificially Synthesized Primer Sequence
agaaaaggaaggcaaggagc

SEQ ID NO: 16893 - DNA, 20 bp, Artificial Sequence
  Artificially Synthesized Primer Sequence
atgtcctgaagggtttgtcg

SEQ ID NO: 16894 - DNA, 20 bp, Artificial Sequence
  Artificially Synthesized Primer Sequence
ttcacagcagatccatgagc

SEQ ID NO: 16895 - DNA, 20 bp, Artificial Sequence
  Artificially Synthesized Primer Sequence
gctatcagtgcgcattacca

SEQ ID NO: 16896 - DNA, 20 bp, Artificial Sequence
  Artificially Synthesized Primer Sequence
gattcggtgcggacaactat

SEQ ID NO: 16897 - DNA, 20 bp, Artificial Sequence
  Artificially Synthesized Primer Sequence
agttcgactccgtaacccct

SEQ ID NO: 16898 - DNA, 20 bp, Artificial Sequence
  Artificially Synthesized Primer Sequence
tgaagcagggtaattcgacc

SEQ ID NO: 16899 - DNA, 20 bp, Artificial Sequence
  Artificially Synthesized Primer Sequence
catccatgatctctgccctt

SEQ ID NO: 16900 - DNA, 21 bp, Artificial Sequence
  Artificially Synthesized Primer Sequence
ctgcatgggagatgtaagagg

SEQ ID NO: 16901 - DNA, 20 bp, Artificial Sequence
  Artificially Synthesized Primer Sequence
aattcctcgagcactgttgg

SEQ ID NO: 16902 - DNA, 19 bp, Artificial Sequence
  Artificially Synthesized Primer Sequence
actcgtggaactcgtcgtg

SEQ ID NO: 16903 - DNA, 20 bp, Artificial Sequence
  Artificially Synthesized Primer Sequence
tgcacacgaacatagcacaa

SEQ ID NO: 16904 - DNA, 19 bp, Artificial Sequence
  Artificially Synthesized Primer Sequence
gtcatgtccgggaaagagg

SEQ ID NO: 16905 - DNA, 20 bp, Artificial Sequence
  Artificially Synthesized Primer Sequence
tgaatgaccctaatgcacca

SEQ ID NO: 16906 - DNA, 20 bp, Artificial Sequence
  Artificially Synthesized Primer Sequence
atcatcgatccaagcactcc

SEQ ID NO: 16907 - DNA, 20 bp, Artificial Sequence
  Artificially Synthesized Primer Sequence
atcatcgatccaagcactcc

SEQ ID NO: 16908 - DNA, 20 bp, Artificial Sequence
  Artificially Synthesized Primer Sequence
caaggcggagatctgacaat

SEQ ID NO: 16909 - DNA, 20 bp, Artificial Sequence
  Artificially Synthesized Primer Sequence
gctctgctgggttcatcttc

SEQ ID NO: 16910 - DNA, 20 bp, Artificial Sequence
  Artificially Synthesized Primer Sequence
aagattgccaggagcgagta

SEQ ID NO: 16911 - DNA, 20 bp, Artificial Sequence
  Artificially Synthesized Primer Sequence
ttaccgaattacgtcggctc

SEQ ID NO: 16912 - DNA, 20 bp, Artificial Sequence
  Artificially Synthesized Primer Sequence
cagccagaagagacagggac

SEQ ID NO: 16913 - DNA, 20 bp, Artificial Sequence
  Artificially Synthesized Primer Sequence
tcatggagacatggaccaga

SEQ ID NO: 16914 - DNA, 20 bp, Artificial Sequence
  Artificially Synthesized Primer Sequence
cgatcacagaaggtcagcaa

SEQ ID NO: 16915 - DNA, 20 bp, Artificial Sequence
  Artificially Synthesized Primer Sequence
gattgcaggattacatgcga

SEQ ID NO: 16916 - DNA, 20 bp, Artificial Sequence
  Artificially Synthesized Primer Sequence
ttgctgaccttctgtgatcg

SEQ ID NO: 16917 - DNA, 20 bp, Artificial Sequence
  Artificially Synthesized Primer Sequence
catttcctgagagctccgac

SEQ ID NO: 16918 - DNA, 20 bp, Artificial Sequence
  Artificially Synthesized Primer Sequence
tgtcataggcccactcattg

SEQ ID NO: 16919 - DNA, 20 bp, Artificial Sequence
  Artificially Synthesized Primer Sequence
aatgcgacaccgtgatgata

SEQ ID NO: 16920 - DNA, 20 bp, Artificial Sequence
  Artificially Synthesized Primer Sequence
tcaaggcaggaataccgaag

SEQ ID NO: 16921 - DNA, 20 bp, Artificial Sequence
  Artificially Synthesized Primer Sequence
gaaggtgctgaagaagtgcc

SEQ ID NO: 16922 - DNA, 20 bp, Artificial Sequence
  Artificially Synthesized Primer Sequence
atcacggactaagtgtcccg

SEQ ID NO: 16923 - DNA, 21 bp, Artificial Sequence
  Artificially Synthesized Primer Sequence
gagattgccggacataattga

SEQ ID NO: 16924 - DNA, 19 bp, Artificial Sequence
  Artificially Synthesized Primer Sequence
gcggagaggaaaaggtacg

SEQ ID NO: 16925 - DNA, 20 bp, Artificial Sequence
  Artificially Synthesized Primer Sequence
tagaaccccactgccatctc

SEQ ID NO: 16926 - DNA, 20 bp, Artificial Sequence
  Artificially Synthesized Primer Sequence
gccaaactaaaccgcaaaaa

SEQ ID NO: 16927 - DNA, 20 bp, Artificial Sequence
  Artificially Synthesized Primer Sequence
gatgctacaatggagggcat

SEQ ID NO: 16928 - DNA, 20 bp, Artificial Sequence
  Artificially Synthesized Primer Sequence
cgagctaatcatctcctggg

SEQ ID NO: 16929 - DNA, 20 bp, Artificial Sequence
  Artificially Synthesized Primer Sequence
gtgttgcatggcttaccctt

SEQ ID NO: 16930 - DNA, 20 bp, Artificial Sequence
  Artificially Synthesized Primer Sequence
gcttcatgcttcttccaagc

SEQ ID NO: 16931 - DNA, 20 bp, Artificial Sequence
  Artificially Synthesized Primer Sequence
tccagtgctcttcgatcctt

SEQ ID NO: 16932 - DNA, 20 bp, Artificial Sequence
  Artificially Synthesized Primer Sequence
aaggagtcagccacgagaaa

SEQ ID NO: 16933 - DNA, 20 bp, Artificial Sequence
  Artificially Synthesized Primer Sequence
accattgctcctccaatgtc

SEQ ID NO: 16934 - DNA, 20 bp, Artificial Sequence
  Artificially Synthesized Primer Sequence
atcgcacatgaagcagacag

SEQ ID NO: 16935 - DNA, 20 bp, Artificial Sequence
  Artificially Synthesized Primer Sequence
acttcgacaaaggacgctgt

SEQ ID NO: 16936 - DNA, 20 bp, Artificial Sequence
  Artificially Synthesized Primer Sequence
ctactaccgccagaagccac

SEQ ID NO: 16937 - DNA, 20 bp, Artificial Sequence
  Artificially Synthesized Primer Sequence
cgctccaattaagcttcgtc

SEQ ID NO: 16938 - DNA, 20 bp, Artificial Sequence
  Artificially Synthesized Primer Sequence
tgcctgagattgtcgatgag

SEQ ID NO: 16939 - DNA, 20 bp, Artificial Sequence
  Artificially Synthesized Primer Sequence
tgtggaatgagtgggaacaa

SEQ ID NO: 16940 - DNA, 20 bp, Artificial Sequence
  Artificially Synthesized Primer Sequence
ggttggatccgctagctaca

SEQ ID NO: 16941 - DNA, 20 bp, Artificial Sequence
  Artificially Synthesized Primer Sequence
ggtcagctaggccttttcct

SEQ ID NO: 16942 - DNA, 20 bp, Artificial Sequence
  Artificially Synthesized Primer Sequence
acgactcgactgaggcactt

SEQ ID NO: 16943 - DNA, 20 bp, Artificial Sequence
  Artificially Synthesized Primer Sequence
acgacgacgaaggtactgct

SEQ ID NO: 16944 - DNA, 20 bp, Artificial Sequence
  Artificially Synthesized Primer Sequence
tctattcctcagtggcctcg

SEQ ID NO: 16945 - DNA, 20 bp, Artificial Sequence
  Artificially Synthesized Primer Sequence
ttgtgtccccgttactgaca

SEQ ID NO: 16946 - DNA, 20 bp, Artificial Sequence
  Artificially Synthesized Primer Sequence
cccaatgtgtgagaccactg

SEQ ID NO: 16947 - DNA, 20 bp, Artificial Sequence
  Artificially Synthesized Primer Sequence
aattgagccattgcttctgg

SEQ ID NO: 16948 - DNA, 20 bp, Artificial Sequence
  Artificially Synthesized Primer Sequence
cgatgatggggaaagctaaa

SEQ ID NO: 16949 - DNA, 20 bp, Artificial Sequence
  Artificially Synthesized Primer Sequence
ctggctcttccttcacaagc

SEQ ID NO: 16950 - DNA, 20 bp, Artificial Sequence
  Artificially Synthesized Primer Sequence
cgagcgacaacgacatctta

SEQ ID NO: 16951 - DNA, 20 bp, Artificial Sequence
  Artificially Synthesized Primer Sequence
acatccttgcttgcttgctt

SEQ ID NO: 16952 - DNA, 20 bp, Artificial Sequence
  Artificially Synthesized Primer Sequence
cacccagtggctctggtact

SEQ ID NO: 16953 - DNA, 20 bp, Artificial Sequence
  Artificially Synthesized Primer Sequence
tcttccttccatccatccag

SEQ ID NO: 16954 - DNA, 20 bp, Artificial Sequence
  Artificially Synthesized Primer Sequence
ctggccattgttgaggatct

SEQ ID NO: 16955 - DNA, 20 bp, Artificial Sequence
  Artificially Synthesized Primer Sequence
tacagacacccccatcttcc

SEQ ID NO: 16956 - DNA, 20 bp, Artificial Sequence
  Artificially Synthesized Primer Sequence
ggcgaatggtacaatcagga

SEQ ID NO: 16957 - DNA, 20 bp, Artificial Sequence
  Artificially Synthesized Primer Sequence
tgtcatcaagagcagatgcc

SEQ ID NO: 16958 - DNA, 20 bp, Artificial Sequence
  Artificially Synthesized Primer Sequence
gcaacacacggaaaaatgtg

SEQ ID NO: 16959 - DNA, 22 bp, Artificial Sequence
  Artificially Synthesized Primer Sequence
cgggactcatttacgaagtagc

SEQ ID NO: 16960 - DNA, 20 bp, Artificial Sequence
  Artificially Synthesized Primer Sequence
ggaggaaaataggcacggat

SEQ ID NO: 16961 - DNA, 20 bp, Artificial Sequence
  Artificially Synthesized Primer Sequence
gaaactttttcctcccagcc

SEQ ID NO: 16962 - DNA, 20 bp, Artificial Sequence
  Artificially Synthesized Primer Sequence
ggaaaaacagagagcatggc

SEQ ID NO: 16963 - DNA, 20 bp, Artificial Sequence
  Artificially Synthesized Primer Sequence
ggaaaaacagagagcatggc

SEQ ID NO: 16964 - DNA, 20 bp, Artificial Sequence
  Artificially Synthesized Primer Sequence
gaaactttttcctcccagcc

SEQ ID NO: 16965 - DNA, 20 bp, Artificial Sequence
  Artificially Synthesized Primer Sequence
acaaactctgcctcacgctt

SEQ ID NO: 16966 - DNA, 20 bp, Artificial Sequence
  Artificially Synthesized Primer Sequence
ggcgagagatactgctttgg

SEQ ID NO: 16967 - DNA, 20 bp, Artificial Sequence
  Artificially Synthesized Primer Sequence
atcgctttttcgcaaactgt

SEQ ID NO: 16968 - DNA, 20 bp, Artificial Sequence
  Artificially Synthesized Primer Sequence
gaatggccatatggttcctg

SEQ ID NO: 16969 - DNA, 20 bp, Artificial Sequence
  Artificially Synthesized Primer Sequence
acggagagcagctgacattt

SEQ ID NO: 16970 - DNA, 20 bp, Artificial Sequence
  Artificially Synthesized Primer Sequence
ccctaggtaaacacaggcca

SEQ ID NO: 16971 - DNA, 20 bp, Artificial Sequence
  Artificially Synthesized Primer Sequence
agcaatcacacgcaagtcac

SEQ ID NO: 16972 - DNA, 20 bp, Artificial Sequence
  Artificially Synthesized Primer Sequence
gtcccatctggcattgagtt

SEQ ID NO: 16973 - DNA, 20 bp, Artificial Sequence
  Artificially Synthesized Primer Sequence
ccgagaaggactacgacgag

SEQ ID NO: 16974 - DNA, 20 bp, Artificial Sequence
  Artificially Synthesized Primer Sequence
cacagatagtgaagcgcgac

SEQ ID NO: 16975 - DNA, 20 bp, Artificial Sequence
  Artificially Synthesized Primer Sequence
cgacgatgcataatgctcaa

SEQ ID NO: 16976 - DNA, 20 bp, Artificial Sequence
  Artificially Synthesized Primer Sequence
ggctccagctagggtttctc

SEQ ID NO: 16977 - DNA, 20 bp, Artificial Sequence
  Artificially Synthesized Primer Sequence
gcgtccatagagtcagcaca

SEQ ID NO: 16978 - DNA, 20 bp, Artificial Sequence
  Artificially Synthesized Primer Sequence
taacgccgatgttaccatga

SEQ ID NO: 16979 - DNA, 20 bp, Artificial Sequence
  Artificially Synthesized Primer Sequence
cagcctaatttgagcaccgt

SEQ ID NO: 16980 - DNA, 20 bp, Artificial Sequence
  Artificially Synthesized Primer Sequence
tgtacccgccaataaccttc

SEQ ID NO: 16981 - DNA, 20 bp, Artificial Sequence
  Artificially Synthesized Primer Sequence
gatcagaaaagtcccgtcca

SEQ ID NO: 16982 - DNA, 20 bp, Artificial Sequence
  Artificially Synthesized Primer Sequence
ggccttgtagttgtggtggt

SEQ ID NO: 16983 - DNA, 20 bp, Artificial Sequence
  Artificially Synthesized Primer Sequence
ttccactgctcagcacagtt

SEQ ID NO: 16984 - DNA, 20 bp, Artificial Sequence
  Artificially Synthesized Primer Sequence
gatcagaaaagtcccgtcca

SEQ ID NO: 16985 - DNA, 20 bp, Artificial Sequence
  Artificially Synthesized Primer Sequence
ttctagagagaagcgagcgg

SEQ ID NO: 16986 - DNA, 20 bp, Artificial Sequence
  Artificially Synthesized Primer Sequence
cctgaatcagcgaggctaac

SEQ ID NO: 16987 - DNA, 20 bp, Artificial Sequence
  Artificially Synthesized Primer Sequence
tagcatggggaaaacctgac

SEQ ID NO: 16988 - DNA, 20 bp, Artificial Sequence
  Artificially Synthesized Primer Sequence
acttgtgggcaaaagcaatc

SEQ ID NO: 16989 - DNA, 20 bp, Artificial Sequence
  Artificially Synthesized Primer Sequence
caccattgacaacgtgaagg

SEQ ID NO: 16990 - DNA, 20 bp, Artificial Sequence
  Artificially Synthesized Primer Sequence
caccaagtgaagggtggact

SEQ ID NO: 16991 - DNA, 20 bp, Artificial Sequence
  Artificially Synthesized Primer Sequence
gacgacagacagacacccct

SEQ ID NO: 16992 - DNA, 20 bp, Artificial Sequence
  Artificially Synthesized Primer Sequence
caccctggctgactacaaca

SEQ ID NO: 16993 - DNA, 20 bp, Artificial Sequence
  Artificially Synthesized Primer Sequence
tgctatgcttgcatctcagg

SEQ ID NO: 16994 - DNA, 20 bp, Artificial Sequence
  Artificially Synthesized Primer Sequence
taggatccacgcaacattca

SEQ ID NO: 16995 - DNA, 20 bp, Artificial Sequence
  Artificially Synthesized Primer Sequence
gcaggactacccagagagga

SEQ ID NO: 16996 - DNA, 20 bp, Artificial Sequence
  Artificially Synthesized Primer Sequence
ctgacttgtctgggagggaa

SEQ ID NO: 16997 - DNA, 20 bp, Artificial Sequence
  Artificially Synthesized Primer Sequence
aagatgcatgttagggtcgg

SEQ ID NO: 16998 - DNA, 20 bp, Artificial Sequence
  Artificially Synthesized Primer Sequence
acattgagagcatgtgcagc

SEQ ID NO: 16999 - DNA, 20 bp, Artificial Sequence
  Artificially Synthesized Primer Sequence
acattgagagcatgtgcagc

SEQ ID NO: 17000 - DNA, 20 bp, Artificial Sequence
  Artificially Synthesized Primer Sequence
aagatgcatgttagggtcgg

SEQ ID NO: 17001 - DNA, 20 bp, Artificial Sequence
  Artificially Synthesized Primer Sequence
gatttagcgcacaagcatga

SEQ ID NO: 17002 - DNA, 20 bp, Artificial Sequence
  Artificially Synthesized Primer Sequence
cagcatgggttggtaggtct

SEQ ID NO: 17003 - DNA, 20 bp, Artificial Sequence
  Artificially Synthesized Primer Sequence
tcagctccatcaacacttcg

SEQ ID NO: 17004 - DNA, 20 bp, Artificial Sequence
  Artificially Synthesized Primer Sequence
agctggtgatagggcatttg

SEQ ID NO: 17005 - DNA, 20 bp, Artificial Sequence
  Artificially Synthesized Primer Sequence
ggcggtggtgaacatagagt

SEQ ID NO: 17006 - DNA, 20 bp, Artificial Sequence
  Artificially Synthesized Primer Sequence
acctcatactcccgaacacg

SEQ ID NO: 17007 - DNA, 20 bp, Artificial Sequence
  Artificially Synthesized Primer Sequence
tggctactgaaaactgcacg

SEQ ID NO: 17008 - DNA, 20 bp, Artificial Sequence
  Artificially Synthesized Primer Sequence
aagttgagctgtggctgagg

SEQ ID NO: 17009 - DNA, 20 bp, Artificial Sequence
  Artificially Synthesized Primer Sequence
gccttcaaacccatctcaaa

SEQ ID NO: 17010 - DNA, 20 bp, Artificial Sequence
  Artificially Synthesized Primer Sequence
caggcaccaaccctgtctat

SEQ ID NO: 17011 - DNA, 20 bp, Artificial Sequence
  Artificially Synthesized Primer Sequence
ctatgcagaacaggatgcga

SEQ ID NO: 17012 - DNA, 20 bp, Artificial Sequence
  Artificially Synthesized Primer Sequence
gccttcaaacccatctcaaa

SEQ ID NO: 17013 - DNA, 20 bp, Artificial Sequence
  Artificially Synthesized Primer Sequence
tggtgtcgttgcatttgttt

SEQ ID NO: 17014 - DNA, 20 bp, Artificial Sequence
  Artificially Synthesized Primer Sequence
gttccacccacgatgtaacc

SEQ ID NO: 17015 - DNA, 20 bp, Artificial Sequence
  Artificially Synthesized Primer Sequence
gccgaaatacgtctcacaca

SEQ ID NO: 17016 - DNA, 20 bp, Artificial Sequence
  Artificially Synthesized Primer Sequence
cacctctccgacgaactctc

SEQ ID NO: 17017 - DNA, 20 bp, Artificial Sequence
  Artificially Synthesized Primer Sequence
ctgtggagagattcatcgca

SEQ ID NO: 17018 - DNA, 20 bp, Artificial Sequence
  Artificially Synthesized Primer Sequence
gaagtacaccggcacctcat

SEQ ID NO: 17019 - DNA, 20 bp, Artificial Sequence
  Artificially Synthesized Primer Sequence
tacaacaacaatggggagca

SEQ ID NO: 17020 - DNA, 20 bp, Artificial Sequence
  Artificially Synthesized Primer Sequence
tgaacttgtgtcagggacca

SEQ ID NO: 17021 - DNA, 20 bp, Artificial Sequence
  Artificially Synthesized Primer Sequence
ggtaagcagctcgaagatgg

SEQ ID NO: 17022 - DNA, 20 bp, Artificial Sequence
  Artificially Synthesized Primer Sequence
ccttgacgttgtcaatggtg

SEQ ID NO: 17023 - DNA, 20 bp, Artificial Sequence
  Artificially Synthesized Primer Sequence
gctcacttgattcagggctc

SEQ ID NO: 17024 - DNA, 20 bp, Artificial Sequence
  Artificially Synthesized Primer Sequence
agtcctcggacaccattgac

SEQ ID NO: 17025 - DNA, 20 bp, Artificial Sequence
  Artificially Synthesized Primer Sequence
tctctcgtcctcctccttca

SEQ ID NO: 17026 - DNA, 20 bp, Artificial Sequence
  Artificially Synthesized Primer Sequence
ggagtgtggactccttctgg

SEQ ID NO: 17027 - DNA, 20 bp, Artificial Sequence
  Artificially Synthesized Primer Sequence
agacaccgagccttgtgaac

SEQ ID NO: 17028 - DNA, 20 bp, Artificial Sequence
  Artificially Synthesized Primer Sequence
accagcagcgtctcatcttt

SEQ ID NO: 17029 - DNA, 20 bp, Artificial Sequence
  Artificially Synthesized Primer Sequence
ggtaagcagctcgaagatgg

SEQ ID NO: 17030 - DNA, 20 bp, Artificial Sequence
  Artificially Synthesized Primer Sequence
gctcacttgattcagggctc

SEQ ID NO: 17031 - DNA, 20 bp, Artificial Sequence
  Artificially Synthesized Primer Sequence
aagacaccaacgacagaccc

SEQ ID NO: 17032 - DNA, 20 bp, Artificial Sequence
  Artificially Synthesized Primer Sequence
agaaggagtccaccctccac

SEQ ID NO: 17033 - DNA, 20 bp, Artificial Sequence
  Artificially Synthesized Primer Sequence
gcttcgaggactacgtcgag

SEQ ID NO: 17034 - DNA, 20 bp, Artificial Sequence
  Artificially Synthesized Primer Sequence
tagaggtgttaccaacgccc

SEQ ID NO: 17035 - DNA, 20 bp, Artificial Sequence
  Artificially Synthesized Primer Sequence
tagaggtgttaccaacgccc

SEQ ID NO: 17036 - DNA, 20 bp, Artificial Sequence
  Artificially Synthesized Primer Sequence
agaagcgcaagaccatcaac

SEQ ID NO: 17037 - DNA, 20 bp, Artificial Sequence
  Artificially Synthesized Primer Sequence
ccctttttctgctcaagtcg

SEQ ID NO: 17038 - DNA, 20 bp, Artificial Sequence
  Artificially Synthesized Primer Sequence
tgctgaaaagatcaaacccc

SEQ ID NO: 17039 - DNA, 20 bp, Artificial Sequence
  Artificially Synthesized Primer Sequence
gctgaaaagatcaaacccca

SEQ ID NO: 17040 - DNA, 20 bp, Artificial Sequence
  Artificially Synthesized Primer Sequence
ggtgtgacatttgttgctgc

SEQ ID NO: 17041 - DNA, 20 bp, Artificial Sequence
  Artificially Synthesized Primer Sequence
agaacgatgttagcatcccg

SEQ ID NO: 17042 - DNA, 20 bp, Artificial Sequence
  Artificially Synthesized Primer Sequence
aagaggaaaggaaagcgagg

SEQ ID NO: 17043 - DNA, 20 bp, Artificial Sequence
  Artificially Synthesized Primer Sequence
cggagccaagagtttttgag

SEQ ID NO: 17044 - DNA, 20 bp, Artificial Sequence
  Artificially Synthesized Primer Sequence
ccgagaccgtgagaaaagag

SEQ ID NO: 17045 - DNA, 20 bp, Artificial Sequence
  Artificially Synthesized Primer Sequence
attccagcatctgacaaggg

SEQ ID NO: 17046 - DNA, 20 bp, Artificial Sequence
  Artificially Synthesized Primer Sequence
gcttcaaaccctcaacaagc

SEQ ID NO: 17047 - DNA, 20 bp, Artificial Sequence
  Artificially Synthesized Primer Sequence
atcagaagccatgatgtccc

SEQ ID NO: 17048 - DNA, 20 bp, Artificial Sequence
  Artificially Synthesized Primer Sequence
ttgttctccacactgatgcc

SEQ ID NO: 17049 - DNA, 20 bp, Artificial Sequence
  Artificially Synthesized Primer Sequence
gttcctgctcaagttcctcg

SEQ ID NO: 17050 - DNA, 20 bp, Artificial Sequence
  Artificially Synthesized Primer Sequence
ttgacaaaggagacgaggct

SEQ ID NO: 17051 - DNA, 20 bp, Artificial Sequence
  Artificially Synthesized Primer Sequence
gccgtactgcattttgatcc

SEQ ID NO: 17052 - DNA, 20 bp, Artificial Sequence
  Artificially Synthesized Primer Sequence
atccaggatctgccgtatga

SEQ ID NO: 17053 - DNA, 20 bp, Artificial Sequence
  Artificially Synthesized Primer Sequence
cgaatacggcctcttggata

SEQ ID NO: 17054 - DNA, 20 bp, Artificial Sequence
  Artificially Synthesized Primer Sequence
ccctgccgaaaataaactga

SEQ ID NO: 17055 - DNA, 20 bp, Artificial Sequence
  Artificially Synthesized Primer Sequence
tcgagccacttcagagaagg

SEQ ID NO: 17056 - DNA, 20 bp, Artificial Sequence
  Artificially Synthesized Primer Sequence
cagcttgtgtgcctgaacat

SEQ ID NO: 17057 - DNA, 20 bp, Artificial Sequence
  Artificially Synthesized Primer Sequence
ttgcattcctgttgaagctg

SEQ ID NO: 17058 - DNA, 20 bp, Artificial Sequence
  Artificially Synthesized Primer Sequence
ttgagcattgagccctctct

SEQ ID NO: 17059 - DNA, 20 bp, Artificial Sequence
  Artificially Synthesized Primer Sequence
gcctcggcgatcctatttat

SEQ ID NO: 17060 - DNA, 20 bp, Artificial Sequence
  Artificially Synthesized Primer Sequence
ggtgaaatgctacgaccgat

SEQ ID NO: 17061 - DNA, 20 bp, Artificial Sequence
  Artificially Synthesized Primer Sequence
ttggtgctatgtaccgtgga

SEQ ID NO: 17062 - DNA, 20 bp, Artificial Sequence
  Artificially Synthesized Primer Sequence
gagagatcgaaaccttcccc

SEQ ID NO: 17063 - DNA, 20 bp, Artificial Sequence
  Artificially Synthesized Primer Sequence
aaccaacaaccgacctcaac

SEQ ID NO: 17064 - DNA, 20 bp, Artificial Sequence
  Artificially Synthesized Primer Sequence
agaaaggtcatgcgagctgt

SEQ ID NO: 17065 - DNA, 20 bp, Artificial Sequence
  Artificially Synthesized Primer Sequence
gcctacgaacgaagatcagc

SEQ ID NO: 17066 - DNA, 20 bp, Artificial Sequence
  Artificially Synthesized Primer Sequence
ccatggctaaactctaggcg

SEQ ID NO: 17067 - DNA, 20 bp, Artificial Sequence
  Artificially Synthesized Primer Sequence
gcctacgaacgaagatcagc

SEQ ID NO: 17068 - DNA, 20 bp, Artificial Sequence
  Artificially Synthesized Primer Sequence
ctgccaccattgtgattctg

SEQ ID NO: 17069 - DNA, 20 bp, Artificial Sequence
  Artificially Synthesized Primer Sequence
ccccacagagtgtgtgtgac

SEQ ID NO: 17070 - DNA, 20 bp, Artificial Sequence
  Artificially Synthesized Primer Sequence
gcacacacagagagagcgag

SEQ ID NO: 17071 - DNA, 20 bp, Artificial Sequence
  Artificially Synthesized Primer Sequence
ccgacgtttagaacgggtaa

SEQ ID NO: 17072 - DNA, 20 bp, Artificial Sequence
  Artificially Synthesized Primer Sequence
aacgtcaagtcaagcgtgtg

SEQ ID NO: 17073 - DNA, 20 bp, Artificial Sequence
  Artificially Synthesized Primer Sequence
gaacatgtcgttcagggagg

SEQ ID NO: 17074 - DNA, 20 bp, Artificial Sequence
  Artificially Synthesized Primer Sequence
tccaccttcaccttcacctt

SEQ ID NO: 17075 - DNA, 20 bp, Artificial Sequence
  Artificially Synthesized Primer Sequence
aattccacggcaaaacaatg

SEQ ID NO: 17076 - DNA, 20 bp, Artificial Sequence
  Artificially Synthesized Primer Sequence
agatttgggggcagattctt

SEQ ID NO: 17077 - DNA, 20 bp, Artificial Sequence
  Artificially Synthesized Primer Sequence
catgcgaacgtgcatatttc

SEQ ID NO: 17078 - DNA, 20 bp, Artificial Sequence
  Artificially Synthesized Primer Sequence
ggtagctgcgttctctggtc

SEQ ID NO: 17079 - DNA, 20 bp, Artificial Sequence
  Artificially Synthesized Primer Sequence
gcgatgagaactttccaagc

SEQ ID NO: 17080 - DNA, 20 bp, Artificial Sequence
  Artificially Synthesized Primer Sequence
caagcaacatagcaggagca

SEQ ID NO: 17081 - DNA, 20 bp, Artificial Sequence
  Artificially Synthesized Primer Sequence
gctatgccagatttttccca

SEQ ID NO: 17082 - DNA, 20 bp, Artificial Sequence
  Artificially Synthesized Primer Sequence
agcatcatctcggaagctgt

SEQ ID NO: 17083 - DNA, 20 bp, Artificial Sequence
  Artificially Synthesized Primer Sequence
agcatcatctcggaagctgt

SEQ ID NO: 17084 - DNA, 20 bp, Artificial Sequence
  Artificially Synthesized Primer Sequence
gggcatttgcagaggttaaa

SEQ ID NO: 17085 - DNA, 20 bp, Artificial Sequence
  Artificially Synthesized Primer Sequence
caaggcattgcttcacttca

SEQ ID NO: 17086 - DNA, 20 bp, Artificial Sequence
  Artificially Synthesized Primer Sequence
acccatcaaggcatcatctc

SEQ ID NO: 17087 - DNA, 20 bp, Artificial Sequence
  Artificially Synthesized Primer Sequence
gcaagttgcacacaagcaat

SEQ ID NO: 17088 - DNA, 19 bp, Artificial Sequence
  Artificially Synthesized Primer Sequence
agcgacgtctctggctctt

SEQ ID NO: 17089 - DNA, 20 bp, Artificial Sequence
  Artificially Synthesized Primer Sequence
cccaccatcaagttcctcat

SEQ ID NO: 17090 - DNA, 20 bp, Artificial Sequence
  Artificially Synthesized Primer Sequence
cctccatctggtaaagcagc

SEQ ID NO: 17091 - DNA, 20 bp, Artificial Sequence
  Artificially Synthesized Primer Sequence
ttgagagatgtttgctccca

SEQ ID NO: 17092 - DNA, 20 bp, Artificial Sequence
  Artificially Synthesized Primer Sequence
tgatatcacagcacaaggcg

SEQ ID NO: 17093 - DNA, 20 bp, Artificial Sequence
  Artificially Synthesized Primer Sequence
cgaaagtagtggccgagaag

SEQ ID NO: 17094 - DNA, 20 bp, Artificial Sequence
  Artificially Synthesized Primer Sequence
aataaccagcaggtggcaag

SEQ ID NO: 17095 - DNA, 20 bp, Artificial Sequence
  Artificially Synthesized Primer Sequence
ggtcgatcacacagaagcag

SEQ ID NO: 17096 - DNA, 20 bp, Artificial Sequence
  Artificially Synthesized Primer Sequence
cagcgactgctgatactgga

SEQ ID NO: 17097 - DNA, 20 bp, Artificial Sequence
  Artificially Synthesized Primer Sequence
ccaatgctgatggacacaag

SEQ ID NO: 17098 - DNA, 20 bp, Artificial Sequence
  Artificially Synthesized Primer Sequence
ccaccggtgttcaatcttct

SEQ ID NO: 17099 - DNA, 20 bp, Artificial Sequence
  Artificially Synthesized Primer Sequence
ccaccggtgttcaatcttct

SEQ ID NO: 17100 - DNA, 20 bp, Artificial Sequence
  Artificially Synthesized Primer Sequence
ccaatgctgatggacacaag

SEQ ID NO: 17101 - DNA, 20 bp, Artificial Sequence
  Artificially Synthesized Primer Sequence
ttgacactcacctcgctgtc

SEQ ID NO: 17102 - DNA, 20 bp, Artificial Sequence
  Artificially Synthesized Primer Sequence
accagatgggcactacttgg

SEQ ID NO: 17103 - DNA, 20 bp, Artificial Sequence
  Artificially Synthesized Primer Sequence
aggtggcaaacatttaacgg

SEQ ID NO: 17104 - DNA, 20 bp, Artificial Sequence
  Artificially Synthesized Primer Sequence
tatgtgatgggaggtgcctt

SEQ ID NO: 17105 - DNA, 20 bp, Artificial Sequence
  Artificially Synthesized Primer Sequence
ccaagtggaaccggaataaa

SEQ ID NO: 17106 - DNA, 20 bp, Artificial Sequence
  Artificially Synthesized Primer Sequence
tgagcacactccctgcatag

SEQ ID NO: 17107 - DNA, 20 bp, Artificial Sequence
  Artificially Synthesized Primer Sequence
ctttgccgaaatcagggtaa

SEQ ID NO: 17108 - DNA, 20 bp, Artificial Sequence
  Artificially Synthesized Primer Sequence
tacggtattggggacaggaa

SEQ ID NO: 17109 - DNA, 20 bp, Artificial Sequence
  Artificially Synthesized Primer Sequence
aattcctcgagcactgttgg

SEQ ID NO: 17110 - DNA, 20 bp, Artificial Sequence
  Artificially Synthesized Primer Sequence
atgatggacggccagtagtc

SEQ ID NO: 17111 - DNA, 20 bp, Artificial Sequence
  Artificially Synthesized Primer Sequence
cgcactcgtccaagtttaca

SEQ ID NO: 17112 - DNA, 20 bp, Artificial Sequence
  Artificially Synthesized Primer Sequence
tgctcttcatgttcgtcgtc

SEQ ID NO: 17113 - DNA, 20 bp, Artificial Sequence
  Artificially Synthesized Primer Sequence
gaagcttaagattggcgtgc

SEQ ID NO: 17114 - DNA, 20 bp, Artificial Sequence
  Artificially Synthesized Primer Sequence
aaccaacgatcatgctgtca

SEQ ID NO: 17115 - DNA, 20 bp, Artificial Sequence
  Artificially Synthesized Primer Sequence
gcacgaacgatcagtagcaa

SEQ ID NO: 17116 - DNA, 19 bp, Artificial Sequence
  Artificially Synthesized Primer Sequence
aggagtgggcagcactgtt

SEQ ID NO: 17117 - DNA, 22 bp, Artificial Sequence
  Artificially Synthesized Primer Sequence
tcgagttaacccaacttgaaca

SEQ ID NO: 17118 - DNA, 20 bp, Artificial Sequence
  Artificially Synthesized Primer Sequence
atcaagctcaatgtccccat

SEQ ID NO: 17119 - DNA, 20 bp, Artificial Sequence
  Artificially Synthesized Primer Sequence
aaccagtaagagcaatggcg

SEQ ID NO: 17120 - DNA, 20 bp, Artificial Sequence
  Artificially Synthesized Primer Sequence
tcagatgggcagtgaagttg

SEQ ID NO: 17121 - DNA, 20 bp, Artificial Sequence
  Artificially Synthesized Primer Sequence
aagtgttcttgctcctccga

SEQ ID NO: 17122 - DNA, 20 bp, Artificial Sequence
  Artificially Synthesized Primer Sequence
cgtcgaaaaaggtgcttctc

SEQ ID NO: 17123 - DNA, 20 bp, Artificial Sequence
  Artificially Synthesized Primer Sequence
cgaacaccatcatggaacac

SEQ ID NO: 17124 - DNA, 20 bp, Artificial Sequence
  Artificially Synthesized Primer Sequence
acctttggagtgcaagctgt

SEQ ID NO: 17125 - DNA, 20 bp, Artificial Sequence
  Artificially Synthesized Primer Sequence
acggttggcatccttctatg

SEQ ID NO: 17126 - DNA, 20 bp, Artificial Sequence
  Artificially Synthesized Primer Sequence
aaaatggccaattcttgtcg

SEQ ID NO: 17127 - DNA, 20 bp, Artificial Sequence
  Artificially Synthesized Primer Sequence
gtccaccggtgttcaatctt

SEQ ID NO: 17128 - DNA, 20 bp, Artificial Sequence
  Artificially Synthesized Primer Sequence
gttcgaagaccctgcagaag

SEQ ID NO: 17129 - DNA, 20 bp, Artificial Sequence
  Artificially Synthesized Primer Sequence
tgtcattggaggagatgctg

SEQ ID NO: 17130 - DNA, 20 bp, Artificial Sequence
  Artificially Synthesized Primer Sequence
agttacgacatcaggcccac

SEQ ID NO: 17131 - DNA, 20 bp, Artificial Sequence
  Artificially Synthesized Primer Sequence
ctcgaaacaaggaaaatccg

SEQ ID NO: 17132 - DNA, 20 bp, Artificial Sequence
  Artificially Synthesized Primer Sequence
tccagaaccaggaagaatgg

SEQ ID NO: 17133 - DNA, 20 bp, Artificial Sequence
  Artificially Synthesized Primer Sequence
atcagagtggaggggaaggt

SEQ ID NO: 17134 - DNA, 20 bp, Artificial Sequence
  Artificially Synthesized Primer Sequence
tctgcttgtccaggtaggct

SEQ ID NO: 17135 - DNA, 20 bp, Artificial Sequence
  Artificially Synthesized Primer Sequence
ggtgggctgaaagacatcat

SEQ ID NO: 17136 - DNA, 20 bp, Artificial Sequence
  Artificially Synthesized Primer Sequence
atcagagtggaggggaaggt

SEQ ID NO: 17137 - DNA, 20 bp, Artificial Sequence
  Artificially Synthesized Primer Sequence
aattcctcgagcactgttgg

SEQ ID NO: 17138 - DNA, 20 bp, Artificial Sequence
  Artificially Synthesized Primer Sequence
gttcatagcggtaacgtcgg

SEQ ID NO: 17139 - DNA, 20 bp, Artificial Sequence
  Artificially Synthesized Primer Sequence
caccggtgtattggtcatca

SEQ ID NO: 17140 - DNA, 20 bp, Artificial Sequence
  Artificially Synthesized Primer Sequence
gggaatgttcaggaactgga

SEQ ID NO: 17141 - DNA, 20 bp, Artificial Sequence
  Artificially Synthesized Primer Sequence
gaagtccaagaagagcgtgg

SEQ ID NO: 17142 - DNA, 20 bp, Artificial Sequence
  Artificially Synthesized Primer Sequence
ttacacagcggcaagaacag

SEQ ID NO: 17143 - DNA, 20 bp, Artificial Sequence
  Artificially Synthesized Primer Sequence
gtgaagcgacaggggtaaga

SEQ ID NO: 17144 - DNA, 20 bp, Artificial Sequence
  Artificially Synthesized Primer Sequence
gaagtccaagaagagcgtgg

SEQ ID NO: 17145 - DNA, 20 bp, Artificial Sequence
  Artificially Synthesized Primer Sequence
catggagaaggaagggatca

SEQ ID NO: 17146 - DNA, 20 bp, Artificial Sequence
  Artificially Synthesized Primer Sequence
agccgttgtctgcaaagatt

SEQ ID NO: 17147 - DNA, 20 bp, Artificial Sequence
  Artificially Synthesized Primer Sequence
gcttccgccagtcagaatac

SEQ ID NO: 17148 - DNA, 20 bp, Artificial Sequence
  Artificially Synthesized Primer Sequence
catcatggagaaggaaggga

SEQ ID NO: 17149 - DNA, 20 bp, Artificial Sequence
  Artificially Synthesized Primer Sequence
gtccgtcgtcaactccaact

SEQ ID NO: 17150 - DNA, 20 bp, Artificial Sequence
  Artificially Synthesized Primer Sequence
gtgtaatcagccaccctcgt

SEQ ID NO: 17151 - DNA, 20 bp, Artificial Sequence
  Artificially Synthesized Primer Sequence
acatcttcgtgatctcggct

SEQ ID NO: 17152 - DNA, 20 bp, Artificial Sequence
  Artificially Synthesized Primer Sequence
ccacactttcctctgccttc

SEQ ID NO: 17153 - DNA, 20 bp, Artificial Sequence
  Artificially Synthesized Primer Sequence
gtgatcacggtgttgtggag

SEQ ID NO: 17154 - DNA, 20 bp, Artificial Sequence
  Artificially Synthesized Primer Sequence
taaaaggtggcgacacttcc

SEQ ID NO: 17155 - DNA, 20 bp, Artificial Sequence
  Artificially Synthesized Primer Sequence
taaaaggtggcgacacttcc

SEQ ID NO: 17156 - DNA, 20 bp, Artificial Sequence
  Artificially Synthesized Primer Sequence
atcaccaacgtcatcaatgg

SEQ ID NO: 17157 - DNA, 20 bp, Artificial Sequence
  Artificially Synthesized Primer Sequence
aacaaaatcggcaccagaac

SEQ ID NO: 17158 - DNA, 20 bp, Artificial Sequence
  Artificially Synthesized Primer Sequence
tcaatcgggtacgtttgaca

SEQ ID NO: 17159 - DNA, 20 bp, Artificial Sequence
  Artificially Synthesized Primer Sequence
tcacatcaccaaaacctcca

SEQ ID NO: 17160 - DNA, 20 bp, Artificial Sequence
  Artificially Synthesized Primer Sequence
gcaaaagatgtcgctgattg

SEQ ID NO: 17161 - DNA, 20 bp, Artificial Sequence
  Artificially Synthesized Primer Sequence
aaatcatcgaagaattgccg

SEQ ID NO: 17162 - DNA, 20 bp, Artificial Sequence
  Artificially Synthesized Primer Sequence
gtcactggcgcaagtatcaa

SEQ ID NO: 17163 - DNA, 20 bp, Artificial Sequence
  Artificially Synthesized Primer Sequence
cccaaaggccttacgaattt

SEQ ID NO: 17164 - DNA, 20 bp, Artificial Sequence
  Artificially Synthesized Primer Sequence
aaatcatcgaagaattgccg

SEQ ID NO: 17165 - DNA, 20 bp, Artificial Sequence
  Artificially Synthesized Primer Sequence
tatctcaaggaatggccagg

SEQ ID NO: 17166 - DNA, 20 bp, Artificial Sequence
  Artificially Synthesized Primer Sequence
ttcacacactgcagaaaggc

SEQ ID NO: 17167 - DNA, 20 bp, Artificial Sequence
  Artificially Synthesized Primer Sequence
gcgctggtcacagaagtaca

SEQ ID NO: 17168 - DNA, 20 bp, Artificial Sequence
  Artificially Synthesized Primer Sequence
gcctttctgcagtgtgtgaa

SEQ ID NO: 17169 - DNA, 20 bp, Artificial Sequence
  Artificially Synthesized Primer Sequence
aggtcatgtgtcgtgaacca

SEQ ID NO: 17170 - DNA, 20 bp, Artificial Sequence
  Artificially Synthesized Primer Sequence
aacagaggtaagggtgggct

SEQ ID NO: 17171 - DNA, 20 bp, Artificial Sequence
  Artificially Synthesized Primer Sequence
gcctttcatcttaaagccca

SEQ ID NO: 17172 - DNA, 20 bp, Artificial Sequence
  Artificially Synthesized Primer Sequence
ctgatgtgtcatacgagccg

SEQ ID NO: 17173 - DNA, 20 bp, Artificial Sequence
  Artificially Synthesized Primer Sequence
ggggcgtactaagggagaac

SEQ ID NO: 17174 - DNA, 20 bp, Artificial Sequence
  Artificially Synthesized Primer Sequence
atgcttctccagcaacgtct

SEQ ID NO: 17175 - DNA, 20 bp, Artificial Sequence
  Artificially Synthesized Primer Sequence
aattcaaatcatgcggtggt

SEQ ID NO: 17176 - DNA, 20 bp, Artificial Sequence
  Artificially Synthesized Primer Sequence
acggatatgcaaggagttgg

SEQ ID NO: 17177 - DNA, 20 bp, Artificial Sequence
  Artificially Synthesized Primer Sequence
gcacgaggatagacacagca

SEQ ID NO: 17178 - DNA, 20 bp, Artificial Sequence
  Artificially Synthesized Primer Sequence
aactcatttgatggccttgg

SEQ ID NO: 17179 - DNA, 20 bp, Artificial Sequence
  Artificially Synthesized Primer Sequence
tcaaatgagatttaccgggc

SEQ ID NO: 17180 - DNA, 20 bp, Artificial Sequence
  Artificially Synthesized Primer Sequence
ccaaggccatcaaatgagtt

SEQ ID NO: 17181 - DNA, 20 bp, Artificial Sequence
  Artificially Synthesized Primer Sequence
acttcaggctattggagcga

SEQ ID NO: 17182 - DNA, 20 bp, Artificial Sequence
  Artificially Synthesized Primer Sequence
tctcatcgtgcagaacaagg

SEQ ID NO: 17183 - DNA, 20 bp, Artificial Sequence
  Artificially Synthesized Primer Sequence
catagggccaactatcagcc

SEQ ID NO: 17184 - DNA, 20 bp, Artificial Sequence
  Artificially Synthesized Primer Sequence
gacttttggagcaacttggc

SEQ ID NO: 17185 - DNA, 20 bp, Artificial Sequence
  Artificially Synthesized Primer Sequence
gctaggaaggagggaacacc

SEQ ID NO: 17186 - DNA, 20 bp, Artificial Sequence
  Artificially Synthesized Primer Sequence
aaaatggggattttcccaag

SEQ ID NO: 17187 - DNA, 20 bp, Artificial Sequence
  Artificially Synthesized Primer Sequence
cgagcgtcttcagagtaggg

SEQ ID NO: 17188 - DNA, 20 bp, Artificial Sequence
  Artificially Synthesized Primer Sequence
gccttgcgtttagagtggtc

SEQ ID NO: 17189 - DNA, 20 bp, Artificial Sequence
  Artificially Synthesized Primer Sequence
aagatccacggcaagctcta

SEQ ID NO: 17190 - DNA, 20 bp, Artificial Sequence
  Artificially Synthesized Primer Sequence
tcagaacatagcctccccac

SEQ ID NO: 17191 - DNA, 20 bp, Artificial Sequence
  Artificially Synthesized Primer Sequence
aacagggatgtcgaaacagc

SEQ ID NO: 17192 - DNA, 20 bp, Artificial Sequence
  Artificially Synthesized Primer Sequence
gacaggatgacgagccattt

SEQ ID NO: 17193 - DNA, 20 bp, Artificial Sequence
  Artificially Synthesized Primer Sequence
tctggaagccttgacgaagt

SEQ ID NO: 17194 - DNA, 20 bp, Artificial Sequence
  Artificially Synthesized Primer Sequence
tcaactctcaatccccaagg

SEQ ID NO: 17195 - DNA, 20 bp, Artificial Sequence
  Artificially Synthesized Primer Sequence
gcaacaggtttgaaccaaca

SEQ ID NO: 17196 - DNA, 20 bp, Artificial Sequence
  Artificially Synthesized Primer Sequence
agcgacagaaggagttcgac

SEQ ID NO: 17197 - DNA, 20 bp, Artificial Sequence
  Artificially Synthesized Primer Sequence
ggacacaacccgattattgc

SEQ ID NO: 17198 - DNA, 20 bp, Artificial Sequence
  Artificially Synthesized Primer Sequence
tgtatcggacaaacggaaca

SEQ ID NO: 17199 - DNA, 20 bp, Artificial Sequence
  Artificially Synthesized Primer Sequence
ggtactgtgaacgacggcat

SEQ ID NO: 17200 - DNA, 19 bp, Artificial Sequence
  Artificially Synthesized Primer Sequence
gaacgtcacgctggcatac

SEQ ID NO: 17201 - DNA, 20 bp, Artificial Sequence
  Artificially Synthesized Primer Sequence
cctgctgggactcatttgat

SEQ ID NO: 17202 - DNA, 20 bp, Artificial Sequence
  Artificially Synthesized Primer Sequence
cagggacttgccaaattgtt

SEQ ID NO: 17203 - DNA, 22 bp, Artificial Sequence
  Artificially Synthesized Primer Sequence
tttttgacacactgacctcgat

SEQ ID NO: 17204 - DNA, 20 bp, Artificial Sequence
  Artificially Synthesized Primer Sequence
gatggtcggttttatggtcg

SEQ ID NO: 17205 - DNA, 20 bp, Artificial Sequence
  Artificially Synthesized Primer Sequence
gcagccttactgcaggtttc

SEQ ID NO: 17206 - DNA, 20 bp, Artificial Sequence
  Artificially Synthesized Primer Sequence
cacaaaaagcagaaggagcc

SEQ ID NO: 17207 - DNA, 20 bp, Artificial Sequence
  Artificially Synthesized Primer Sequence
atttggagtttgaattggcg

SEQ ID NO: 17208 - DNA, 20 bp, Artificial Sequence
  Artificially Synthesized Primer Sequence
tggtatgaatgtggtggtgg

SEQ ID NO: 17209 - DNA, 20 bp, Artificial Sequence
  Artificially Synthesized Primer Sequence
ggggttactgggggagaata

SEQ ID NO: 17210 - DNA, 20 bp, Artificial Sequence
  Artificially Synthesized Primer Sequence
ccgaagcactaaaccctttg

SEQ ID NO: 17211 - DNA, 20 bp, Artificial Sequence
  Artificially Synthesized Primer Sequence
cctcctgctgttactctggc

SEQ ID NO: 17212 - DNA, 20 bp, Artificial Sequence
  Artificially Synthesized Primer Sequence
catctagcactggacgacga

SEQ ID NO: 17213 - DNA, 20 bp, Artificial Sequence
  Artificially Synthesized Primer Sequence
cgagaagagggagtcacagg

SEQ ID NO: 17214 - DNA, 20 bp, Artificial Sequence
  Artificially Synthesized Primer Sequence
agcatgagcaaagcatgttg

SEQ ID NO: 17215 - DNA, 20 bp, Artificial Sequence
  Artificially Synthesized Primer Sequence
aaaaaggcggagttagcaca

SEQ ID NO: 17216 - DNA, 20 bp, Artificial Sequence
  Artificially Synthesized Primer Sequence
tggtatggcacttggggtat

SEQ ID NO: 17217 - DNA, 20 bp, Artificial Sequence
  Artificially Synthesized Primer Sequence
caggacccctacgtcatcat

SEQ ID NO: 17218 - DNA, 20 bp, Artificial Sequence
  Artificially Synthesized Primer Sequence
aatgagcatcacttccccag

SEQ ID NO: 17219 - DNA, 20 bp, Artificial Sequence
  Artificially Synthesized Primer Sequence
ggcaaacccgcaatatagaa

SEQ ID NO: 17220 - DNA, 20 bp, Artificial Sequence
  Artificially Synthesized Primer Sequence
ttatccaccacggccatatt

SEQ ID NO: 17221 - DNA, 20 bp, Artificial Sequence
  Artificially Synthesized Primer Sequence
atcgcctatccccatattcc

SEQ ID NO: 17222 - DNA, 20 bp, Artificial Sequence
  Artificially Synthesized Primer Sequence
tttgtgggaaacgaaaaagg

SEQ ID NO: 17223 - DNA, 20 bp, Artificial Sequence
  Artificially Synthesized Primer Sequence
gatggttgctaggctgttcg

SEQ ID NO: 17224 - DNA, 19 bp, Artificial Sequence
  Artificially Synthesized Primer Sequence
agccgtatccaccaccttc

SEQ ID NO: 17225 - DNA, 20 bp, Artificial Sequence
  Artificially Synthesized Primer Sequence
tgttttagggggataagggg

SEQ ID NO: 17226 - DNA, 20 bp, Artificial Sequence
  Artificially Synthesized Primer Sequence
ggcaaaacgtgtgtatgtgg

SEQ ID NO: 17227 - DNA, 20 bp, Artificial Sequence
  Artificially Synthesized Primer Sequence
gactaccgcaggaaccaaaa

SEQ ID NO: 17228 - DNA, 20 bp, Artificial Sequence
  Artificially Synthesized Primer Sequence
cagcacgctcttcttctgtg

SEQ ID NO: 17229 - DNA, 20 bp, Artificial Sequence
  Artificially Synthesized Primer Sequence
aatgagtttgtcgaccaggg

SEQ ID NO: 17230 - DNA, 20 bp, Artificial Sequence
  Artificially Synthesized Primer Sequence
ttaacgcgggtttctattgg

SEQ ID NO: 17231 - DNA, 20 bp, Artificial Sequence
  Artificially Synthesized Primer Sequence
gctaattatcggcgagcatc

SEQ ID NO: 17232 - DNA, 20 bp, Artificial Sequence
  Artificially Synthesized Primer Sequence
caaattgtcgtgtttgtggc

SEQ ID NO: 17233 - DNA, 20 bp, Artificial Sequence
  Artificially Synthesized Primer Sequence
gactccgaggttgtccagag

SEQ ID NO: 17234 - DNA, 20 bp, Artificial Sequence
  Artificially Synthesized Primer Sequence
cttttcccaaagcgagtcag

SEQ ID NO: 17235 - DNA, 20 bp, Artificial Sequence
  Artificially Synthesized Primer Sequence
cattacacggacaaaacccc

SEQ ID NO: 17236 - DNA, 20 bp, Artificial Sequence
  Artificially Synthesized Primer Sequence
ggacgagctgtagttgctca

SEQ ID NO: 17237 - DNA, 20 bp, Artificial Sequence
  Artificially Synthesized Primer Sequence
ccatggcttgtctaccgact

SEQ ID NO: 17238 - DNA, 20 bp, Artificial Sequence
  Artificially Synthesized Primer Sequence
gctgaagttccagacttggc

SEQ ID NO: 17239 - DNA, 20 bp, Artificial Sequence
  Artificially Synthesized Primer Sequence
tccttgtcgtactgctcgtg

SEQ ID NO: 17240 - DNA, 20 bp, Artificial Sequence
  Artificially Synthesized Primer Sequence
tctgtgaagatcagcaaccg

SEQ ID NO: 17241 - DNA, 20 bp, Artificial Sequence
  Artificially Synthesized Primer Sequence
gaagccatgtatgggcagtt

SEQ ID NO: 17242 - DNA, 20 bp, Artificial Sequence
  Artificially Synthesized Primer Sequence
cctcttctgcaggtgagtcc

SEQ ID NO: 17243 - DNA, 20 bp, Artificial Sequence
  Artificially Synthesized Primer Sequence
gccagagcaacaatgactga

SEQ ID NO: 17244 - DNA, 20 bp, Artificial Sequence
  Artificially Synthesized Primer Sequence
aatcaatcgaggcattggac

SEQ ID NO: 17245 - DNA, 20 bp, Artificial Sequence
  Artificially Synthesized Primer Sequence
gggtcatcatctgaggtcgt

SEQ ID NO: 17246 - DNA, 20 bp, Artificial Sequence
  Artificially Synthesized Primer Sequence
aaaagacacatttgggccag

SEQ ID NO: 17247 - DNA, 20 bp, Artificial Sequence
  Artificially Synthesized Primer Sequence
cgtcaactgacacccagatg

SEQ ID NO: 17248 - DNA, 20 bp, Artificial Sequence
  Artificially Synthesized Primer Sequence
gttctccgccatggatctac

SEQ ID NO: 17249 - DNA, 20 bp, Artificial Sequence
  Artificially Synthesized Primer Sequence
ccttcggaacgctctacaag

SEQ ID NO: 17250 - DNA, 20 bp, Artificial Sequence
  Artificially Synthesized Primer Sequence
ggacaatgggaatgtccaac

SEQ ID NO: 17251 - DNA, 20 bp, Artificial Sequence
  Artificially Synthesized Primer Sequence
tccaaaatgacaaggcaaca

SEQ ID NO: 17252 - DNA, 20 bp, Artificial Sequence
  Artificially Synthesized Primer Sequence
aacttggccgttatctgcac

SEQ ID NO: 17253 - DNA, 20 bp, Artificial Sequence
  Artificially Synthesized Primer Sequence
gcatggcattgtcacttttg

SEQ ID NO: 17254 - DNA, 20 bp, Artificial Sequence
  Artificially Synthesized Primer Sequence
ccactcactcagagatgcca

SEQ ID NO: 17255 - DNA, 20 bp, Artificial Sequence
  Artificially Synthesized Primer Sequence
gccacaagtccaaacacctt

SEQ ID NO: 17256 - DNA, 20 bp, Artificial Sequence
  Artificially Synthesized Primer Sequence
ccgagcacatgcaaaatatc

SEQ ID NO: 17257 - DNA, 20 bp, Artificial Sequence
  Artificially Synthesized Primer Sequence
actggttcaagtacgggcag

SEQ ID NO: 17258 - DNA, 20 bp, Artificial Sequence
  Artificially Synthesized Primer Sequence
aaacgaccgagatccatgag

SEQ ID NO: 17259 - DNA, 20 bp, Artificial Sequence
  Artificially Synthesized Primer Sequence
aaacgaccgagatccatgag

SEQ ID NO: 17260 - DNA, 20 bp, Artificial Sequence
  Artificially Synthesized Primer Sequence
actggttcaagtacgggcag

SEQ ID NO: 17261 - DNA, 20 bp, Artificial Sequence
  Artificially Synthesized Primer Sequence
tggtcacagatggtctggaa

SEQ ID NO: 17262 - DNA, 20 bp, Artificial Sequence
  Artificially Synthesized Primer Sequence
tcaccacaatcgtcgtcact

SEQ ID NO: 17263 - DNA, 20 bp, Artificial Sequence
  Artificially Synthesized Primer Sequence
gcaaacataaggaaccccct

SEQ ID NO: 17264 - DNA, 20 bp, Artificial Sequence
  Artificially Synthesized Primer Sequence
ggagtgacgacgattgtgtg

SEQ ID NO: 17265 - DNA, 20 bp, Artificial Sequence
  Artificially Synthesized Primer Sequence
ccactggggtgatgaactct

SEQ ID NO: 17266 - DNA, 20 bp, Artificial Sequence
  Artificially Synthesized Primer Sequence
acgtcttcagctgctggatt

SEQ ID NO: 17267 - DNA, 20 bp, Artificial Sequence
  Artificially Synthesized Primer Sequence
aaccaaattaagccgacacg

SEQ ID NO: 17268 - DNA, 20 bp, Artificial Sequence
  Artificially Synthesized Primer Sequence
gagtcacaaagaagggctgc

SEQ ID NO: 17269 - DNA, 20 bp, Artificial Sequence
  Artificially Synthesized Primer Sequence
ttgctatccaaagtggtccc

SEQ ID NO: 17270 - DNA, 20 bp, Artificial Sequence
  Artificially Synthesized Primer Sequence
taaaccagcaccctagtgcc

SEQ ID NO: 17271 - DNA, 20 bp, Artificial Sequence
  Artificially Synthesized Primer Sequence
caagcaaccgaaagaagcat

SEQ ID NO: 17272 - DNA, 20 bp, Artificial Sequence
  Artificially Synthesized Primer Sequence
cctgagtgggtttctagcca

SEQ ID NO: 17273 - DNA, 20 bp, Artificial Sequence
  Artificially Synthesized Primer Sequence
cgcatctctgcatccaagta

SEQ ID NO: 17274 - DNA, 20 bp, Artificial Sequence
  Artificially Synthesized Primer Sequence
cgagtccttcgccattttag

SEQ ID NO: 17275 - DNA, 20 bp, Artificial Sequence
  Artificially Synthesized Primer Sequence
cagagaagccaacgatgtca

SEQ ID NO: 17276 - DNA, 20 bp, Artificial Sequence
  Artificially Synthesized Primer Sequence
ctatcttcggcaaggacgac

SEQ ID NO: 17277 - DNA, 10 bp, Artificial Sequence
  Artificially Synthesized Primer Sequence
  MISC_FEATURE (1)..(10): n stands for any base
nnnnnnnnnn

SEQ ID NO: 17278 - DNA, 10 bp, Artificial Sequence
  Artificially Synthesized Primer Sequence
  MISC_FEATURE (1)..(10): n stands for any base
nnnnnnnnnn

SEQ ID NO: 17279 - DNA, 20 bp, Artificial Sequence
  Artificially Synthesized Primer Sequence
gcagaagaaagaacgttggg

SEQ ID NO: 17280 - DNA, 20 bp, Artificial Sequence
  Artificially Synthesized Primer Sequence
actttgaggaagcgtcggta

SEQ ID NO: 17281 - DNA, 20 bp, Artificial Sequence
  Artificially Synthesized Primer Sequence
tcctgttttggcacgatatg

SEQ ID NO: 17282 - DNA, 21 bp, Artificial Sequence
  Artificially Synthesized Primer Sequence
atgatcatcagctgctcgttt

SEQ ID NO: 17283 - DNA, 20 bp, Artificial Sequence
  Artificially Synthesized Primer Sequence
tagctcagcaccaaaagcct

SEQ ID NO: 17284 - DNA, 20 bp, Artificial Sequence
  Artificially Synthesized Primer Sequence
ctgccagatcgagaacatca

SEQ ID NO: 17285 - DNA, 20 bp, Artificial Sequence
  Artificially Synthesized Primer Sequence
gtcttttcttccctttgccc

SEQ ID NO: 17286 - DNA, 20 bp, Artificial Sequence
  Artificially Synthesized Primer Sequence
gggggataaaaataagcgga

SEQ ID NO: 17287 - DNA, 20 bp, Artificial Sequence
  Artificially Synthesized Primer Sequence
ccatcgtcgacaacacaaat

SEQ ID NO: 17288 - DNA, 20 bp, Artificial Sequence
  Artificially Synthesized Primer Sequence
gcagggcatctttaggaaca

SEQ ID NO: 17289 - DNA, 20 bp, Artificial Sequence
  Artificially Synthesized Primer Sequence
ttatctttgacctcggtggc

SEQ ID NO: 17290 - DNA, 20 bp, Artificial Sequence
  Artificially Synthesized Primer Sequence
gacaaggccaactcatggat

SEQ ID NO: 17291 - DNA, 20 bp, Artificial Sequence
  Artificially Synthesized Primer Sequence
gcagggttcaggtctgagag

SEQ ID NO: 17292 - DNA, 20 bp, Artificial Sequence
  Artificially Synthesized Primer Sequence
acctatacagcaacgcgtcc

SEQ ID NO: 17293 - DNA, 20 bp, Artificial Sequence
  Artificially Synthesized Primer Sequence
ggttaccgcccatacacatc

SEQ ID NO: 17294 - DNA, 20 bp, Artificial Sequence
  Artificially Synthesized Primer Sequence
aaagatgaagcaacggttcg

SEQ ID NO: 17295 - DNA, 20 bp, Artificial Sequence
  Artificially Synthesized Primer Sequence
acgctcatcaaggtctgctt

SEQ ID NO: 17296 - DNA, 20 bp, Artificial Sequence
  Artificially Synthesized Primer Sequence
gctgttggtgaaggaccaat

SEQ ID NO: 17297 - DNA, 20 bp, Artificial Sequence
  Artificially Synthesized Primer Sequence
gcgatgtggcctcttctact

SEQ ID NO: 17298 - DNA, 20 bp, Artificial Sequence
  Artificially Synthesized Primer Sequence
agcagaaagcagtggttgtg

SEQ ID NO: 17299 - DNA, 20 bp, Artificial Sequence
  Artificially Synthesized Primer Sequence
ctcattgcgggttaccagtt

SEQ ID NO: 17300 - DNA, 20 bp, Artificial Sequence
  Artificially Synthesized Primer Sequence
ccagcaatgccatatcctct

SEQ ID NO: 17301 - DNA, 20 bp, Artificial Sequence
  Artificially Synthesized Primer Sequence
aacaagctcaagggcgagta

SEQ ID NO: 17302 - DNA, 20 bp, Artificial Sequence
  Artificially Synthesized Primer Sequence
gtcgtcatcctcgtcctcat

SEQ ID NO: 17303 - DNA, 20 bp, Artificial Sequence
  Artificially Synthesized Primer Sequence
gcggaggacatacaccctaa

SEQ ID NO: 17304 - DNA, 20 bp, Artificial Sequence
  Artificially Synthesized Primer Sequence
aagctcaagggcgagtacaa

SEQ ID NO: 17305 - DNA, 20 bp, Artificial Sequence
  Artificially Synthesized Primer Sequence
catgtttgtgggtcatctcg

SEQ ID NO: 17306 - DNA, 20 bp, Artificial Sequence
  Artificially Synthesized Primer Sequence
catggcaatttcagggtctt

SEQ ID NO: 17307 - DNA, 20 bp, Artificial Sequence
  Artificially Synthesized Primer Sequence
tttccctgcacatctcactg

SEQ ID NO: 17308 - DNA, 20 bp, Artificial Sequence
  Artificially Synthesized Primer Sequence
cgtggcattcttgtttgatg

SEQ ID NO: 17309 - DNA, 20 bp, Artificial Sequence
  Artificially Synthesized Primer Sequence
acaaggaacatcacaagccc

SEQ ID NO: 17310 - DNA, 20 bp, Artificial Sequence
  Artificially Synthesized Primer Sequence
tctcagcattgtcatcggag

SEQ ID NO: 17311 - DNA, 20 bp, Artificial Sequence
  Artificially Synthesized Primer Sequence
ggaaacaacgtgcatttcct

SEQ ID NO: 17312 - DNA, 20 bp, Artificial Sequence
  Artificially Synthesized Primer Sequence
ctccgatgacaatgctgaga

SEQ ID NO: 17313 - DNA, 20 bp, Artificial Sequence
  Artificially Synthesized Primer Sequence
caaagctctgccagaaggtc

SEQ ID NO: 17314 - DNA, 20 bp, Artificial Sequence
  Artificially Synthesized Primer Sequence
ctgctgtacaacgtgccagt

SEQ ID NO: 17315 - DNA, 20 bp, Artificial Sequence
  Artificially Synthesized Primer Sequence
cagaaccaggaaacggaaaa

SEQ ID NO: 17316 - DNA, 20 bp, Artificial Sequence
  Artificially Synthesized Primer Sequence
tggcacgttgtacagcagat

SEQ ID NO: 17317 - DNA, 20 bp, Artificial Sequence
  Artificially Synthesized Primer Sequence
gacaactatgcgacccgaat

SEQ ID NO: 17318 - DNA, 20 bp, Artificial Sequence
  Artificially Synthesized Primer Sequence
ctgagagctgtgcgtcgtag

SEQ ID NO: 17319 - DNA, 20 bp, Artificial Sequence
  Artificially Synthesized Primer Sequence
cagaacaaacgcaaagcaaa

SEQ ID NO: 17320 - DNA, 20 bp, Artificial Sequence
  Artificially Synthesized Primer Sequence
gtacgactcgatgagcagca

SEQ ID NO: 17321 - DNA, 20 bp, Artificial Sequence
  Artificially Synthesized Primer Sequence
gaaaatggatggcaagagga

SEQ ID NO: 17322 - DNA, 20 bp, Artificial Sequence
  Artificially Synthesized Primer Sequence
acattggctcccatttcttg

SEQ ID NO: 17323 - DNA, 20 bp, Artificial Sequence
  Artificially Synthesized Primer Sequence
gaaaatggatggcaagagga

SEQ ID NO: 17324 - DNA, 20 bp, Artificial Sequence
  Artificially Synthesized Primer Sequence
gcagtgcacgcatatcattt

SEQ ID NO: 17325 - DNA, 20 bp, Artificial Sequence
  Artificially Synthesized Primer Sequence
aaccaagtgaggtacacggc

SEQ ID NO: 17326 - DNA, 20 bp, Artificial Sequence
  Artificially Synthesized Primer Sequence
cttggtacgagggtccgtaa

SEQ ID NO: 17327 - DNA, 20 bp, Artificial Sequence
  Artificially Synthesized Primer Sequence
cgtttcgataacgggaaaga

SEQ ID NO: 17328 - DNA, 20 bp, Artificial Sequence
  Artificially Synthesized Primer Sequence
ctctagcaggtcgtcaaggg

SEQ ID NO: 17329 - DNA, 20 bp, Artificial Sequence
  Artificially Synthesized Primer Sequence
tcactatagggcgaattggg

SEQ ID NO: 17330 - DNA, 20 bp, Artificial Sequence
  Artificially Synthesized Primer Sequence
caaaccgaagggtgaaggta

SEQ ID NO: 17331 - DNA, 20 bp, Artificial Sequence
  Artificially Synthesized Primer Sequence
ggggacaattttgagtgtgc

SEQ ID NO: 17332 - DNA, 20 bp, Artificial Sequence
  Artificially Synthesized Primer Sequence
accaaaacggtaacaatcgc

SEQ ID NO: 17333 - DNA, 20 bp, Artificial Sequence
  Artificially Synthesized Primer Sequence
ccagcaccctggtacatctt

SEQ ID NO: 17334 - DNA, 20 bp, Artificial Sequence
  Artificially Synthesized Primer Sequence
caagatcaccatcaccaacg

SEQ ID NO: 17335 - DNA, 20 bp, Artificial Sequence
  Artificially Synthesized Primer Sequence
acacgactaatggcactccc

SEQ ID NO: 17336 - DNA, 20 bp, Artificial Sequence
  Artificially Synthesized Primer Sequence
ggagtgtgagagcctccttg

SEQ ID NO: 17337 - DNA, 20 bp, Artificial Sequence
  Artificially Synthesized Primer Sequence
ctggaggttgatcgcaattt

SEQ ID NO: 17338 - DNA, 20 bp, Artificial Sequence
  Artificially Synthesized Primer Sequence
agacggcgaagaacaaagaa

SEQ ID NO: 17339 - DNA, 20 bp, Artificial Sequence
  Artificially Synthesized Primer Sequence
tcacacacatgcacaaatgc

SEQ ID NO: 17340 - DNA, 20 bp, Artificial Sequence
  Artificially Synthesized Primer Sequence
ttgagcatcgctgttcactc

SEQ ID NO: 17341 - DNA, 21 bp, Hordeum vulgare
gcaaccacgasgtacatcgtt

SEQ ID NO: 17342 - DNA, 21 bp, Hordeum vulgare
agcttacatcstggaatcttc

SEQ ID NO: 17343 - DNA, 21 bp, Hordeum vulgare
agctcgcggcrccgttcacct

SEQ ID NO: 17344 - DNA, 21 bp, Hordeum vulgare
cctccacgacsgccccgggct

SEQ ID NO: 17345 - DNA, 21 bp, Hordeum vulgare
ataatgtatcsacattctcgc

SEQ ID NO: 17346 - DNA, 21 bp, Hordeum vulgare
ttttctgaaaygcaaacaata

SEQ ID NO: 17347 - DNA, 21 bp, Hordeum vulgare
cgcttgcccamgtgtgcaaca

SEQ ID NO: 17348 - DNA, 21 bp, Hordeum vulgare
tcctcggcgcraccgcctaca

SEQ ID NO: 17349 - DNA, 21 bp, Hordeum vulgare
cacttgtatgyagttcaccaa

SEQ ID NO: 17350 - DNA, 21 bp, Hordeum vulgare
accagagcaamtgactcactg

SEQ ID NO: 17351 - DNA, 21 bp, Hordeum vulgare
acttcaccctygtccagcaca

SEQ ID NO: 17352 - DNA, 21 bp, Hordeum vulgare
gcggcatcttyctatggtact

SEQ ID NO: 17353 - DNA, 21 bp, Hordeum vulgare
tgattgcatcraaatggcatg

SEQ ID NO: 17354 - DNA, 21 bp, Hordeum vulgare
ccaggtgccgsggttgttgca

SEQ ID NO: 17355 - DNA, 20 bp, Hordeum vulgare
ggaagttctcgtccttgagg

SEQ ID NO: 17356 - DNA, 21 bp, Hordeum vulgare
  MISC_FEATURE (5): n stands for any base
ggaangtctcatccttgaagg

SEQ ID NO: 17357 - DNA, 21 bp, Hordeum vulgare
tgctaacatgyttgtacgacc

SEQ ID NO: 17358 - DNA, 21 bp, Hordeum vulgare
tccactccatrctccagtggt

SEQ ID NO: 17359 - DNA, 21 bp, Hordeum vulgare
gggagctgcakcagcagcccc

SEQ ID NO: 17360 - DNA, 21 bp, Hordeum vulgare
accagacgggmgactacgagg

SEQ ID NO: 17361 - DNA, 21 bp, Hordeum vulgare
cggcgcacccrgccctctcgt

SEQ ID NO: 17362 - DNA, 21 bp, Hordeum vulgare
acgcgtaaackccaagtgcat

SEQ ID NO: 17363 - DNA, 21 bp, Hordeum vulgare
tattcaagaasaaaacacatg

SEQ ID NO: 17364 - DNA, 21 bp, Hordeum vulgare
agtgcattgayagactcccca

SEQ ID NO: 17365 - DNA, 21 bp, Hordeum vulgare
ctggaacctgrctgctaaaag

SEQ ID NO: 17366 - DNA, 21 bp, Hordeum vulgare
tgctggaaackaaagtggggc

SEQ ID NO: 17367 - DNA, 21 bp, Hordeum vulgare
caaacattagycagttacttc

SEQ ID NO: 17368 - DNA, 21 bp, Hordeum vulgare
gctctcaagcrtctgttcatc

SEQ ID NO: 17369 - DNA, 21 bp, Hordeum vulgare
aaataaaacargaggaaagga

SEQ ID NO: 17370 - DNA, 21 bp, Hordeum vulgare
atatgtcagamatgcgtggca

SEQ ID NO: 17371 - DNA, 21 bp, Hordeum vulgare
ctcgcggacgyacccaccatt

SEQ ID NO: 17372 - DNA, 21 bp, Hordeum vulgare
caggtctgggwttgccaggaa

SEQ ID NO: 17373 - DNA, 21 bp, Hordeum vulgare
agcgtcccttrccgggatggc

SEQ ID NO: 17374 - DNA, 21 bp, Hordeum vulgare
tgacgcagtaycttgatgcaa

SEQ ID NO: 17375 - DNA, 21 bp, Hordeum vulgare
agcagcatgcrcatgtgatgg

SEQ ID NO: 17376 - DNA, 21 bp, Hordeum vulgare
ggagcgacgamcttgatcttc

SEQ ID NO: 17377 - DNA, 21 bp, Hordeum vulgare
ggcgtatcccragagtaccca

SEQ ID NO: 17378 - DNA, 21 bp, Hordeum vulgare
tgtcaccggcrtcagcatagt

SEQ ID NO: 17379 - DNA, 21 bp, Hordeum vulgare
ggtttggcgcratgtcaccgg

SEQ ID NO: 17380 - DNA, 21 bp, Hordeum vulgare
gggccctgtgygcttggtttg

SEQ ID NO: 17381 - DNA, 21 bp, Hordeum vulgare
ctggttcttcrcaccactggt

SEQ ID NO: 17382 - DNA, 21 bp, Hordeum vulgare
caatgaggccrtacagggcaa

SEQ ID NO: 17383 - DNA, 21 bp, Hordeum vulgare
catgaccaccrtctcgtgccg

SEQ ID NO: 17384 - DNA, 21 bp, Hordeum vulgare
tgcatcatccstgactacttc

SEQ ID NO: 17385 - DNA, 21 bp, Hordeum vulgare
cgagaccggcsctcgattaag

SEQ ID NO: 17386 - DNA, 21 bp, Hordeum vulgare
gggcgacccgrtatgaacaac

SEQ ID NO: 17387 - DNA, 21 bp, Hordeum vulgare
cgaagttccargcgtcattga

SEQ ID NO: 17388 - DNA, 21 bp, Hordeum vulgare
ggagcgatcgrtcgacgggac

SEQ ID NO: 17389 - DNA, 21 bp, Hordeum vulgare
tcccatcatgktatgttcaac

SEQ ID NO: 17390 - DNA, 21 bp, Hordeum vulgare
gttctaaggcwctttaataat

SEQ ID NO: 17391 - DNA, 21 bp, Hordeum vulgare
tgaaccgattygatacactgc

SEQ ID NO: 17392 - DNA, 21 bp, Hordeum vulgare
ccgttggaacrcacgggctct

SEQ ID NO: 17393 - DNA, 21 bp, Hordeum vulgare
ctttggagtakccaagctctc

SEQ ID NO: 17394 - DNA, 21 bp, Hordeum vulgare
ccacggtggcraacttgtcgt

SEQ ID NO: 17395 - DNA, 21 bp, Hordeum vulgare
acctccagacrgcggttgtct

SEQ ID NO: 17396 - DNA, 21 bp, Hordeum vulgare
ccgtgtccgargctcgcctca

SEQ ID NO: 17397 - DNA, 21 bp, Hordeum vulgare
ggcaccctgcractcatctgt

SEQ ID NO: 17398 - DNA, 21 bp, Hordeum vulgare
gaagggattgsagagtatgtc

SEQ ID NO: 17399 - DNA, 21 bp, Hordeum vulgare
ctatcactctkatcagtgaag

SEQ ID NO: 17400 - DNA, 21 bp, Hordeum vulgare
agtgacgctgycttctgggcc

SEQ ID NO: 17401 - DNA, 21 bp, Hordeum vulgare
cgcccagacgrgggtccagca

SEQ ID NO: 17402 - DNA, 21 bp, Hordeum vulgare
ccttggcgtcrtggagctgct

SEQ ID NO: 17403 - DNA, 21 bp, Hordeum vulgare
agacgagggcrctgctgagga

SEQ ID NO: 17404 - DNA, 21 bp, Hordeum vulgare
acagtaatatygattatgaat

SEQ ID NO: 17405 - DNA, 21 bp, Hordeum vulgare
aatcccttgayccaaacaaag

SEQ ID NO: 17406 - DNA, 21 bp, Hordeum vulgare
gcttcgccctygctgtagacg

SEQ ID NO: 17407 - DNA, 21 bp, Hordeum vulgare
tcattgcttcmtgcacaccat

SEQ ID NO: 17408 - DNA, 21 bp, Hordeum vulgare
ctgaccatgcracgaagaata

SEQ ID NO: 17409 - DNA, 21 bp, Hordeum vulgare
agcacacagcmgaggctcgct

SEQ ID NO: 17410 - DNA, 21 bp, Hordeum vulgare
cctcgtcctcstcgccggaga

SEQ ID NO: 17411 - DNA, 21 bp, Hordeum vulgare
ggcgaggtacsgcacgacctg

SEQ ID NO: 17412 - DNA, 21 bp, Hordeum vulgare
gcacgacctgsctcctcttcc

SEQ ID NO: 17413 - DNA, 21 bp, Hordeum vulgare
gcacgacaccsgcgtccttgc

SEQ ID NO: 17414 - DNA, 21 bp, Hordeum vulgare
tgggtgagccwgagccgcgaa

SEQ ID NO: 17415 - DNA, 21 bp, Hordeum vulgare
agcctccatgkccgcccatca

SEQ ID NO: 17416 - DNA, 21 bp, Hordeum vulgare
cgtcccagctsacaaactttg

SEQ ID NO: 17417 - DNA, 21 bp, Hordeum vulgare
atttggggctrggtgtctttt

SEQ ID NO: 17418 - DNA, 21 bp, Hordeum vulgare
ggcttacagtygacagtaatc

SEQ ID NO: 17419 - DNA, 21 bp, Hordeum vulgare
gaatctgggtyggatgatggc

SEQ ID NO: 17420 - DNA, 21 bp, Hordeum vulgare
atggcacaccyttgttcaatg

SEQ ID NO: 17421 - DNA, 21 bp, Hordeum vulgare
gaaacatctaytaggcttaca

SEQ ID NO: 17422 - DNA, 21 bp, Hordeum vulgare
gaccggatctrgacgccagga

SEQ ID NO: 17423 - DNA, 21 bp, Hordeum vulgare
atcttctgcargcacttgtcg

SEQ ID NO: 17424 - DNA, 21 bp, Hordeum vulgare
ccccctgtggycacctctggc

SEQ ID NO: 17425 - DNA, 21 bp, Hordeum vulgare
gtgaaattggygggtggggat

SEQ ID NO: 17426 - DNA, 21 bp, Hordeum vulgare
atcttctgcargcacttgtcg

SEQ ID NO: 17427 - DNA, 21 bp, Hordeum vulgare
tggtgccagcrccgtcgacgg

SEQ ID NO: 17428 - DNA, 21 bp, Hordeum vulgare
taccgatcccrataagcgcct

SEQ ID NO: 17429 - DNA, 21 bp, Hordeum vulgare
aagcggacgarcgcctcttca

SEQ ID NO: 17430 - DNA, 21 bp, Hordeum vulgare
ttggtgagcasattcttaccg

SEQ ID NO: 17431 - DNA, 21 bp, Hordeum vulgare
ggttggtttgrcgcagcttgc

SEQ ID NO: 17432 - DNA, 21 bp, Hordeum vulgare
aagatgcacargaacatattt

SEQ ID NO: 17433 - DNA, 21 bp, Hordeum vulgare
tgtaagtaaasagatcgatag

SEQ ID NO: 17434 - DNA, 21 bp, Hordeum vulgare
acatgcgaaaycacaagagat

SEQ ID NO: 17435 - DNA, 21 bp, Hordeum vulgare
atactattagrgtcttcggta

SEQ ID NO: 17436 - DNA, 21 bp, Hordeum vulgare
ctttgtagcawtgctgcctaa

SEQ ID NO: 17437 - DNA, 21 bp, Hordeum vulgare
atgcagatgarcaattatagt

SEQ ID NO: 17438 - DNA, 21 bp, Hordeum vulgare
ctgcctaacamattaaaattt

SEQ ID NO: 17439 - DNA, 21 bp, Hordeum vulgare
  MISC_FEATURE (11): n is SNP, in which the one is g and the other is a or t or c
agtctcagaangatgggatga

SEQ ID NO: 17440 - DNA, 21 bp, Hordeum vulgare
  MISC_FEATURE (11): n is SNP, in which the one is c and the other is a or t or g
agtgagctttnatgtatcagg

SEQ ID NO: 17441 - DNA, 21 bp, Hordeum vulgare
ggttgtcagaytcgtgcacct

SEQ ID NO: 17442 - DNA, 21 bp, Hordeum vulgare
tctggcacggycaaggggaac

SEQ ID NO: 17443 - DNA, 21 bp, Hordeum vulgare
aggggaactckaactcttgat

SEQ ID NO: 17444 - DNA, 21 bp, Hordeum vulgare
atagtagaaaygcatggtcac

SEQ ID NO: 17445 - DNA, 21 bp, Hordeum vulgare
catcaacacakttcagcaaga

SEQ ID NO: 17446 - DNA, 21 bp, Hordeum vulgare
ccacggtgggracgccggggt

SEQ ID NO: 17447 - DNA, 21 bp, Hordeum vulgare
cgttgttgtasgtgaacgcac

SEQ ID NO: 17448 - DNA, 21 bp, Hordeum vulgare
tctcggcactyttatgagttg

SEQ ID NO: 17449 - DNA, 21 bp, Hordeum vulgare
aggaagaaaargtagagatct

SEQ ID NO: 17450 - DNA, 21 bp, Hordeum vulgare
aagaccctgtmcaccttgtcc

SEQ ID NO: 17451 - DNA, 21 bp, Hordeum vulgare
tgatccgagayatgcaaagag

SEQ ID NO: 17452 - DNA, 21 bp, Hordeum vulgare
tcatactaatrccccacacga

SEQ ID NO: 17453 - DNA, 21 bp, Hordeum vulgare
aatgcctcgamttagttatga

SEQ ID NO: 17454 - DNA, 21 bp, Hordeum vulgare
agactgcttaytcatgcattg

SEQ ID NO: 17455 - DNA, 21 bp, Hordeum vulgare
aattccgaacrgagggagtat

SEQ ID NO: 17456 - DNA, 21 bp, Hordeum vulgare
gggtggctgcrtgtgacaaca

SEQ ID NO: 17457 - DNA, 21 bp, Hordeum vulgare
aatgcctcgamttagttatga

SEQ ID NO: 17458 - DNA, 21 bp, Hordeum vulgare
tttttccttawctattatatc

SEQ ID NO: 17459 - DNA, 21 bp, Hordeum vulgare
taactatctcmtcatctgggt

SEQ ID NO: 17460 - DNA, 21 bp, Hordeum vulgare
atgacagatgsaaccaagcat

SEQ ID NO: 17461 - DNA, 19 bp, Hordeum vulgare
atctctcatctatctcgaa

SEQ ID NO: 17462 - DNA, 21 bp, Hordeum vulgare
ttctctcatcctatctcgata

SEQ ID NO: 17463 - DNA, 21 bp, Hordeum vulgare
tattccaggtraagctacccc

SEQ ID NO: 17464 - DNA, 21 bp, Hordeum vulgare
atggaacagcrctgagcattt

SEQ ID NO: 17465 - DNA, 21 bp, Hordeum vulgare
acagaactttytgcacaacag

SEQ ID NO: 17466 - DNA, 21 bp, Hordeum vulgare
gcaaagagatmaaatacaata

SEQ ID NO: 17467 - DNA, 21 bp, Hordeum vulgare
ttacttacagstctctttcca

SEQ ID NO: 17468 - DNA, 21 bp, Hordeum vulgare
ggactttatcrttaaccgggc

SEQ ID NO: 17469 - DNA, 21 bp, Hordeum vulgare
gatctgaataytagcatactc

SEQ ID NO: 17470 - DNA, 21 bp, Hordeum vulgare
ttttcttcttktagtgtgttt

SEQ ID NO: 17471 - DNA, 21 bp, Hordeum vulgare
tgaagaaacakgaacaatata

SEQ ID NO: 17472 - DNA, 21 bp, Hordeum vulgare
atatggtcagygaagccaggg

SEQ ID NO: 17473 - DNA, 21 bp, Hordeum vulgare
ttgaagggtcrgtgttatggt

SEQ ID NO: 17474 - DNA, 21 bp, Hordeum vulgare
gccgccgcccrctggcaggat

SEQ ID NO: 17475 - DNA, 21 bp, Hordeum vulgare
accttttttawtgaagcatac

SEQ ID NO: 17476 - DNA, 21 bp, Hordeum vulgare
agacacataaratgacgagct

SEQ ID NO: 17477 - DNA, 21 bp, Hordeum vulgare
gagtacatcgyaatagacata

SEQ ID NO: 17478 - DNA, 21 bp, Hordeum vulgare
aggagcagatsagggagccga

SEQ ID NO: 17479 - DNA, 21 bp, Hordeum vulgare
gcaaggaattrgaaacagaag

SEQ ID NO: 17480 - DNA, 21 bp, Hordeum vulgare
caagccgcgcrcgagctagct

SEQ ID NO: 17481 - DNA, 21 bp, Hordeum vulgare
ctgtatatgtscgacctgcaa

SEQ ID NO: 17482 - DNA, 21 bp, Hordeum vulgare
aaaatattgckcagctttaaa

SEQ ID NO: 17483 - DNA, 21 bp, Hordeum vulgare
tgccatggtgyctgaaattct

SEQ ID NO: 17484 - DNA, 21 bp, Hordeum vulgare
gttcctgcttytgacgaagag

SEQ ID NO: 17485 - DNA, 21 bp, Hordeum vulgare
aacccatatcycacacacacc

SEQ ID NO: 17486 - DNA, 21 bp, Hordeum vulgare
taggagtaatycacaacccat

SEQ ID NO: 17487 - DNA, 21 bp, Hordeum vulgare
rwacacactgraaaccagcga

SEQ ID NO: 17488 - DNA, 21 bp, Hordeum vulgare
agccggaagawaataacatga

SEQ ID NO: 17489 - DNA, 21 bp, Hordeum vulgare
tcaagaatcgyctttgggggt

SEQ ID NO: 17490 - DNA, 21 bp, Hordeum vulgare
  MISC_FEATURE (21): n stands for any base
ggtgtttggamccaataccan

SEQ ID NO: 17491 - DNA, 21 bp, Hordeum vulgare
ttttgtcgtcracagatgaaa

SEQ ID NO: 17492 - DNA, 21 bp, Hordeum vulgare
ctggccaaagwgtctcctcgg

SEQ ID NO: 17493 - DNA, 21 bp, Hordeum vulgare
cggcgcgaagsgatcgcgctc

SEQ ID NO: 17494 - DNA, 21 bp, Hordeum vulgare
ttgaactatgmccggatgagc

SEQ ID NO: 17495 - DNA, 21 bp, Hordeum vulgare
ccttccactgygaagaagtca

SEQ ID NO: 17496 - DNA, 21 bp, Hordeum vulgare
ctgctgagcasatagtggggc

SEQ ID NO: 17497 - DNA, 21 bp, Hordeum vulgare
agtcatagtcractacacaat

SEQ ID NO: 17498 - DNA, 21 bp, Hordeum vulgare
attggcttgcrgaattctctc

SEQ ID NO: 17499 - DNA, 21 bp, Hordeum vulgare
aaaattctatrttatgctagg

SEQ ID NO: 17500 - DNA, 21 bp, Hordeum vulgare
gtgaaaaagtsaccgcttctc

SEQ ID NO: 17501 - DNA, 21 bp, Hordeum vulgare
ctcgtgttttkgcactgctct

SEQ ID NO: 17502 - DNA, 21 bp, Hordeum vulgare
catgtacaacragaacgcgac

SEQ ID NO: 17503 - DNA, 21 bp, Hordeum vulgare
gaaaatctgcrggcgttcatc

SEQ ID NO: 17504 - DNA, 21 bp, Hordeum vulgare
acacccacgtytgaaaatctg

SEQ ID NO: 17505 - DNA, 21 bp, Hordeum vulgare
tcggagaagaracggagggcg

SEQ ID NO: 17506 - DNA, 21 bp, Hordeum vulgare
tccgctgagcsgcgcttctag

SEQ ID NO: 17507 - DNA, 21 bp, Hordeum vulgare
cgatgatggawggctggaaga

SEQ ID NO: 17508 - DNA, 21 bp, Hordeum vulgare
ggccctcctcygccctagccg

SEQ ID NO: 17509 - DNA, 21 bp, Hordeum vulgare
accatgtcgcygggaagagcc

SEQ ID NO: 17510 - DNA, 21 bp, Hordeum vulgare
gaaaagagtcygcaccttatc

SEQ ID NO: 17511 - DNA, 21 bp, Hordeum vulgare
cttgcgtacaraatcttgttg

SEQ ID NO: 17512 - DNA, 21 bp, Hordeum vulgare
atatatacgamctcatgtagc

SEQ ID NO: 17513 - DNA, 21 bp, Hordeum vulgare
aggcttctgcrccccttgctg

SEQ ID NO: 17514 - DNA, 21 bp, Hordeum vulgare
cgtacagagargaaacagaca

SEQ ID NO: 17515 - DNA, 21 bp, Hordeum vulgare
attttgactayggtagcttgg

SEQ ID NO: 17516 - DNA, 21 bp, Hordeum vulgare
tttgaactatstgggactggg

SEQ ID NO: 17517 - DNA, 21 bp, Hordeum vulgare
aaagcttagakaataactggt

SEQ ID NO: 17518 - DNA, 21 bp, Hordeum vulgare
atagatgcttyaccagtgcac

SEQ ID NO: 17519 - DNA, 21 bp, Hordeum vulgare
gtagaacctcrtgaacatttc

SEQ ID NO: 17520 - DNA, 21 bp, Hordeum vulgare
ccgcgtccacrgcgaagtcca

SEQ ID NO: 17521 - DNA, 21 bp, Hordeum vulgare
gtcaacgcagytctgggcatc

SEQ ID NO: 17522 - DNA, 21 bp, Hordeum vulgare
tatggacagtytagacaagca

SEQ ID NO: 17523 - DNA, 21 bp, Hordeum vulgare
ggcttttgccrctatcaactg

SEQ ID NO: 17524 - DNA, 21 bp, Hordeum vulgare
tcgggtagacsaaaaaacccg

SEQ ID NO: 17525 - DNA, 21 bp, Hordeum vulgare
ccaacggcacratcatccctc

SEQ ID NO: 17526 - DNA, 21 bp, Hordeum vulgare
ctctccctgckgaaatgccat

SEQ ID NO: 17527 - DNA, 21 bp, Hordeum vulgare
cagcaacagcyataaaacaat

SEQ ID NO: 17528 - DNA, 21 bp, Hordeum vulgare
acacttgaccktggctgctgc

SEQ ID NO: 17529 - DNA, 21 bp, Hordeum vulgare
cgatgggtacsgcagcttgaa

SEQ ID NO: 17530 - DNA, 21 bp, Hordeum vulgare
ctgcttcttcygctgggggcc

SEQ ID NO: 17531 - DNA, 21 bp, Hordeum vulgare
ctacacgtacrcaagctgcag

SEQ ID NO: 17532 - DNA, 21 bp, Hordeum vulgare
agaagtagtgrgtatgattgt

SEQ ID NO: 17533 - DNA, 21 bp, Hordeum vulgare
accgagacccractccacgga

SEQ ID NO: 17534 - DNA, 21 bp, Hordeum vulgare
attttcccacrcagccctttt

SEQ ID NO: 17535 - DNA, 21 bp, Hordeum vulgare
tcgagacggcrgtccaccagc

SEQ ID NO: 17536 - DNA, 21 bp, Hordeum vulgare
ggtagtttatrtgtgcagcat

SEQ ID NO: 17537 - DNA, 21 bp, Hordeum vulgare
agtgaaccaartatcataaat

SEQ ID NO: 17538 - DNA, 21 bp, Hordeum vulgare
tcataaatgaratggtttacg

SEQ ID NO: 17539 - DNA, 21 bp, Hordeum vulgare
tcgccttctcrgtgtccttgt

SEQ ID NO: 17540 - DNA, 21 bp, Hordeum vulgare
ttcagagaatraatggattaa

SEQ ID NO: 17541 - DNA, 21 bp, Hordeum vulgare
cacccaccttytatttattgt

SEQ ID NO: 17542 - DNA, 21 bp, Hordeum vulgare
gcagttataawttgctactgt

SEQ ID NO: 17543 - DNA, 21 bp, Hordeum vulgare
agcacttcatmagtgcttcca

SEQ ID NO: 17544 - DNA, 21 bp, Hordeum vulgare
tcccccacagkcgtgtttctc

SEQ ID NO: 17545 - DNA, 21 bp, Hordeum vulgare
aaaggtaagtraacataaact

SEQ ID NO: 17546 - DNA, 21 bp, Hordeum vulgare
agccctatgtraaaacatttc

SEQ ID NO: 17547 - DNA, 21 bp, Hordeum vulgare
tagggcaccaracaaactaga

SEQ ID NO: 17548 - DNA, 21 bp, Hordeum vulgare
tatgtacacawttttgcacag

SEQ ID NO: 17549 - DNA, 21 bp, Hordeum vulgare
tcattcagagycgtatatgta

SEQ ID NO: 17550 - DNA, 21 bp, Hordeum vulgare
aatggtaattrctccagaaga

SEQ ID NO: 17551 - DNA, 21 bp, Hordeum vulgare
catgttggatwgctgcaacac

SEQ ID NO: 17552 - DNA, 21 bp, Hordeum vulgare
ttgcgctctckgcaaggcata

SEQ ID NO: 17553 - DNA, 21 bp, Hordeum vulgare
gggcaacaagrtcgcctgcat

SEQ ID NO: 17554 - DNA, 21 bp, Hordeum vulgare
acaaataattytgacagttca

SEQ ID NO: 17555 - DNA, 21 bp, Hordeum vulgare
ttatgggctcygcggcttctg

SEQ ID NO: 17556 - DNA, 21 bp, Hordeum vulgare
gcaaaagcagyttgaagtata

SEQ ID NO: 17557 - DNA, 21 bp, Hordeum vulgare
gcgccaagatmaggcggctga

SEQ ID NO: 17558 - DNA, 21 bp, Hordeum vulgare
catccaccatwacaagacaag

SEQ ID NO: 17559 - DNA, 21 bp, Hordeum vulgare
cactccctcargaactcaaca

SEQ ID NO: 17560 - DNA, 21 bp, Hordeum vulgare
atcagtttatwtgcctcgtgt

SEQ ID NO: 17561 - DNA, 21 bp, Hordeum vulgare
aataaaattgycttatttttg

SEQ ID NO: 17562 - DNA, 21 bp, Hordeum vulgare
gatgtagaagytggagagcat

SEQ ID NO: 17563 - DNA, 21 bp, Hordeum vulgare
gctttgcttasgaacggatct

SEQ ID NO: 17564 - DNA, 21 bp, Hordeum vulgare
tcaagttctcrgtgtcgtaga

SEQ ID NO: 17565 - DNA, 21 bp, Hordeum vulgare
gcatgtcgtcrttgtccccat

SEQ ID NO: 17566 - DNA, 21 bp, Hordeum vulgare
agttatattawggttgagaca

SEQ ID NO: 17567 - DNA, 21 bp, Hordeum vulgare
accacacaagsctcagatctt

SEQ ID NO: 17568 - DNA, 21 bp, Hordeum vulgare
gtttactgccraaattagcag

SEQ ID NO: 17569 - DNA, 21 bp, Hordeum vulgare
taaggataatrgaccattcca

SEQ ID NO: 17570 - DNA, 21 bp, Hordeum vulgare
tctcatgccgrtatcttatag

SEQ ID NO: 17571 - DNA, 21 bp, Hordeum vulgare
gtaaatatgcwataatgctgt

SEQ ID NO: 17572 - DNA, 21 bp, Hordeum vulgare
gctaattcagrttcactgtag

SEQ ID NO: 17573 - DNA, 21 bp, Hordeum vulgare
atggtataatkattctgtgag

SEQ ID NO: 17574 - DNA, 21 bp, Hordeum vulgare
tcggcgaccgwctcccaacca

SEQ ID NO: 17575 - DNA, 21 bp, Hordeum vulgare
gcaagatgtaycctgacttgg

SEQ ID NO: 17576 - DNA, 21 bp, Hordeum vulgare
aagctggcgcmtgtactatgt

SEQ ID NO: 17577 - DNA, 21 bp, Hordeum vulgare
gacgtggccgyatattcttct

SEQ ID NO: 17578 - DNA, 21 bp, Hordeum vulgare
caaacgtcacrcccttcttgt

SEQ ID NO: 17579 - DNA, 21 bp, Hordeum vulgare
gggggttgtcrcggctttggt

SEQ ID NO: 17580 - DNA, 21 bp, Hordeum vulgare
tggtagatgcycgcgaatcct

SEQ ID NO: 17581 - DNA, 21 bp, Hordeum vulgare
ggcagaggacygccagaaacg

SEQ ID NO: 17582 - DNA, 21 bp, Hordeum vulgare
tccagtggagrccctcgtgga

SEQ ID NO: 17583 - DNA, 21 bp, Hordeum vulgare
gctgttgagcyactcctttgc

SEQ ID NO: 17584 - DNA, 21 bp, Hordeum vulgare
gctggcctggycgttttgtcg

SEQ ID NO: 17585 - DNA, 21 bp, Hordeum vulgare
cgagcatatgkttgatttttg

SEQ ID NO: 17586 - DNA, 21 bp, Hordeum vulgare
gtccagtttgytggggggaga

SEQ ID NO: 17587 - DNA, 21 bp, Hordeum vulgare
tggccgtgtasaaggcgtcca

SEQ ID NO: 17588 - DNA, 21 bp, Hordeum vulgare
tatacgcgcgygcgtacgtac

SEQ ID NO: 17589 - DNA, 21 bp, Hordeum vulgare
aggcgtccackgtggtgtcga

SEQ ID NO: 17590 - DNA, 21 bp, Hordeum vulgare
gatcatcagtyggtctaacac

SEQ ID NO: 17591 - DNA, 21 bp, Hordeum vulgare
tagaaatgaartcaagtgctc

SEQ ID NO: 17592 - DNA, 21 bp, Hordeum vulgare
gaatcggaacygttataatca

SEQ ID NO: 17593 - DNA, 21 bp, Hordeum vulgare
ccggcacgccrtcgaccttca

SEQ ID NO: 17594 - DNA, 21 bp, Hordeum vulgare
gtcggagcatygctcacatat

SEQ ID NO: 17595 - DNA, 21 bp, Hordeum vulgare
cgccggattcsatgctgctgc

SEQ ID NO: 17596 - DNA, 21 bp, Hordeum vulgare
cggcaacgggrtcttcaggcc

SEQ ID NO: 17597 - DNA, 21 bp, Hordeum vulgare
cttgacgctgwactccacgaa

SEQ ID NO: 17598 - DNA, 21 bp, Hordeum vulgare
cagaataaaayggaggaacat

SEQ ID NO: 17599 - DNA, 21 bp, Hordeum vulgare
tttggccataragcatggcac

SEQ ID NO: 17600 - DNA, 21 bp, Hordeum vulgare
gaggaggtgcyggctttctta

SEQ ID NO: 17601 - DNA, 21 bp, Hordeum vulgare
aaccaaatcaratcggttaca

SEQ ID NO: 17602 - DNA, 21 bp, Hordeum vulgare
catctcttgtktacgtaccat

SEQ ID NO: 17603 - DNA, 21 bp, Hordeum vulgare
gccaggcttasatattttgga

SEQ ID NO: 17604 - DNA, 21 bp, Hordeum vulgare
atgtgattggkgctcaactga

SEQ ID NO: 17605 - DNA, 21 bp, Hordeum vulgare
aacataatttycaatctgtta

SEQ ID NO: 17606 - DNA, 21 bp, Hordeum vulgare
ggcctgcacaktggggaaaat

SEQ ID NO: 17607 - DNA, 21 bp, Hordeum vulgare
tcgcccttggrggagacagcg

SEQ ID NO: 17608 - DNA, 21 bp, Hordeum vulgare
agcagaaaggrgcagctcaac

SEQ ID NO: 17609 - DNA, 21 bp, Hordeum vulgare
aagaagaacarcacagaagtt

SEQ ID NO: 17610 - DNA, 21 bp, Hordeum vulgare
cctaagcagtmggtgcattct

SEQ ID NO: 17611 - DNA, 21 bp, Hordeum vulgare
gacacaacagrgggctcctgg

SEQ ID NO: 17612 - DNA, 21 bp, Hordeum vulgare
aggcgttgagracggctgata

SEQ ID NO: 17613 - DNA, 21 bp, Hordeum vulgare
aaaaaaacacrtgtaccttat

SEQ ID NO: 17614 - DNA, 21 bp, Hordeum vulgare
gtaaaatgccrgcgcgtctac

SEQ ID NO: 17615 - DNA, 21 bp, Hordeum vulgare
tgccccaccayttgcgcttgg

SEQ ID NO: 17616 - DNA, 21 bp, Hordeum vulgare
tgccaccggcmctgccgccgc

SEQ ID NO: 17617 - DNA, 21 bp, Hordeum vulgare
aatacaagtasgatcatccta

SEQ ID NO: 17618 - DNA, 21 bp, Hordeum vulgare
tgtcctctctyctgacaaaac

SEQ ID NO: 17619 - DNA, 21 bp, Hordeum vulgare
aataaatgaaygaagacaaca

SEQ ID NO: 17620 - DNA, 21 bp, Hordeum vulgare
aaatcaatgarcaggtagaat

SEQ ID NO: 17621 - DNA, 21 bp, Hordeum vulgare
agctcagatcraaaccggctt

SEQ ID NO: 17622 - DNA, 21 bp, Hordeum vulgare
gctggaaattkttccacgggg

SEQ ID NO: 17623 - DNA, 21 bp, Hordeum vulgare
tggcaatgctwtgccggctca

SEQ ID NO: 17624 - DNA, 21 bp, Hordeum vulgare
atatgctaccmctaagctgca

SEQ ID NO: 17625 - DNA, 21 bp, Hordeum vulgare
cacactagatragatggaggg

SEQ ID NO: 17626 - DNA, 21 bp, Hordeum vulgare
acggcgccgakagggcggaga

SEQ ID NO: 17627 - DNA, 21 bp, Hordeum vulgare
gatcgaggtakccgacggaat

SEQ ID NO: 17628 - DNA, 21 bp, Hordeum vulgare
acgctgtaaaytggctaccgg

SEQ ID NO: 17629 - DNA, 21 bp, Hordeum vulgare
cccctgcgtgrtcaccgtgtc

SEQ ID NO: 17630 - DNA, 21 bp, Hordeum vulgare
tcaatatttgmaggtgcttga

SEQ ID NO: 17631 - DNA, 21 bp, Hordeum vulgare
tggatctaccwtcaatatttg

SEQ ID NO: 17632 - DNA, 21 bp, Hordeum vulgare
aataagttgaragactggatc

SEQ ID NO: 17633 - DNA, 21 bp, Hordeum vulgare
cgtgcatgttygcctgcacag

SEQ ID NO: 17634 - DNA, 21 bp, Hordeum vulgare
gtttgcaaacraaaagaagct

SEQ ID NO: 17635 - DNA, 21 bp, Hordeum vulgare
gttacaactcrgttcaattcc

SEQ ID NO: 17636 - DNA, 21 bp, Hordeum vulgare
tgtcaactcawcttagtgtcg

SEQ ID NO: 17637 - DNA, 21 bp, Hordeum vulgare
tctacatagamtgtactagct

SEQ ID NO: 17638 - DNA, 21 bp, Hordeum vulgare
caatcgacagyggctccaggg

SEQ ID NO: 17639 - DNA, 21 bp, Hordeum vulgare
ctcagccaagytctccctaac

SEQ ID NO: 17640 - DNA, 21 bp, Hordeum vulgare
ctgctcctcgmactcattgac

SEQ ID NO: 17641 - DNA, 21 bp, Hordeum vulgare
ttcctaggacsttcttcaaat

SEQ ID NO: 17642 - DNA, 21 bp, Hordeum vulgare
cggcaacgggrtcttcaggcc

SEQ ID NO: 17643 - DNA, 21 bp, Hordeum vulgare
ggagctttttraagctccgcg

SEQ ID NO: 17644 - DNA, 21 bp, Hordeum vulgare
acactaacaarattcagcaag

SEQ ID NO: 17645 - DNA, 21 bp, Hordeum vulgare
agtacaggtcmagaagttaaa

SEQ ID NO: 17646 - DNA, 21 bp, Hordeum vulgare
tcgggataggyccaaaaccca

SEQ ID NO: 17647 - DNA, 21 bp, Hordeum vulgare
ttcatgaccayggccctctgc

SEQ ID NO: 17648 - DNA, 21 bp, Hordeum vulgare
gctgccaaccwagtactcttt

SEQ ID NO: 17649 - DNA, 21 bp, Hordeum vulgare
cgacctcgtarggcccgacga

SEQ ID NO: 17650 - DNA, 21 bp, Hordeum vulgare
actaagttagyacatatatca

SEQ ID NO: 17651 - DNA, 21 bp, Hordeum vulgare
ccatataaaamggttcagcta

SEQ ID NO: 17652 - DNA, 21 bp, Hordeum vulgare
cagttcgatgycgattgcaaa

SEQ ID NO: 17653 - DNA, 21 bp, Hordeum vulgare
atgcgttcaamatttagcctg

SEQ ID NO: 17654 - DNA, 21 bp, Hordeum vulgare
ggtgttgacaytacaacaaag

SEQ ID NO: 17655 - DNA, 21 bp, Hordeum vulgare
tcaaagctacscacgactgcg

SEQ ID NO: 17656 - DNA, 21 bp, Hordeum vulgare
gagtgattcasatgtgattgc

SEQ ID NO: 17657 - DNA, 21 bp, Hordeum vulgare
cacactcgttmacacacgaca

SEQ ID NO: 17658 - DNA, 21 bp, Hordeum vulgare
ggccgtggccstgagagtcgt

SEQ ID NO: 17659 - DNA, 21 bp, Hordeum vulgare
ggccgtcgagrgccatgaact

SEQ ID NO: 17660 - DNA, 21 bp, Hordeum vulgare
ggatgcagtcrgcgaacttgc

SEQ ID NO: 17661 - DNA, 21 bp, Hordeum vulgare
ctcgtgaagartgacacaggc

SEQ ID NO: 17662 - DNA, 21 bp, Hordeum vulgare
tccatgaggcygaacctaact

SEQ ID NO: 17663 - DNA, 21 bp, Hordeum vulgare
ataagaaatcrtcagaaacag

SEQ ID NO: 17664 - DNA, 21 bp, Hordeum vulgare
agaaacagtgrgaaaacctag

SEQ ID NO: 17665 - DNA, 21 bp, Hordeum vulgare
atataagttcwctaattttgc

SEQ ID NO: 17666 - DNA, 21 bp, Hordeum vulgare
tctaaacgatyattaccacca

SEQ ID NO: 17667 - DNA, 21 bp, Hordeum vulgare
gcctacacttyactgatgatt

SEQ ID NO: 17668 - DNA, 21 bp, Hordeum vulgare
atgactcacawtgtgacagca

SEQ ID NO: 17669 - DNA, 21 bp, Hordeum vulgare
cggactgaaaygagtgaacaa

SEQ ID NO: 17670 - DNA, 21 bp, Hordeum vulgare
taagaaagatsacatgaaaat

SEQ ID NO: 17671 - DNA, 21 bp, Hordeum vulgare
gttcattctcrgccaaggtca

SEQ ID NO: 17672 - DNA, 21 bp, Hordeum vulgare
gacagacgccratggacatgc

SEQ ID NO: 17673 - DNA, 21 bp, Hordeum vulgare
gtatttccggraattctgcag

SEQ ID NO: 17674 - DNA, 21 bp, Hordeum vulgare
gcacgcatgtrtccttgaatt

SEQ ID NO: 17675 - DNA, 21 bp, Hordeum vulgare
cctccgactastcgatcttat

SEQ ID NO: 17676 - DNA, 21 bp, Hordeum vulgare
gctggcggcgscgccgttgcc

SEQ ID NO: 17677 - DNA, 21 bp, Hordeum vulgare
tcactcgtaaygacatgatca

SEQ ID NO: 17678 - DNA, 21 bp, Hordeum vulgare
acgtcctgtgmtttgcgtgcc

SEQ ID NO: 17679 - DNA, 21 bp, Hordeum vulgare
gcgaccgccayctcaggctcg

SEQ ID NO: 17680 - DNA, 21 bp, Hordeum vulgare
cgacgggagastggccagcca

SEQ ID NO: 17681 - DNA, 21 bp, Hordeum vulgare
caccactgctygattgttcat

SEQ ID NO: 17682 - DNA, 21 bp, Hordeum vulgare
tatgagactacactgtgtcct

SEQ ID NO: 17683 - DNA, 16 bp, Hordeum vulgare
ttgagataaactggtt

SEQ ID NO: 17684 - DNA, 21 bp, Hordeum vulgare
ccgtcgactcsggcggattta

SEQ ID NO: 17685 - DNA, 21 bp, Hordeum vulgare
tctcggcctcrgtgaactcca

SEQ ID NO: 17686 - DNA, 21 bp, Hordeum vulgare
aaagcacaatrccacataaat

SEQ ID NO: 17687 - DNA, 21 bp, Hordeum vulgare
cattcatgttrctctcggcct

SEQ ID NO: 17688 - DNA, 21 bp, Hordeum vulgare
cgaaatatggycgcacctgtg

SEQ ID NO: 17689 - DNA, 21 bp, Hordeum vulgare
aagaaaaatgwgaggagagaa

SEQ ID NO: 17690 - DNA, 21 bp, Hordeum vulgare
acaagtcaagyaagccgtacg

SEQ ID NO: 17691 - DNA, 21 bp, Hordeum vulgare
caccattgttkggcmatttac

SEQ ID NO: 17692 - DNA, 21 bp, Hordeum vulgare
attgttkggcmatttacagca

SEQ ID NO: 17693 - DNA, 21 bp, Hordeum vulgare
ccaaccagcasaaaacagttt

SEQ ID NO: 17694 - DNA, 21 bp, Hordeum vulgare
gcacggaccarcatcaaaggt

SEQ ID NO: 17695 - DNA, 21 bp, Hordeum vulgare
atcataagaaygatttggaga

SEQ ID NO: 17696 - DNA, 21 bp, Hordeum vulgare
tcgtgccccayctccctcgtt

SEQ ID NO: 17697 - DNA, 21 bp, Hordeum vulgare
tgtctgggcargtgtggagcg

SEQ ID NO: 17698 - DNA, 21 bp, Hordeum vulgare
gaagctactcrtcagttagga

SEQ ID NO: 17699 - DNA, 21 bp, Hordeum vulgare
aatccgcatgrtgcagcgatg

SEQ ID NO: 17700 - DNA, 21 bp, Hordeum vulgare
gccctgcccgycggctccgca

SEQ ID NO: 17701 - DNA, 21 bp, Hordeum vulgare
cacctgatacratgaagatgt

SEQ ID NO: 17702 - DNA, 21 bp, Hordeum vulgare
aaaactcgtcrgcgctgctgt

SEQ ID NO: 17703 - DNA, 21 bp, Hordeum vulgare
ccacacttgtrattagcaacc

SEQ ID NO: 17704 - DNA, 21 bp, Hordeum vulgare
cgttcataacrcatcaccatt

SEQ ID NO: 17705 - DNA, 21 bp, Hordeum vulgare
cgtgcctaacracctgaaacg

SEQ ID NO: 17706 - DNA, 21 bp, Hordeum vulgare
tctgaatgatrgtgtgaaaga

SEQ ID NO: 17707 - DNA, 21 bp, Hordeum vulgare
ctgcatttggrttggttccag

SEQ ID NO: 17708 - DNA, 21 bp, Hordeum vulgare
tctggacttgygacgccacga

SEQ ID NO: 17709 - DNA, 21 bp, Hordeum vulgare
acacagtttartaatactgta

SEQ ID NO: 17710 - DNA, 21 bp, Hordeum vulgare
ttctgtactamaagagatgac

SEQ ID NO: 17711 - DNA, 21 bp, Hordeum vulgare
ccctgaagtcrctgcccttga

SEQ ID NO: 17712 - DNA, 21 bp, Hordeum vulgare
gggatgagtcsagcgactcga

SEQ ID NO: 17713 - DNA, 21 bp, Hordeum vulgare
agtcacacttycagggtcgac

SEQ ID NO: 17714 - DNA, 21 bp, Hordeum vulgare
tttgagacgcycgactagtcg

SEQ ID NO: 17715 - DNA, 21 bp, Hordeum vulgare
tgaaattatcrtgaaacggaa

SEQ ID NO: 17716 - DNA, 21 bp, Hordeum vulgare
agaggaagccrtccctgcgat

SEQ ID NO: 17717 - DNA, 21 bp, Hordeum vulgare
taaacacagaygcagcttagc

SEQ ID NO: 17718 - DNA, 21 bp, Hordeum vulgare
catgctgatcmatactgctct

SEQ ID NO: 17719 - DNA, 21 bp, Hordeum vulgare
ttgccagtaaytacagcagtt

SEQ ID NO: 17720 - DNA, 21 bp, Hordeum vulgare
tactttgagaygcagaaagca

SEQ ID NO: 17721 - DNA, 21 bp, Hordeum vulgare
atgaacatackaaaatctaac

SEQ ID NO: 17722 - DNA, 21 bp, Hordeum vulgare
acaagtagagmcaaaaggtga

SEQ ID NO: 17723 - DNA, 21 bp, Hordeum vulgare
caaaacaattyagccacaaaa

SEQ ID NO: 17724 - DNA, 21 bp, Hordeum vulgare
cagatggagcyggcgccttca

SEQ ID NO: 17725 - DNA, 21 bp, Hordeum vulgare
gtactccctcytggtgtcgaa

SEQ ID NO: 17726 - DNA, 21 bp, Hordeum vulgare
tagacattacygggagaatcc

SEQ ID NO: 17727 - DNA, 21 bp, Hordeum vulgare
atgtccaaaargaaagtcagc

SEQ ID NO: 17728 - DNA, 21 bp, Hordeum vulgare
tcatggtacakaaatcttaca

SEQ ID NO: 17729 - DNA, 21 bp, Hordeum vulgare
ttacttgtttygttgatagac

SEQ ID NO: 17730 - DNA, 21 bp, Hordeum vulgare
ctccatggtgmgccgacggtg

SEQ ID NO: 17731 - DNA, 21 bp, Hordeum vulgare
acatcttgccrtcgaacttgt

SEQ ID NO: 17732 - DNA, 21 bp, Hordeum vulgare
tccgcacggcsaccgccctgc

SEQ ID NO: 17733 - DNA, 21 bp, Hordeum vulgare
tcttcctcgtygtcgtcgaga

SEQ ID NO: 17734 - DNA, 21 bp, Hordeum vulgare
gaagtacttgytcctctcggc

SEQ ID NO: 17735 - DNA, 21 bp, Hordeum vulgare
gactaatagargcctatatga

SEQ ID NO: 17736 - DNA, 21 bp, Hordeum vulgare
acatatcgcayatatctgagc

SEQ ID NO: 17737 - DNA, 21 bp, Hordeum vulgare
ggcaaccatcrttaggcacaa

SEQ ID NO: 17738 - DNA, 21 bp, Hordeum vulgare
caaaggcagcratcttcttcc

SEQ ID NO: 17739 - DNA, 21 bp, Hordeum vulgare
tcttcttcccrttcttcacca

SEQ ID NO: 17740 - DNA, 21 bp, Hordeum vulgare
acttcaggttrtataggacat

SEQ ID NO: 17741 - DNA, 21 bp, Hordeum vulgare
ccttaacagtscattccatcc

SEQ ID NO: 17742 - DNA, 21 bp, Hordeum vulgare
caagcggtaakcataactaca

SEQ ID NO: 17743 - DNA, 21 bp, Hordeum vulgare
aggttcatcarttccctttcc

SEQ ID NO: 17744 - DNA, 21 bp, Hordeum vulgare
taatccaccgmccctcaatct

SEQ ID NO: 17745 - DNA, 21 bp, Hordeum vulgare
gctaggactgyaaaataaacg

SEQ ID NO: 17746 - DNA, 21 bp, Hordeum vulgare
atccaaattasaaccacttcc

SEQ ID NO: 17747 - DNA, 21 bp, Hordeum vulgare
gaacagaagawtgccattaac

SEQ ID NO: 17748 - DNA, 21 bp, Hordeum vulgare
tagctggcggrtaacagtttc

SEQ ID NO: 17749 - DNA, 21 bp, Hordeum vulgare
tcctcttcgarctgtagggga

SEQ ID NO: 17750 - DNA, 21 bp, Hordeum vulgare
cgcccttgccsagacccttgc

SEQ ID NO: 17751 - DNA, 21 bp, Hordeum vulgare
agatcttgagsacgccgcggg

SEQ ID NO: 17752 - DNA, 21 bp, Hordeum vulgare
caacggaggcrgcgcactgtc

SEQ ID NO: 17753 - DNA, 21 bp, Hordeum vulgare
ccgcgatggcragggcggcgc

SEQ ID NO: 17754 - DNA, 21 bp, Hordeum vulgare
gggtagtttcsaagctgaagt

SEQ ID NO: 17755 - DNA, 21 bp, Hordeum vulgare
caaattgatcrcagactccac

SEQ ID NO: 17756 - DNA, 21 bp, Hordeum vulgare
actactaagaragtccagctg

SEQ ID NO: 17757 - DNA, 21 bp, Hordeum vulgare
cagaccagacmacagagatga

SEQ ID NO: 17758 - DNA, 21 bp, Hordeum vulgare
acctgtcctgyttcagcgcgt

SEQ ID NO: 17759 - DNA, 21 bp, Hordeum vulgare
acggcgtcacrtacagcacga

SEQ ID NO: 17760 - DNA, 21 bp, Hordeum vulgare
aaccccgccasttgtataaga

SEQ ID NO: 17761 - DNA, 21 bp, Hordeum vulgare
tatcagggatycaggagggga

SEQ ID NO: 17762 - DNA, 21 bp, Hordeum vulgare
ttcacgagtgyacactacaat

SEQ ID NO: 17763 - DNA, 21 bp, Hordeum vulgare
caggaggggasgagcgatcgc

SEQ ID NO: 17764 - DNA, 21 bp, Hordeum vulgare
gaataacgacstacaaatcsa

SEQ ID NO: 17765 - DNA, 21 bp, Hordeum vulgare
cstacaaatcsagtatactag

SEQ ID NO: 17766 - DNA, 21 bp, Hordeum vulgare
catagggctcstcgttatcaa

SEQ ID NO: 17767 - DNA, 21 bp, Hordeum vulgare
tctcacattcraagattgtag

SEQ ID NO: 17768 - DNA, 21 bp, Hordeum vulgare
tttgtctgagygcatgagctt

SEQ ID NO: 17769 - DNA, 21 bp, Hordeum vulgare
caagtgagtamactgactgtt

SEQ ID NO: 17770 - DNA, 21 bp, Hordeum vulgare
cgattgacgtkgcaccctctg

SEQ ID NO: 17771 - DNA, 21 bp, Hordeum vulgare
aggaattttgsatgataaact

SEQ ID NO: 17772 - DNA, 18 bp, Hordeum vulgare
atccgcagtggacgcatt

SEQ ID NO: 17773 - DNA, 21 bp, Hordeum vulgare
gtttctgcaggggcacgcatc

SEQ ID NO: 17774 - DNA, 21 bp, Hordeum vulgare
agaatggcgasattagaaata

SEQ ID NO: 17775 - DNA, 21 bp, Hordeum vulgare
cctggccgcgsgacctttata

SEQ ID NO: 17776 - DNA, 21 bp, Hordeum vulgare
attttgattcrcacctgcact

SEQ ID NO: 17777 - DNA, 21 bp, Hordeum vulgare
cagagtatacyagacgtagta

SEQ ID NO: 17778 - DNA, 21 bp, Hordeum vulgare
tattgtcgacmctcacacagc

SEQ ID NO: 17779 - DNA, 21 bp, Hordeum vulgare
aataccaagtmacccgttgtg

SEQ ID NO: 17780 - DNA, 21 bp, Hordeum vulgare
atgaatggccrggcasaatgc

SEQ ID NO: 17781 - DNA, 21 bp, Hordeum vulgare
tggccrggcasaatgcatatt

SEQ ID NO: 17782 - DNA, 21 bp, Hordeum vulgare
agctaactagsgccaacgcct

SEQ ID NO: 17783 - DNA, 21 bp, Hordeum vulgare
caaggcgcccrttcttgacct

SEQ ID NO: 17784 - DNA, 21 bp, Hordeum vulgare
cgaagctgccrccagggtaga

SEQ ID NO: 17785 - DNA, 21 bp, Hordeum vulgare
gttttggctckcctagcaagg

SEQ ID NO: 17786 - DNA, 21 bp, Hordeum vulgare
cattttgtctyttgttttctc

SEQ ID NO: 17787 - DNA, 21 bp, Hordeum vulgare
ctcggaccccyggagcagcag

SEQ ID NO: 17788 - DNA, 21 bp, Hordeum vulgare
ctccctcctcygttcctgatt

SEQ ID NO: 17789 - DNA, 21 bp, Hordeum vulgare
ccatgaggccratgatccacc

SEQ ID NO: 17790 - DNA, 21 bp, Hordeum vulgare
ttgccgtgctytgtatcggac

SEQ ID NO: 17791 - DNA, 21 bp, Hordeum vulgare
caacaaatacraaagtgagtt

SEQ ID NO: 17792 - DNA, 21 bp, Hordeum vulgare
aatcggccggrgaccatcaga

SEQ ID NO: 17793 - DNA, 21 bp, Hordeum vulgare
acgatgcagcrgacacaagct

SEQ ID NO: 17794 - DNA, 21 bp, Hordeum vulgare
ttgtcttttawaataagcatt

SEQ ID NO: 17795 - DNA, 21 bp, Hordeum vulgare
ttttattgacrgtgcaaaaca

SEQ ID NO: 17796 - DNA, 21 bp, Hordeum vulgare
aaactctgacrtgggatagaa

SEQ ID NO: 17797 - DNA, 21 bp, Hordeum vulgare
atgtgttgatyacagctgctc

SEQ ID NO: 17798 - DNA, 21 bp, Hordeum vulgare
tggtgcagacrggcgcggtga

SEQ ID NO: 17799 - DNA, 21 bp, Hordeum vulgare
ccacgacgtasgtacgtcgtt

SEQ ID NO: 17800 - DNA, 21 bp, Hordeum vulgare
agtcatttatytggaatgaag

SEQ ID NO: 17801 - DNA, 21 bp, Hordeum vulgare
actcaactaayttttaggtgg

SEQ ID NO: 17802 - DNA, 21 bp, Hordeum vulgare
cgaagctgccrccagggtaga

SEQ ID NO: 17803 - DNA, 21 bp, Hordeum vulgare
cgaggccaccstcgctgaaga

SEQ ID NO: 17804 - DNA, 21 bp, Hordeum vulgare
agctagttcasacatcgtcct

SEQ ID NO: 17805 - DNA, 21 bp, Hordeum vulgare
ggaatcttggrtagttggagc

SEQ ID NO: 17806 - DNA, 21 bp, Hordeum vulgare
tccatgacgawtccacacacc

SEQ ID NO: 17807 - DNA, 21 bp, Hordeum vulgare
ggtactggcarcatccatgac

SEQ ID NO: 17808 - DNA, 21 bp, Hordeum vulgare
tcctcttgctrtcttacagtc

SEQ ID NO: 17809 - DNA, 21 bp, Hordeum vulgare
agacaaagaarattgcaagtc

SEQ ID NO: 17810 - DNA, 21 bp, Hordeum vulgare
caggtcgttckggggaagcag

SEQ ID NO: 17811 - DNA, 21 bp, Hordeum vulgare
ctgcttgaaayatcaccataa

SEQ ID NO: 17812 - DNA, 21 bp, Hordeum vulgare
caaatgccttrtgtgcactgc

SEQ ID NO: 17813 - DNA, 21 bp, Hordeum vulgare
aaggtcttgcractgaaggcg

SEQ ID NO: 17814 - DNA, 21 bp, Hordeum vulgare
tagtaaaactytaaaaagact

SEQ ID NO: 17815 - DNA, 21 bp, Hordeum vulgare
ccatctccgcmttggcccagt

SEQ ID NO: 17816 - DNA, 21 bp, Hordeum vulgare
gctttcttggyagggtaagga

SEQ ID NO: 17817 - DNA, 21 bp, Hordeum vulgare
cctcgccgtcsagcacgctgc

SEQ ID NO: 17818 - DNA, 21 bp, Hordeum vulgare
acgagtggtcktcccagccag

SEQ ID NO: 17819 - DNA, 21 bp, Hordeum vulgare
ttaacagccgrcggctgaacg

SEQ ID NO: 17820 - DNA, 21 bp, Hordeum vulgare
tccctaccttmcctggcctcc

SEQ ID NO: 17821 - DNA, 21 bp, Hordeum vulgare
tcccggagctmgcgttcgcgt

SEQ ID NO: 17822 - DNA, 21 bp, Hordeum vulgare
tctttcggagmtgctactcta

SEQ ID NO: 17823 - DNA, 21 bp, Hordeum vulgare
agtttcggggwaaatttatcc

SEQ ID NO: 17824 - DNA, 21 bp, Hordeum vulgare
cctccccgcaycgcagtgtgg

SEQ ID NO: 17825 - DNA, 21 bp, Hordeum vulgare
ggcagcatctsacgaaacacc

SEQ ID NO: 17826 - DNA, 21 bp, Hordeum vulgare
gaaaagagtgraaacatacaa

SEQ ID NO: 17827 - DNA, 21 bp, Hordeum vulgare
ttacatgtccwctgtgtctgc

SEQ ID NO: 17828 - DNA, 21 bp, Hordeum vulgare
gtgatggcaakgaattttatg

SEQ ID NO: 17829 - DNA, 21 bp, Hordeum vulgare
gtgacctcgtygaaacttggt

SEQ ID NO: 17830 - DNA, 21 bp, Hordeum vulgare
tgcggtacacygcgctcagcc

SEQ ID NO: 17831 - DNA, 21 bp, Hordeum vulgare
acaaacagctkcaatttccat

SEQ ID NO: 17832 - DNA, 21 bp, Hordeum vulgare
cgagccgacastgcacaccgc

SEQ ID NO: 17833 - DNA, 21 bp, Hordeum vulgare
ccgcgcctctygggtcaccgg

SEQ ID NO: 17834 - DNA, 21 bp, Hordeum vulgare
tgaaaaatgtyatatcattca

SEQ ID NO: 17835 - DNA, 21 bp, Hordeum vulgare
gacaggatgarcaacttgcct

SEQ ID NO: 17836 - DNA, 21 bp, Hordeum vulgare
ctcgattgccratgtatatga

SEQ ID NO: 17837 - DNA, 21 bp, Hordeum vulgare
ctttcctgatmatggagcaat

SEQ ID NO: 17838 - DNA, 21 bp, Hordeum vulgare
ctggtattggmggcaatggga

SEQ ID NO: 17839 - DNA, 21 bp, Hordeum vulgare
ccctgccggcratctcaccga

SEQ ID NO: 17840 - DNA, 21 bp, Hordeum vulgare
cagacatctcrtctgtccagg

SEQ ID NO: 17841 - DNA, 21 bp, Hordeum vulgare
atatggcaccsatacaaccct

SEQ ID NO: 17842 - DNA, 21 bp, Hordeum vulgare
gccaacaacaktgcacgtact

SEQ ID NO: 17843 - DNA, 21 bp, Hordeum vulgare
tagtaattgtwatgtagtagg

SEQ ID NO: 17844 - DNA, 21 bp, Hordeum vulgare
ggcctcggccrccatagaacc

SEQ ID NO: 17845 - DNA, 21 bp, Hordeum vulgare
cagatcacttrcaaatgtggt

SEQ ID NO: 17846 - DNA, 21 bp, Hordeum vulgare
gtttgtgtatsagaagaagag

SEQ ID NO: 17847 - DNA, 21 bp, Hordeum vulgare
agtcgttgtcyatctggtcat

SEQ ID NO: 17848 - DNA, 21 bp, Hordeum vulgare
tggccttcagytcaggcttca

SEQ ID NO: 17849 - DNA, 21 bp, Hordeum vulgare
ccagggcatastccttcctac

SEQ ID NO: 17850 - DNA, 21 bp, Hordeum vulgare
cctccaagtcrgaagagatga

SEQ ID NO: 17851 - DNA, 21 bp, Hordeum vulgare
ttgttttgtasagctgcaaag

SEQ ID NO: 17852 - DNA, 21 bp, Hordeum vulgare
tggagttggakatcatgcaca

SEQ ID NO: 17853 - DNA, 21 bp, Hordeum vulgare
agaagagatcrttcgccgcca

SEQ ID NO: 17854 - DNA, 21 bp, Hordeum vulgare
tcttgcacgascaatgaggtg

SEQ ID NO: 17855 - DNA, 21 bp, Hordeum vulgare
ccttgaaaacygacgagtagt

SEQ ID NO: 17856 - DNA, 21 bp, Hordeum vulgare
actgcggcacrctccaggtct

SEQ ID NO: 17857 - DNA, 21 bp, Hordeum vulgare
gagtgccaagyttccatagca

SEQ ID NO: 17858 - DNA, 21 bp, Hordeum vulgare
ggcttggagtyggaggtactg

SEQ ID NO: 17859 - DNA, 21 bp, Hordeum vulgare
gaatcagatgmacaagacagt

SEQ ID NO: 17860 - DNA, 21 bp, Hordeum vulgare
tcagtcctcaycaagtagcat

SEQ ID NO: 17861 - DNA, 21 bp, Hordeum vulgare
acaacacaagsaaatgaaggg

SEQ ID NO: 17862 - DNA, 21 bp, Hordeum vulgare
gatcaggatcrtcacttttcc

SEQ ID NO: 17863 - DNA, 21 bp, Hordeum vulgare
atacgctcttwatatgctaca

SEQ ID NO: 17864 - DNA, 21 bp, Hordeum vulgare
atgaagggggyaaaacaggtt

SEQ ID NO: 17865 - DNA, 21 bp, Hordeum vulgare
aggaggaggcrtcgtcagaaa

SEQ ID NO: 17866 - DNA, 21 bp, Hordeum vulgare
tattgttgggraccatctagt

SEQ ID NO: 17867 - DNA, 21 bp, Hordeum vulgare
agtcaacgagmtcgccccact

SEQ ID NO: 17868 - DNA, 21 bp, Hordeum vulgare
actgagagtcraccactgtat

SEQ ID NO: 17869 - DNA, 21 bp, Hordeum vulgare
tgtcgatgcasaagttgcgac

SEQ ID NO: 17870 - DNA, 21 bp, Hordeum vulgare
aatagtctgtytcagtctcac

SEQ ID NO: 17871 - DNA, 21 bp, Hordeum vulgare
caaaccaagawagcatcagtc

SEQ ID NO: 17872 - DNA, 21 bp, Hordeum vulgare
ccctcaggaargccaatgtga

SEQ ID NO: 17873 - DNA, 21 bp, Hordeum vulgare
atctctcctcracttgttcac

SEQ ID NO: 17874 - DNA, 21 bp, Hordeum vulgare
ttcttcttctwgggcaacgta

SEQ ID NO: 17875 - DNA, 21 bp, Hordeum vulgare
tttaggtaaaytgaacctcaa

SEQ ID NO: 17876 - DNA, 21 bp, Hordeum vulgare
gtgctgtcgcragcatgaccg

SEQ ID NO: 17877 - DNA, 21 bp, Hordeum vulgare
aaaaaaaaaaraaaaaaaaaa

SEQ ID NO: 17878 - DNA, 21 bp, Hordeum vulgare
aagagctgacygtggaaacca

SEQ ID NO: 17879 - DNA, 21 bp, Hordeum vulgare
aaaaaaaaaaraaaaaaaaaa

SEQ ID NO: 17880 - DNA, 21 bp, Hordeum vulgare
ttagggatgcyggatcaagta

SEQ ID NO: 17881 - DNA, 21 bp, Hordeum vulgare
tgggggcaccracctttcgga

SEQ ID NO: 17882 - DNA, 21 bp, Hordeum vulgare
aaacaagtgcmgaccatggcc

SEQ ID NO: 17883 - DNA, 21 bp, Hordeum vulgare
gcatgtactcrttggaggaac

SEQ ID NO: 17884 - DNA, 21 bp, Hordeum vulgare
ctcaacatcawacatactgct

SEQ ID NO: 17885 - DNA, 21 bp, Hordeum vulgare
caggaggaatrctaaactgct

SEQ ID NO: 17886 - DNA, 21 bp, Hordeum vulgare
gctagaatgtwctagatcagt

SEQ ID NO: 17887 - DNA, 21 bp, Hordeum vulgare
tggtcactcargcagaaagga

SEQ ID NO: 17888 - DNA, 21 bp, Hordeum vulgare
tgggggcaccracctttcgga

SEQ ID NO: 17889 - DNA, 21 bp, Hordeum vulgare
tgtgagggacragtcaatact

SEQ ID NO: 17890 - DNA, 21 bp, Hordeum vulgare
agtagatgcargggttcgaag

SEQ ID NO: 17891 - DNA, 21 bp, Hordeum vulgare
tgagcacatayatgtagtaga

SEQ ID NO: 17892 - DNA, 21 bp, Hordeum vulgare
atccgaggatycagcaggctg

SEQ ID NO: 17893 - DNA, 21 bp, Hordeum vulgare
tatgattgacrctacgacttt

SEQ ID NO: 17894 - DNA, 21 bp, Hordeum vulgare
atgaccatccrgtggggtagt

SEQ ID NO: 17895 - DNA, 21 bp, Hordeum vulgare
tcatgcttgaracggtgcaga

SEQ ID NO: 17896 - DNA, 21 bp, Hordeum vulgare
gacttcaaggkggttccacaa

SEQ ID NO: 17897 - DNA, 21 bp, Hordeum vulgare
acagtatatcrcacgagaaaa

SEQ ID NO: 17898 - DNA, 21 bp, Hordeum vulgare
gctggcctgtsgcaccattcg

SEQ ID NO: 17899 - DNA, 21 bp, Hordeum vulgare
tgtctgcagartgattctcca

SEQ ID NO: 17900 - DNA, 21 bp, Hordeum vulgare
gagtgaacagycttggaaagc

SEQ ID NO: 17901 - DNA, 21 bp, Hordeum vulgare
tcgccagctcrccgacaccac

SEQ ID NO: 17902 - DNA, 21 bp, Hordeum vulgare
ccattgcattkaacgattcca

SEQ ID NO: 17903 - DNA, 21 bp, Hordeum vulgare
aaataacttgwgtcatgttca

SEQ ID NO: 17904 - DNA, 21 bp, Hordeum vulgare
ggtgcacacgrgacacataac

SEQ ID NO: 17905 - DNA, 21 bp, Hordeum vulgare
tctgtggcttsgcaggatctt

SEQ ID NO: 17906 - DNA, 21 bp, Hordeum vulgare
tcatcatgtcmgcgccagata

SEQ ID NO: 17907 - DNA, 21 bp, Hordeum vulgare
acatgtttgcrgtgttgaggt

SEQ ID NO: 17908 - DNA, 21 bp, Hordeum vulgare
tgaagtggtckcgggggtgca

SEQ ID NO: 17909 - DNA, 21 bp, Hordeum vulgare
ccaccagcackccggcacctg

SEQ ID NO: 17910 - DNA, 21 bp, Hordeum vulgare
ggccgtatggmtccattggcg

SEQ ID NO: 17911 - DNA, 21 bp, Hordeum vulgare
gatttcttgarttgtaatccg

SEQ ID NO: 17912 - DNA, 21 bp, Hordeum vulgare
gcaacatccgmctagatttct

SEQ ID NO: 17913 - DNA, 21 bp, Hordeum vulgare
tgtagtccccrtgcaacttcc

SEQ ID NO: 17914 - DNA, 21 bp, Hordeum vulgare
ttttattaaaraaatagaaat

SEQ ID NO: 17915 - DNA, 21 bp, Hordeum vulgare
gacagggtcgrcaatgtggtc

SEQ ID NO: 17916 - DNA, 21 bp, Hordeum vulgare
taatatacatmgttggtgtta

SEQ ID NO: 17917 - DNA, 21 bp, Hordeum vulgare
gacggggtcgrcgatgtggtc

SEQ ID NO: 17918 - DNA, 21 bp, Hordeum vulgare
agccaaacatygagaacatgg

SEQ ID NO: 17919 - DNA, 21 bp, Hordeum vulgare
agagtgcgggsggctcagtag

SEQ ID NO: 17920 - DNA, 21 bp, Hordeum vulgare
ctgcgcaatgrccaacggtaa

SEQ ID NO: 17921 - DNA, 21 bp, Hordeum vulgare
cacactcatcratccattcgc

SEQ ID NO: 17922 - DNA, 21 bp, Hordeum vulgare
ccacatcaaaagagcagtcag

SEQ ID NO: 17923 - DNA, 20 bp, Hordeum vulgare
ccacatcaaagagcagtcag

SEQ ID NO: 17924 - DNA, 21 bp, Hordeum vulgare
ggtggaattcyttggtgtccc

SEQ ID NO: 17925 - DNA, 21 bp, Hordeum vulgare
ccagatgcttycatcctctca

SEQ ID NO: 17926 - DNA, 21 bp, Hordeum vulgare
gctctttgtcsgtgccttgca

SEQ ID NO: 17927 - DNA, 21 bp, Hordeum vulgare
caagcccagctccaaactacc

SEQ ID NO: 17928 - DNA, 20 bp, Hordeum vulgare
caagcccagcccaaactacc

SEQ ID NO: 17929 - DNA, 21 bp, Hordeum vulgare
ggacaatgggratgttctcac

SEQ ID NO: 17930 - DNA, 21 bp, Hordeum vulgare
cttgtggactygagtcatcac

SEQ ID NO: 17931 - DNA, 21 bp, Hordeum vulgare
ggagctccggrcgcacgaagt

SEQ ID NO: 17932 - DNA, 21 bp, Hordeum vulgare
cgtgctggcgytccagtagcc

SEQ ID NO: 17933 - DNA, 21 bp, Hordeum vulgare
cagcttaagcrcattcataac

SEQ ID NO: 17934 - DNA, 21 bp, Hordeum vulgare
cttatgtgatmataatactgc

SEQ ID NO: 17935 - DNA, 21 bp, Hordeum vulgare
agccttccacyggtatcattt

SEQ ID NO: 17936 - DNA, 21 bp, Hordeum vulgare
tgccaaacggracggtgccga

SEQ ID NO: 17937 - DNA, 21 bp, Hordeum vulgare
tgagcgaccgygtgtatatgt

SEQ ID NO: 17938 - DNA, 21 bp, Hordeum vulgare
tcttctgcccygccggaacat

SEQ ID NO: 17939 - DNA, 21 bp, Hordeum vulgare
atgtgcagcaratgagatgag

SEQ ID NO: 17940 - DNA, 21 bp, Hordeum vulgare
ctgcccagatrtatgattagg

SEQ ID NO: 17941 - DNA, 21 bp, Hordeum vulgare
ggaatggaatrtgcgaaatag

SEQ ID NO: 17942 - DNA, 21 bp, Hordeum vulgare
gatttaaaagrcttcttccag

SEQ ID NO: 17943 - DNA, 21 bp, Hordeum vulgare
agatgagaaaygacgcgacac

SEQ ID NO: 17944 - DNA, 21 bp, Hordeum vulgare
actcacatacrcagctttcaa

SEQ ID NO: 17945 - DNA, 21 bp, Hordeum vulgare
cgtagacatgrtcgccatcgc

SEQ ID NO: 17946 - DNA, 21 bp, Hordeum vulgare
cagggggcagmgtcataagat

SEQ ID NO: 17947 - DNA, 21 bp, Hordeum vulgare
agcactataaycgtccgaaac

SEQ ID NO: 17948 - DNA, 21 bp, Hordeum vulgare
atcacaactgygctacttttt

SEQ ID NO: 17949 - DNA, 21 bp, Hordeum vulgare
ccgctcctccrtacgatgatg

SEQ ID NO: 17950 - DNA, 21 bp, Hordeum vulgare
ggaatgactcratcaggtcgc

SEQ ID NO: 17951 - DNA, 21 bp, Hordeum vulgare
aaacttacttrgtgcacgact

SEQ ID NO: 17952 - DNA, 21 bp, Hordeum vulgare
taataaatttmcaaactcaaa

SEQ ID NO: 17953 - DNA, 21 bp, Hordeum vulgare
taaggtaggtwggttggttgg

SEQ ID NO: 17954 - DNA, 21 bp, Hordeum vulgare
ctactggctcygtcgctggat

SEQ ID NO: 17955 - DNA, 21 bp, Hordeum vulgare
tggtggtggayaaacatatat

SEQ ID NO: 17956 - DNA, 21 bp, Hordeum vulgare
attttgacttmggtcgcacct

SEQ ID NO: 17957 - DNA, 21 bp, Hordeum vulgare
aaaacaggatrtacacggcac

SEQ ID NO: 17958 - DNA, 21 bp, Hordeum vulgare
caatgggcggsgcggcgcagc

SEQ ID NO: 17959 - DNA, 21 bp, Hordeum vulgare
cgcagacaagycactggcagc

SEQ ID NO: 17960 - DNA, 21 bp, Hordeum vulgare
ccagttgcccscacgctgcag

SEQ ID NO: 17961 - DNA, 21 bp, Hordeum vulgare
ttgagcagatkgtcagtgttt

SEQ ID NO: 17962 - DNA, 21 bp, Hordeum vulgare
ctgtaggcaawgtgtggatgt

SEQ ID NO: 17963 - DNA, 21 bp, Hordeum vulgare
cgcgacaaacmgcggagcaca

SEQ ID NO: 17964 - DNA, 21 bp, Hordeum vulgare
ctaccgatgaycaaccgagtg

SEQ ID NO: 17965 - DNA, 21 bp, Hordeum vulgare
acaggtgctcsatcgactcac

SEQ ID NO: 17966 - DNA, 21 bp, Hordeum vulgare
tcgtcactgtygcaaatcata

SEQ ID NO: 17967 - DNA, 21 bp, Hordeum vulgare
aggacactgtkacaggttaag

SEQ ID NO: 17968 - DNA, 21 bp, Hordeum vulgare
acttgtgagayggtacgtacc

SEQ ID NO: 17969 - DNA, 21 bp, Hordeum vulgare
tytcagttctrtcgatgcagt

SEQ ID NO: 17970 - DNA, 21 bp, Hordeum vulgare
ttatctacctytcagttctrt

SEQ ID NO: 17971 - DNA, 21 bp, Hordeum vulgare
cttcctccgaycgattgccgc

SEQ ID NO: 17972 - DNA, 21 bp, Hordeum vulgare
ttccgctgtamctcgtggagc

SEQ ID NO: 17973 - DNA, 21 bp, Hordeum vulgare
atcaagcttayaaaacagaat

SEQ ID NO: 17974 - DNA, 21 bp, Hordeum vulgare
ttgcaaccccrccaccatcaa

SEQ ID NO: 17975 - DNA, 21 bp, Hordeum vulgare
tgcatcagaaygaatgtgcat

SEQ ID NO: 17976 - DNA, 21 bp, Hordeum vulgare
atataccttcyaccttacata

SEQ ID NO: 17977 - DNA, 21 bp, Hordeum vulgare
accgctgcaarggatcctgct

SEQ ID NO: 17978 - DNA, 21 bp, Hordeum vulgare
ctcatttctgkgacgaccgct

SEQ ID NO: 17979 - DNA, 21 bp, Hordeum vulgare
atgtcggtccrataaatactt

SEQ ID NO: 17980 - DNA, 21 bp, Hordeum vulgare
gagattgcacraaactacatg

SEQ ID NO: 17981 - DNA, 21 bp, Hordeum vulgare
tgcatcagaaygaatgtgcat

SEQ ID NO: 17982 - DNA, 21 bp, Hordeum vulgare
accaccatggrttctatgtcc

SEQ ID NO: 17983 - DNA, 21 bp, Hordeum vulgare
attgcttgaargcctcgaggt

SEQ ID NO: 17984 - DNA, 21 bp, Hordeum vulgare
agtatccgccrtacgtccaca

SEQ ID NO: 17985 - DNA, 21 bp, Hordeum vulgare
aggcgtcctcyagggcgcgct

SEQ ID NO: 17986 - DNA, 21 bp, Hordeum vulgare
ggttgtgttgycgcacgaacg

SEQ ID NO: 17987 - DNA, 21 bp, Hordeum vulgare
taacagcattrtcgacagtca

SEQ ID NO: 17988 - DNA, 21 bp, Hordeum vulgare
ggatgtgcagkggcacctaca

SEQ ID NO: 17989 - DNA, 21 bp, Hordeum vulgare
gcaccacccgycggccgtcga

SEQ ID NO: 17990 - DNA, 21 bp, Hordeum vulgare
ggcagcagcckgtgcggcacc

SEQ ID NO: 17991 - DNA, 21 bp, Hordeum vulgare
agcagcatgaygaggtccttg

SEQ ID NO: 17992 - DNA, 21 bp, Hordeum vulgare
agccggaggtkagcagggccg

SEQ ID NO: 17993 - DNA, 21 bp, Hordeum vulgare
cggcgtcctcytcctcggcat

SEQ ID NO: 17994 - DNA, 21 bp, Hordeum vulgare
gacctcctccrtcttgctctc

SEQ ID NO: 17995 - DNA, 21 bp, Hordeum vulgare
accttctacargtgccaaggc

SEQ ID NO: 17996 - DNA, 21 bp, Hordeum vulgare
gcagatatgtwcacatcccgt

SEQ ID NO: 17997 - DNA, 21 bp, Hordeum vulgare
tcatacagtascggcggcggg

SEQ ID NO: 17998 - DNA, 21 bp, Hordeum vulgare
ccatgtatcarattgtctcat

SEQ ID NO: 17999 - DNA, 21 bp, Hordeum vulgare
taaaaatcccytgcgttcacc

SEQ ID NO: 18000 - DNA, 21 bp, Hordeum vulgare
attatagaagrttatctttca

SEQ ID NO: 18001 - DNA, 21 bp, Hordeum vulgare
caatggtgtgyagacacaggt

SEQ ID NO: 18002 - DNA, 21 bp, Hordeum vulgare
cggagaagaakgcttcaaggt

SEQ ID NO: 18003 - DNA, 21 bp, Hordeum vulgare
ttcgtccactrcctcgatgaa

SEQ ID NO: 18004 - DNA, 21 bp, Hordeum vulgare
catcctttgargtcctgatac

SEQ ID NO: 18005 - DNA, 21 bp, Hordeum vulgare
tctcaagaggytcaactaacg

SEQ ID NO: 18006 - DNA, 21 bp, Hordeum vulgare
agaatcaatcrtcaactagta

SEQ ID NO: 18007 - DNA, 21 bp, Hordeum vulgare
agaagtggacrttatcttgct

SEQ ID NO: 18008 - DNA, 21 bp, Hordeum vulgare
acttgactcawctatgtccta

SEQ ID NO: 18009 - DNA, 21 bp, Hordeum vulgare
tgttgagtgcrtcttcttcca

SEQ ID NO: 18010 - DNA, 21 bp, Hordeum vulgare
gttcacagaaraaagtagctc

SEQ ID NO: 18011 - DNA, 21 bp, Hordeum vulgare
cgccgtcataygcagagagga

SEQ ID NO: 18012 - DNA, 21 bp, Hordeum vulgare
catcgtttgcytcattgcttc

SEQ ID NO: 18013 - DNA, 21 bp, Hordeum vulgare
cattgtatcarcatctcggat

SEQ ID NO: 18014 - DNA, 21 bp, Hordeum vulgare
gggggtcctcracgacgtcct

SEQ ID NO: 18015 - DNA, 21 bp, Hordeum vulgare
aataaggcttycgtagacacc

SEQ ID NO: 18016 - DNA, 21 bp, Hordeum vulgare
gtcaattgacrgcgccccctc

SEQ ID NO: 18017 - DNA, 21 bp, Hordeum vulgare
cccctccgatyagcggatcat

SEQ ID NO: 18018 - DNA, 21 bp, Hordeum vulgare
cckttccttcstgcgtatgct

SEQ ID NO: 18019 - DNA, 21 bp, Hordeum vulgare
ttgctccacckttccttcstg

SEQ ID NO: 18020 - DNA, 21 bp, Hordeum vulgare
ttgcctgcttygtcaggcgag

SEQ ID NO: 18021 - DNA, 21 bp, Hordeum vulgare
atacaccacakgacgccatta

SEQ ID NO: 18022 - DNA, 21 bp, Hordeum vulgare
agtacaggtayaagaaatgat

SEQ ID NO: 18023 - DNA, 21 bp, Hordeum vulgare
ctttgtcctcyaatgtcagat

SEQ ID NO: 18024 - DNA, 21 bp, Hordeum vulgare
gccttgccatyggtcttcctc

SEQ ID NO: 18025 - DNA, 21 bp, Hordeum vulgare
tgtgctcgacrgtcttcagtt

SEQ ID NO: 18026 - DNA, 21 bp, Hordeum vulgare
aaacataaccratcgtgacga

SEQ ID NO: 18027 - DNA, 21 bp, Hordeum vulgare
ttagtcgtccmtatatctttt

SEQ ID NO: 18028 - DNA, 21 bp, Hordeum vulgare
catcatctctrttgtatactt

SEQ ID NO: 18029 - DNA, 21 bp, Hordeum vulgare
tgtatacttgycacacacccg

SEQ ID NO: 18030 - DNA, 21 bp, Hordeum vulgare
acgaagtgctsagagataata

SEQ ID NO: 18031 - DNA, 21 bp, Hordeum vulgare
acaaaatgacmtgttaataca

SEQ ID NO: 18032 - DNA, 21 bp, Hordeum vulgare
acttagttgaygggttaaaag

SEQ ID NO: 18033 - DNA, 21 bp, Hordeum vulgare
ccactgatatkatagtaccta

SEQ ID NO: 18034 - DNA, 21 bp, Hordeum vulgare
gtgacgggttrcccaaatata

SEQ ID NO: 18035 - DNA, 21 bp, Hordeum vulgare
cactcaatatrtatactactt

SEQ ID NO: 18036 - DNA, 21 bp, Hordeum vulgare
cacccgactcsatcaggttct

SEQ ID NO: 18037 - DNA, 21 bp, Hordeum vulgare
acaccgaggcrgcgttctgga

SEQ ID NO: 18038 - DNA, 21 bp, Hordeum vulgare
cgcatctcgtyaccttggcgg

SEQ ID NO: 18039 - DNA, 21 bp, Hordeum vulgare
cagataaactytcaagaatga

SEQ ID NO: 18040 - DNA, 21 bp, Hordeum vulgare
gcttgctgccrtcggtcgtga

SEQ ID NO: 18041 - DNA, 21 bp, Hordeum vulgare
ctctaaggagratagagcaac

SEQ ID NO: 18042 - DNA, 21 bp, Hordeum vulgare
tgacgacgacrtcgtacatgt

SEQ ID NO: 18043 - DNA, 21 bp, Hordeum vulgare
tcatcaggaayacaagggtat

SEQ ID NO: 18044 - DNA, 21 bp, Hordeum vulgare
cggcgtaggcsagcttgtcgt

SEQ ID NO: 18045 - DNA, 21 bp, Hordeum vulgare
caaggacatcyctttgcattt

SEQ ID NO: 18046 - DNA, 21 bp, Hordeum vulgare
ccatatggtakacagtatgcc

SEQ ID NO: 18047 - DNA, 21 bp, Hordeum vulgare
ataaaatttcygagaacccaa

SEQ ID NO: 18048 - DNA, 21 bp, Hordeum vulgare
tttcataaatwctctattctt

SEQ ID NO: 18049 - DNA, 21 bp, Hordeum vulgare
ttgtgcatccrttttttatgt

SEQ ID NO: 18050 - DNA, 21 bp, Hordeum vulgare
tcgagtttgcrgatctccgta

SEQ ID NO: 18051 - DNA, 21 bp, Hordeum vulgare
acccaagtaayccatatggta

SEQ ID NO: 18052 - DNA, 21 bp, Hordeum vulgare
tgcatcgctcrtcaaacatga

SEQ ID NO: 18053 - DNA, 21 bp, Hordeum vulgare
cacactgcacsgcagaaaact

SEQ ID NO: 18054 - DNA, 21 bp, Hordeum vulgare
cgccgaaaagygtcgcggcgg

SEQ ID NO: 18055 - DNA, 21 bp, Hordeum vulgare
cgagatcttcygaagggtata

SEQ ID NO: 18056 - DNA, 21 bp, Hordeum vulgare
aatccagacaycctaagacac

SEQ ID NO: 18057 - DNA, 21 bp, Hordeum vulgare
tacgcagacartgagatttta

SEQ ID NO: 18058 - DNA, 21 bp, Hordeum vulgare
cctgcagaatsgacaaactat

SEQ ID NO: 18059 - DNA, 21 bp, Hordeum vulgare
gtggcaaggcytgtagatctg

SEQ ID NO: 18060 - DNA, 21 bp, Hordeum vulgare
gcaggttgtcraagccgatga

SEQ ID NO: 18061 - DNA, 21 bp, Hordeum vulgare
actgcacctgmcgcaggttgt

SEQ ID NO: 18062 - DNA, 21 bp, Hordeum vulgare
agccgatgatrcggacgtagg

SEQ ID NO: 18063 - DNA, 21 bp, Hordeum vulgare
ggttacttcawcttgcacttt

SEQ ID NO: 18064 - DNA, 21 bp, Hordeum vulgare
tcaggtagtcracctgcttca

SEQ ID NO: 18065 - DNA, 21 bp, Hordeum vulgare
tgtgtggcgtsggtgcacccg

SEQ ID NO: 18066 - DNA, 21 bp, Hordeum vulgare
agtatcggccrtcgtagtacc

SEQ ID NO: 18067 - DNA, 21 bp, Hordeum vulgare
tgacctcctcsacctcattga

SEQ ID NO: 18068 - DNA, 21 bp, Hordeum vulgare
ggagggcctcmgtggtgaggg

SEQ ID NO: 18069 - DNA, 21 bp, Hordeum vulgare
ggtcgcctacsggtgagcatt

SEQ ID NO: 18070 - DNA, 21 bp, Hordeum vulgare
tgctgaactcsaggcagggca

SEQ ID NO: 18071 - DNA, 21 bp, Hordeum vulgare
acagcaggatscacaatggaa

SEQ ID NO: 18072 - DNA, 21 bp, Hordeum vulgare
gaaggcctggmgcctgggggt

SEQ ID NO: 18073 - DNA, 21 bp, Hordeum vulgare
tcccaggccamaactcctctc

SEQ ID NO: 18074 - DNA, 21 bp, Hordeum vulgare
gcttcggtggsackggcttct

SEQ ID NO: 18075 - DNA, 21 bp, Hordeum vulgare
tcggtggsackggcttcttgt

SEQ ID NO: 18076 - DNA, 21 bp, Hordeum vulgare
cctgtgggaasaccatgatgt

SEQ ID NO: 18077 - DNA, 21 bp, Hordeum vulgare
cggcggacggsaggttgttgg

SEQ ID NO: 18078 - DNA, 21 bp, Hordeum vulgare
agagcttgatyagccgctgcc

SEQ ID NO: 18079 - DNA, 21 bp, Hordeum vulgare
tttcgtcatcrtcaaagcgag

SEQ ID NO: 18080 - DNA, 21 bp, Hordeum vulgare
tccgagtaagkccgtgcaagt

SEQ ID NO: 18081 - DNA, 21 bp, Hordeum vulgare
ctgcggaggcygaacggcttg

SEQ ID NO: 18082 - DNA, 21 bp, Hordeum vulgare
acttgggcgcygcctccagct

SEQ ID NO: 18083 - DNA, 21 bp, Hordeum vulgare
gctccttcttytccacgctct

SEQ ID NO: 18084 - DNA, 21 bp, Hordeum vulgare
gactccattcsgttccagcaa

SEQ ID NO: 18085 - DNA, 21 bp, Hordeum vulgare
acattgcttcycccacatggt

SEQ ID NO: 18086 - DNA, 21 bp, Hordeum vulgare
acaaagaaggycgttcatgat

SEQ ID NO: 18087 - DNA, 21 bp, Hordeum vulgare
tgatgatccarcaaacaaggg

SEQ ID NO: 18088 - DNA, 21 bp, Hordeum vulgare
tctgttgtacyttatgacaat

SEQ ID NO: 18089 - DNA, 21 bp, Hordeum vulgare
tcatgtcaatrcaaatcttta

SEQ ID NO: 18090 - DNA, 21 bp, Hordeum vulgare
tggttctattktagttttatt

SEQ ID NO: 18091 - DNA, 21 bp, Hordeum vulgare
acaaagaaggycgttcatgat

SEQ ID NO: 18092 - DNA, 21 bp, Hordeum vulgare
cttgttattccgaattggaaa

SEQ ID NO: 18093 - DNA, 20 bp, Hordeum vulgare
cttgttattcgaattggaaa

SEQ ID NO: 18094 - DNA, 21 bp, Hordeum vulgare
ataatataagwgtgtttttgt

SEQ ID NO: 18095 - DNA, 21 bp, Hordeum vulgare
gcttcttgacrttggttcggt

SEQ ID NO: 18096 - DNA, 21 bp, Hordeum vulgare
ggaaacagcaratcaagtaca

SEQ ID NO: 18097 - DNA, 21 bp, Hordeum vulgare
acgtcaagggrttccattctt

SEQ ID NO: 18098 - DNA, 21 bp, Hordeum vulgare
ggatgccctascataaactga

SEQ ID NO: 18099 - DNA, 21 bp, Hordeum vulgare
ctagcgccggmccgcaggcag

SEQ ID NO: 18100 - DNA, 21 bp, Hordeum vulgare
ttgtcggtggyctcgtcgccg

SEQ ID NO: 18101 - DNA, 21 bp, Hordeum vulgare
ggatcttgtgrtatagcactt

SEQ ID NO: 18102 - DNA, 21 bp, Hordeum vulgare
agcttcctcakcccaagcgtc

SEQ ID NO: 18103 - DNA, 21 bp, Hordeum vulgare
aagatagatasttgcagcaac

SEQ ID NO: 18104 - DNA, 21 bp, Hordeum vulgare
accagctagaycaccagcttc

SEQ ID NO: 18105 - DNA, 21 bp, Hordeum vulgare
ctgattcaatygactcctaac

SEQ ID NO: 18106 - DNA, 21 bp, Hordeum vulgare
acgggattcaragagggatct

SEQ ID NO: 18107 - DNA, 21 bp, Hordeum vulgare
catcagatatsgaatgatgca

SEQ ID NO: 18108 - DNA, 21 bp, Hordeum vulgare
cgtggtacttrtcgccgttga

SEQ ID NO: 18109 - DNA, 21 bp, Hordeum vulgare
aaaaacatgtygcataccaca

SEQ ID NO: 18110 - DNA, 21 bp, Hordeum vulgare
cgtgcactcascaagttcctc

SEQ ID NO: 18111 - DNA, 21 bp, Hordeum vulgare
tcggagcacgrttcggcgctc

SEQ ID NO: 18112 - DNA, 21 bp, Hordeum vulgare
gagaccgggcsggatccggcc

SEQ ID NO: 18113 - DNA, 21 bp, Hordeum vulgare
gcgagatttgrcctcacgata

SEQ ID NO: 18114 - DNA, 21 bp, Hordeum vulgare
agtcatagtcmgcrtccatgt

SEQ ID NO: 18115 - DNA, 21 bp, Hordeum vulgare
ctagcagcagsaggaggacta

SEQ ID NO: 18116 - DNA, 21 bp, Hordeum vulgare
tcgcaaggcawcacacgcaaa

SEQ ID NO: 18117 - DNA, 21 bp, Hordeum vulgare
ctagcagcagsaggaggacta

SEQ ID NO: 18118 - DNA, 21 bp, Hordeum vulgare
aagccgatcayacacacacac

SEQ ID NO: 18119 - DNA, 21 bp, Hordeum vulgare
gcgtacgtgcrcgagccatgc

SEQ ID NO: 18120 - DNA, 21 bp, Hordeum vulgare
cgtggtacttrtcgccgttga

SEQ ID NO: 18121 - DNA, 21 bp, Hordeum vulgare
cgaacgcgtcrctgtaaggaa

SEQ ID NO: 18122 - DNA, 21 bp, Hordeum vulgare
acaaaatggcracttcagggg

SEQ ID NO: 18123 - DNA, 21 bp, Hordeum vulgare
cgtcgcaaacrttattgccaa

SEQ ID NO: 18124 - DNA, 21 bp, Hordeum vulgare
atgggtcaggwatcgaagccg

SEQ ID NO: 18125 - DNA, 21 bp, Hordeum vulgare
atcctacggtyaacggtgaag

SEQ ID NO: 18126 - DNA, 21 bp, Hordeum vulgare
gctgaacataycccttttcac

SEQ ID NO: 18127 - DNA, 21 bp, Hordeum vulgare
ggcaaaatcaktgtagcaagg

SEQ ID NO: 18128 - DNA, 21 bp, Hordeum vulgare
gcaggtggtcracactgttaa

SEQ ID NO: 18129 - DNA, 21 bp, Hordeum vulgare
actcgcatgcyttcaacagca

SEQ ID NO: 18130 - DNA, 21 bp, Hordeum vulgare
ctgagctgacmcacacaagat

SEQ ID NO: 18131 - DNA, 20 bp, Hordeum vulgare
atgctcacattttctacaca

SEQ ID NO: 18132 - DNA, 21 bp, Hordeum vulgare
atgctcacatatttctacaca

SEQ ID NO: 18133 - DNA, 20 bp, Hordeum vulgare
tattcgaaccctgctatgct

SEQ ID NO: 18134 - DNA, 21 bp, Hordeum vulgare
tattcgaaccactgctatgct

SEQ ID NO: 18135 - DNA, 21 bp, Hordeum vulgare
ccgcgctggaygcgaagttcc

SEQ ID NO: 18136 - DNA, 21 bp, Hordeum vulgare
cgaggttcgcyaggttgccgt

SEQ ID NO: 18137 - DNA, 21 bp, Hordeum vulgare
gaaggcgctgstgaaggccgc

SEQ ID NO: 18138 - DNA, 21 bp, Hordeum vulgare
gcgcgatgttkcccatcttga

SEQ ID NO: 18139 - DNA, 21 bp, Hordeum vulgare
agctgatcctsacctggccct

SEQ ID NO: 18140 - DNA, 21 bp, Hordeum vulgare
gccgttgatcrccttgttaat

SEQ ID NO: 18141 - DNA, 21 bp, Hordeum vulgare
aattcaccttsgagcagctga

SEQ ID NO: 18142 - DNA, 21 bp, Hordeum vulgare
ggccctgcgarccggtcaacg

SEQ ID NO: 18143 - DNA, 21 bp, Hordeum vulgare
caccatggccraggcgaaggc

SEQ ID NO: 18144 - DNA, 21 bp, Hordeum vulgare
gcttgcgagcsctgccgacta

SEQ ID NO: 18145 - DNA, 21 bp, Hordeum vulgare
ttcaaaagtgrgaaaatacca

SEQ ID NO: 18146 - DNA, 21 bp, Hordeum vulgare
aattctgcttsggctgttccg

SEQ ID NO: 18147 - DNA, 21 bp, Hordeum vulgare
ggacatcaaakctacttgtat

SEQ ID NO: 18148 - DNA, 21 bp, Hordeum vulgare
ggtaacctgawtttattatag

SEQ ID NO: 18149 - DNA, 21 bp, Hordeum vulgare
tacctacagaygaggcaagtt

SEQ ID NO: 18150 - DNA, 21 bp, Hordeum vulgare
tttcacagccsgtgagggaca

SEQ ID NO: 18151 - DNA, 21 bp, Hordeum vulgare
taaataaatayaattctgaag

SEQ ID NO: 18152 - DNA, 21 bp, Hordeum vulgare
ttctgaaggtygttactccct

SEQ ID NO: 18153 - DNA, 21 bp, Hordeum vulgare
cgatggcgaaygacttcaaga

SEQ ID NO: 18154 - DNA, 21 bp, Hordeum vulgare
aacggaccctkcggcggctca

SEQ ID NO: 18155 - DNA, 21 bp, Hordeum vulgare
aggagtggccratgatgtacg

SEQ ID NO: 18156 - DNA, 21 bp, Hordeum vulgare
gaaggaacgartaggcgtagt

SEQ ID NO: 18157 - DNA, 21 bp, Hordeum vulgare
gcgtcaccgaygggcccctgc

SEQ ID NO: 18158 - DNA, 21 bp, Hordeum vulgare
tgccataggtytatcgttccg

SEQ ID NO: 18159 - DNA, 21 bp, Hordeum vulgare
tatcgttccgwttacctgttt

SEQ ID NO: 18160 - DNA, 21 bp, Hordeum vulgare
cgttccaaggkcgcgctcttg

SEQ ID NO: 18161 - DNA, 21 bp, Hordeum vulgare
tcgcctgtagygacgaggacg

SEQ ID NO: 18162 - DNA, 21 bp, Hordeum vulgare
gggtggtccaratgactaagt

SEQ ID NO: 18163 - DNA, 21 bp, Hordeum vulgare
ggagggcagayctgatctctt

SEQ ID NO: 18164 - DNA, 21 bp, Hordeum vulgare
gacagaaagargacacacgga

SEQ ID NO: 18165 - DNA, 21 bp, Hordeum vulgare
caagccagttsatatacatat

SEQ ID NO: 18166 - DNA, 21 bp, Hordeum vulgare
aaaagggatgrtggaatacaa

SEQ ID NO: 18167 - DNA, 21 bp, Hordeum vulgare
cgggttcaggyttgggctctg

SEQ ID NO: 18168 - DNA, 21 bp, Hordeum vulgare
atcaattgtcmgtcatcggcg

SEQ ID NO: 18169 - DNA, 21 bp, Hordeum vulgare
caaggaatgcwaaaaagatgc

SEQ ID NO: 18170 - DNA, 21 bp, Hordeum vulgare
aaatctgttcrgttgtgttgc

SEQ ID NO: 18171 - DNA, 21 bp, Hordeum vulgare
gagaatgttakaactaggagc

SEQ ID NO: 18172 - DNA, 21 bp, Hordeum vulgare
ttgagctgcamggaaggtctg

SEQ ID NO: 18173 - DNA, 21 bp, Hordeum vulgare
ttggatcttcrccgctggcat

SEQ ID NO: 18174 - DNA, 21 bp, Hordeum vulgare
gttgccgtcasaatcatcgat

SEQ ID NO: 18175 - DNA, 21 bp, Hordeum vulgare
gaggcacctastaaaatggta

SEQ ID NO: 18176 - DNA, 21 bp, Hordeum vulgare
aaaacctgcascagtttggat

SEQ ID NO: 18177 - DNA, 21 bp, Hordeum vulgare
gcctccgcggkaggttcttcc

SEQ ID NO: 18178 - DNA, 21 bp, Hordeum vulgare
actcgtcagcrtgcttcttct

SEQ ID NO: 18179 - DNA, 21 bp, Hordeum vulgare
ttcctcttggkgcttcctctt

SEQ ID NO: 18180 - DNA, 21 bp, Hordeum vulgare
ttggacttctstttctcctgc

SEQ ID NO: 18181 - DNA, 21 bp, Hordeum vulgare
gctagcatcarcatcagctgc

SEQ ID NO: 18182 - DNA, 21 bp, Hordeum vulgare
caatatttctracccgtcgtg

SEQ ID NO: 18183 - DNA, 21 bp, Hordeum vulgare
catatgcgcgrtcgtgcacat

SEQ ID NO: 18184 - DNA, 21 bp, Hordeum vulgare
gtacgtcttcrtaccggattc

SEQ ID NO: 18185 - DNA, 21 bp, Hordeum vulgare
cctagtttttrtagttagcta

SEQ ID NO: 18186 - DNA, 21 bp, Hordeum vulgare
tttattctggratccttattt

SEQ ID NO: 18187 - DNA, 21 bp, Hordeum vulgare
ttcgctggatwctaggactcc

SEQ ID NO: 18188 - DNA, 21 bp, Hordeum vulgare
ataccactcaraatctaggtc

SEQ ID NO: 18189 - DNA, 21 bp, Hordeum vulgare
ctgctcccacygaggcgccga

SEQ ID NO: 18190 - DNA, 21 bp, Hordeum vulgare
tgcttcatcayctatcactat

SEQ ID NO: 18191 - DNA, 21 bp, Hordeum vulgare
aattttggggyggagggagta

SEQ ID NO: 18192 - DNA, 21 bp, Hordeum vulgare
tacctttcgcraggcggagcg

SEQ ID NO: 18193 - DNA, 21 bp, Hordeum vulgare
tactggtcatsaggcgggagc

SEQ ID NO: 18194 - DNA, 21 bp, Hordeum vulgare
tctcggttccmgtttcagcct

SEQ ID NO: 18195 - DNA, 21 bp, Hordeum vulgare
atttatccgtsgagaccgaga

SEQ ID NO: 18196 - DNA, 21 bp, Hordeum vulgare
gcgcagggtgyagttctcctg

SEQ ID NO: 18197 - DNA, 21 bp, Hordeum vulgare
gcctcaattawaagattggaa

SEQ ID NO: 18198 - DNA, 21 bp, Hordeum vulgare
cagggcatccsatgtgacaac

SEQ ID NO: 18199 - DNA, 21 bp, Hordeum vulgare
cgtgccatatsaggttcaatc

SEQ ID NO: 18200 - DNA, 21 bp, Hordeum vulgare
atgctcgtctygcctcgagaa

SEQ ID NO: 18201 - DNA, 21 bp, Hordeum vulgare
ctagctatctraagcatgtct

SEQ ID NO: 18202 - DNA, 21 bp, Hordeum vulgare
gcaaccaaaawatattagcaa

SEQ ID NO: 18203 - DNA, 21 bp, Hordeum vulgare
gcaaccaaaawatattagcaa

SEQ ID NO: 18204 - DNA, 21 bp, Hordeum vulgare
  MISC_FEATURE (11): n is SNP, in which the one is g and the other is a or t or c
ttactctgaanagaaatgagt

SEQ ID NO: 18205 - DNA, 21 bp, Hordeum vulgare
tttgaacaccrcggacagcct

SEQ ID NO: 18206 - DNA, 21 bp, Hordeum vulgare
gttacttcggwtcgtcgccag

SEQ ID NO: 18207 - DNA, 21 bp, Hordeum vulgare
atactcgacgrgaagaaggga

SEQ ID NO: 18208 - DNA, 21 bp, Hordeum vulgare
tattgttgccwatactcacgc

SEQ ID NO: 18209 - DNA, 21 bp, Hordeum vulgare
gcgtagcgctycacatattgt

SEQ ID NO: 18210 - DNA, 21 bp, Hordeum vulgare
crwgcyyagaraaccttgcta

SEQ ID NO: 18211 - DNA, 21 bp, Hordeum vulgare
gaggcaaaaargagaaggata

SEQ ID NO: 18212 - DNA, 21 bp, Hordeum vulgare
ggttaattttsctcctgggac

SEQ ID NO: 18213 - DNA, 21 bp, Hordeum vulgare
gataggcaacyagaccagatt

SEQ ID NO: 18214 - DNA, 21 bp, Hordeum vulgare
aatacaacgcsaattaattta

SEQ ID NO: 18215 - DNA, 21 bp, Hordeum vulgare
aataagggcgrtcggttaatt

SEQ ID NO: 18216 - DNA, 21 bp, Hordeum vulgare
ttagtaagtcratgtctgcta

SEQ ID NO: 18217 - DNA, 21 bp, Hordeum vulgare
gcaccaacgcsctccagacta

SEQ ID NO: 18218 - DNA, 21 bp, Hordeum vulgare
gccacctgtgsgcaattatga

SEQ ID NO: 18219 - DNA, 21 bp, Hordeum vulgare
gcaagccatcrtcatcctcct

SEQ ID NO: 18220 - DNA, 21 bp, Hordeum vulgare
gcgacgatccytgcagagccc

SEQ ID NO: 18221 - DNA, 21 bp, Hordeum vulgare
ttaaaatggcsagattgccca

SEQ ID NO: 18222 - DNA, 21 bp, Hordeum vulgare
tcatagtagaractactactc

SEQ ID NO: 18223 - DNA, 21 bp, Hordeum vulgare
aatctacactraacaacatgc

SEQ ID NO: 18224 - DNA, 21 bp, Hordeum vulgare
gcaagcgggcrgcgttgcaat

SEQ ID NO: 18225 - DNA, 21 bp, Hordeum vulgare
ccttctagacwagcacacaga

SEQ ID NO: 18226 - DNA, 21 bp, Hordeum vulgare
cccaggaaaamctctacgcac

SEQ ID NO: 18227 - DNA, 21 bp, Hordeum vulgare
tctcaaaatakaaacaaccca

SEQ ID NO: 18228 - DNA, 21 bp, Hordeum vulgare
ttgcttcctcrtaaacccagt

SEQ ID NO: 18229 - DNA, 21 bp, Hordeum vulgare
ttgccgagtcsgagcaaaagc

SEQ ID NO: 18230 - DNA, 21 bp, Hordeum vulgare
taatttgccgygttagcttgt

SEQ ID NO: 18231 - DNA, 21 bp, Hordeum vulgare
tggcctccatwttgccgccac

SEQ ID NO: 18232 - DNA, 21 bp, Hordeum vulgare
agcaccttggwgctgctgaac

SEQ ID NO: 18233 - DNA, 21 bp, Hordeum vulgare
cattgcatgtwtagcacaacc

SEQ ID NO: 18234 - DNA, 21 bp, Hordeum vulgare
tcgtattcagrattcattgca

SEQ ID NO: 18235 - DNA, 21 bp, Hordeum vulgare
atacattatcktgagtgacta

SEQ ID NO: 18236 - DNA, 21 bp, Hordeum vulgare
gattgtagcarttagatacat

SEQ ID NO: 18237 - DNA, 21 bp, Hordeum vulgare
atgatgcacawttgcatctct

SEQ ID NO: 18238 - DNA, 21 bp, Hordeum vulgare
gtctttctctsgatagaataa

SEQ ID NO: 18239 - DNA, 21 bp, Hordeum vulgare
ggcaagtagcracatatgtcg

SEQ ID NO: 18240 - DNA, 21 bp, Hordeum vulgare
aaactttgtcrgatgcgtcga

SEQ ID NO: 18241 - DNA, 21 bp, Hordeum vulgare
ctggttgtcaycggtagctcc

SEQ ID NO: 18242 - DNA, 21 bp, Hordeum vulgare
cgactgcagcwgccatgaaga

SEQ ID NO: 18243 - DNA, 21 bp, Hordeum vulgare
ctttcgtgtayaaagctggag

SEQ ID NO: 18244 - DNA, 21 bp, Hordeum vulgare
aacgagcattraagattattt

SEQ ID NO: 18245 - DNA, 21 bp, Hordeum vulgare
gtcgatcagtrcacgtttcgc

SEQ ID NO: 18246 - DNA, 21 bp, Hordeum vulgare
cacatagactyaatgccccgt

SEQ ID NO: 18247 - DNA, 21 bp, Hordeum vulgare
acttcttctcragctcaatct

SEQ ID NO: 18248 - DNA, 21 bp, Hordeum vulgare
tgtagaatacytcagtgtcca

SEQ ID NO: 18249 - DNA, 21 bp, Hordeum vulgare
tgcttgaacgygcagtgagcc

SEQ ID NO: 18250 - DNA, 21 bp, Hordeum vulgare
ctcattgttcyggtttcacag

SEQ ID NO: 18251 - DNA, 21 bp, Hordeum vulgare
taaacaagtgygccctgagcc

SEQ ID NO: 18252 - DNA, 21 bp, Hordeum vulgare
caagtcatttwacttactgac

SEQ ID NO: 18253 - DNA, 21 bp, Hordeum vulgare
gggacgacagrtgacatctta

SEQ ID NO: 18254 - DNA, 21 bp, Hordeum vulgare
aatttcacacrtgtcatggga

SEQ ID NO: 18255 - DNA, 21 bp, Hordeum vulgare
gggactctatrtctcccatca

SEQ ID NO: 18256 - DNA, 21 bp, Hordeum vulgare
cagagcattckgaaagcatct

SEQ ID NO: 18257 - DNA, 21 bp, Hordeum vulgare
ctaacaatccraagctaaaag

SEQ ID NO: 18258 - DNA, 21 bp, Hordeum vulgare
aggcaatttawacaccacacg

SEQ ID NO: 18259 - DNA, 21 bp, Hordeum vulgare
cgtgctgctcygcgaaccgga

SEQ ID NO: 18260 - DNA, 21 bp, Hordeum vulgare
ttcgcatgatygcatctacag

SEQ ID NO: 18261 - DNA, 21 bp, Hordeum vulgare
accccgtatgrtacaacagcg

SEQ ID NO: 18262 - DNA, 21 bp, Hordeum vulgare
ctctaaccagmgtcaggatat

SEQ ID NO: 18263 - DNA, 21 bp, Hordeum vulgare
acattgcttawacactataga

SEQ ID NO: 18264 - DNA, 21 bp, Hordeum vulgare
tttcagaatgytggaggaata

SEQ ID NO: 18265 - DNA, 21 bp, Hordeum vulgare
ccgcgtttctyggggggtgct

SEQ ID NO: 18266 - DNA, 21 bp, Hordeum vulgare
gagtgtggtarcggtcaccca

SEQ ID NO: 18267 - DNA, 21 bp, Hordeum vulgare
gagactgtgaygcattcagcc

SEQ ID NO: 18268 - DNA, 21 bp, Hordeum vulgare
accgcttgcaratgccaacta

SEQ ID NO: 18269 - DNA, 21 bp, Hordeum vulgare
agtaccaatasctcataagca

SEQ ID NO: 18270 - DNA, 21 bp, Hordeum vulgare
ttggcttcagrgcggcattcg

SEQ ID NO: 18271 - DNA, 21 bp, Hordeum vulgare
gtacacaccckgggctctcac

SEQ ID NO: 18272 - DNA, 21 bp, Hordeum vulgare
ctttgtcaccraatccaagtt

SEQ ID NO: 18273 - DNA, 21 bp, Hordeum vulgare
taaaggcatcmtttagctaat

SEQ ID NO: 18274 - DNA, 21 bp, Hordeum vulgare
agtaaaatgartgaatttacg

SEQ ID NO: 18275 - DNA, 21 bp, Hordeum vulgare
gggaagtgatktctaggcgcc

SEQ ID NO: 18276 - DNA, 21 bp, Hordeum vulgare
gctagttcttwaagaaaatca

SEQ ID NO: 18277 - DNA, 21 bp, Hordeum vulgare
tcaagcattgygatgcatgtt

SEQ ID NO: 18278 - DNA, 21 bp, Hordeum vulgare
aagtgctacayccttggctgt

SEQ ID NO: 18279 - DNA, 21 bp, Hordeum vulgare
ttattgtttgygctgctgcat

SEQ ID NO: 18280 - DNA, 21 bp, Hordeum vulgare
tcaacgttacmaaacacaagt

SEQ ID NO: 18281 - DNA, 21 bp, Hordeum vulgare
tacagccaatrcaactaggat

SEQ ID NO: 18282 - DNA, 21 bp, Hordeum vulgare
gctgcattgtycaccgaccgc

SEQ ID NO: 18283 - DNA, 21 bp, Hordeum vulgare
gcatcaccaamattgaagtac

SEQ ID NO: 18284 - DNA, 21 bp, Hordeum vulgare
caaccatcagytggctaccaa

SEQ ID NO: 18285 - DNA, 21 bp, Hordeum vulgare
gcatacttcaycgttgcagcg

SEQ ID NO: 18286 - DNA, 21 bp, Hordeum vulgare
gtcgcagtctygttcatcatc

SEQ ID NO: 18287 - DNA, 21 bp, Hordeum vulgare
ccaaacttcasggcttgctga

SEQ ID NO: 18288 - DNA, 21 bp, Hordeum vulgare
cattcaggttytttttgttct

SEQ ID NO: 18289 - DNA, 21 bp, Hordeum vulgare
tattttccacrgtaaatggga

SEQ ID NO: 18290 - DNA, 21 bp, Hordeum vulgare
gaaatgagtcsagcgatggta

SEQ ID NO: 18291 - DNA, 21 bp, Hordeum vulgare
acaaagatcakcggggaggac

SEQ ID NO: 18292 - DNA, 21 bp, Hordeum vulgare
ataagccacakcaaagacaga

SEQ ID NO: 18293 - DNA, 21 bp, Hordeum vulgare
aaaaggagtaytgacttgata

SEQ ID NO: 18294 - DNA, 21 bp, Hordeum vulgare
cttgtgctggkgacggctgag

SEQ ID NO: 18295 - DNA, 21 bp, Hordeum vulgare
atggtttggtktttagggctg

SEQ ID NO: 18296 - DNA, 21 bp, Hordeum vulgare
cgctgcccaakgtcgagctac

SEQ ID NO: 18297 - DNA, 21 bp, Hordeum vulgare
atggcttcaamaaacgccgca

SEQ ID NO: 18298 - DNA, 21 bp, Hordeum vulgare
agagaaacgcktcctttggcc

SEQ ID NO: 18299 - DNA, 21 bp, Hordeum vulgare
agatgttgcayctgtcgtacc

SEQ ID NO: 18300 - DNA, 21 bp, Hordeum vulgare
gattggctgaytcttgcaagg

SEQ ID NO: 18301 - DNA, 21 bp, Hordeum vulgare
ttcccttcctrtcaccggttc

SEQ ID NO: 18302 - DNA, 21 bp, Hordeum vulgare
tatttttcaayaaccaaggac

SEQ ID NO: 18303 - DNA, 21 bp, Hordeum vulgare
agaaagagacrtgacaaatca

SEQ ID NO: 18304 - DNA, 21 bp, Hordeum vulgare
acgctgatggygaatccggac

SEQ ID NO: 18305 - DNA, 21 bp, Hordeum vulgare
cagatagcatktgtagcttct

SEQ ID NO: 18306 - DNA, 21 bp, Hordeum vulgare
ccacaggtggktcactatcca

SEQ ID NO: 18307 - DNA, 21 bp, Hordeum vulgare
tcaggccaaaracgatcatct

SEQ ID NO: 18308 - DNA, 21 bp, Hordeum vulgare
tagcctaatakaatttttagt

SEQ ID NO: 18309 - DNA, 21 bp, Hordeum vulgare
agttttttagrtttcacttag

SEQ ID NO: 18310 - DNA, 21 bp, Hordeum vulgare
ctctttttccmagccccataa

SEQ ID NO: 18311 - DNA, 21 bp, Hordeum vulgare
gtatgcagagygctcctgccc

SEQ ID NO: 18312 - DNA, 21 bp, Hordeum vulgare
tcgctatggckgcaaagaaga

SEQ ID NO: 18313 - DNA, 21 bp, Hordeum vulgare
aagctgaggcwgctcgctctt

SEQ ID NO: 18314 - DNA, 21 bp, Hordeum vulgare
tccttgtcccrgtattttctt

SEQ ID NO: 18315 - DNA, 21 bp, Hordeum vulgare
ttgaatgaagrtttaaaaact

SEQ ID NO: 18316 - DNA, 21 bp, Hordeum vulgare
acgatctaacrctgtacgaaa

SEQ ID NO: 18317 - DNA, 21 bp, Hordeum vulgare
ccttcagcggwgcatcaggta

SEQ ID NO: 18318 - DNA, 21 bp, Hordeum vulgare
cctttccatcrgagaatatgt

SEQ ID NO: 18319 - DNA, 21 bp, Hordeum vulgare
cccgatctgcrtaaccaagaa

SEQ ID NO: 18320 - DNA, 21 bp, Hordeum vulgare
tcaaaagtgayggaaagaaaa

SEQ ID NO: 18321 - DNA, 21 bp, Hordeum vulgare
aaaattggacraggttctcta

SEQ ID NO: 18322 - DNA, 21 bp, Hordeum vulgare
agtaagaaacrtcagctaata

SEQ ID NO: 18323 - DNA, 21 bp, Hordeum vulgare
gcttcttctayggttgcatat

SEQ ID NO: 18324 - DNA, 21 bp, Hordeum vulgare
atctaggattyatcccttcct

SEQ ID NO: 18325 - DNA, 21 bp, Hordeum vulgare
gagctcgacgrgtcctttagc

SEQ ID NO: 18326 - DNA, 21 bp, Hordeum vulgare
  MISC_FEATURE (11),(15),(16): n is SNP, in which the one is g and the other is a or t or c
aactactaccnggtnngcgac

SEQ ID NO: 18327 - DNA, 21 bp, Hordeum vulgare
cttcccrtacrgacagcacaa

SEQ ID NO: 18328 - DNA, 21 bp, Hordeum vulgare
ttagcttcccrtacrgacagc

SEQ ID NO: 18329 - DNA, 21 bp, Hordeum vulgare
catgcttccgytcagataatg

SEQ ID NO: 18330 - DNA, 21 bp, Hordeum vulgare
acccctccctmcccaacctgc

SEQ ID NO: 18331 - DNA, 21 bp, Hordeum vulgare
ttgcaatatgkgaccttacat

SEQ ID NO: 18332 - DNA, 21 bp, Hordeum vulgare
ctgcacctgayctgcatgtct

SEQ ID NO: 18333 - DNA, 21 bp, Hordeum vulgare
caaaaagataygagtgtttgt

SEQ ID NO: 18334 - DNA, 21 bp, Hordeum vulgare
agttcggcagytttgttgcca

SEQ ID NO: 18335 - DNA, 21 bp, Hordeum vulgare
aaacgatggarattaatcgtg

SEQ ID NO: 18336 - DNA, 21 bp, Hordeum vulgare
gatgtagcagwtgatcttaca

SEQ ID NO: 18337 - DNA, 21 bp, Hordeum vulgare
gatgacatttyacatgtcatt

SEQ ID NO: 18338 - DNA, 21 bp, Hordeum vulgare
ccttgagtttmttgcaaataa

SEQ ID NO: 18339 - DNA, 21 bp, Hordeum vulgare
gattcactggyccattcggat

SEQ ID NO: 18340 - DNA, 21 bp, Hordeum vulgare
caacagcttgwtcagtggtgc

SEQ ID NO: 18341 - DNA, 21 bp, Hordeum vulgare
ttgtgcggacwtcaacagctt

SEQ ID NO: 18342 - DNA, 21 bp, Hordeum vulgare
gctattttatmtcaatgatga

SEQ ID NO: 18343 - DNA, 21 bp, Hordeum vulgare
ttctaatcagkggtataatag

SEQ ID NO: 18344 - DNA, 21 bp, Hordeum vulgare
gtcgtgcagakcgccgtttgt

SEQ ID NO: 18345 - DNA, 21 bp, Hordeum vulgare
aagagttaggmaagaagaggc

SEQ ID NO: 18346 - DNA, 21 bp, Hordeum vulgare
agcagcgagargacagctgga

SEQ ID NO: 18347 - DNA, 21 bp, Hordeum vulgare
agctggcgttkgatctgttga

SEQ ID NO: 18348 - DNA, 21 bp, Hordeum vulgare
acaacagagarattatcacaa

SEQ ID NO: 18349 - DNA, 21 bp, Hordeum vulgare
aaaagttcttycttttaatcc

SEQ ID NO: 18350 - DNA, 21 bp, Hordeum vulgare
tggatctgctrgtgctggcgc

SEQ ID NO: 18351 - DNA, 21 bp, Hordeum vulgare
cctccttggccgccgcggata

SEQ ID NO: 18352 - DNA, 20 bp, Hordeum vulgare
cctccttggctgccgcggta

SEQ ID NO: 18353 - DNA, 21 bp, Hordeum vulgare
gaaatccttcrgcatagtttg

SEQ ID NO: 18354 - DNA, 21 bp, Hordeum vulgare
gtctcagacamggtacttcca

SEQ ID NO: 18355 - DNA, 21 bp, Hordeum vulgare
acagtacacamcgactgaata

SEQ ID NO: 18356 - DNA, 21 bp, Hordeum vulgare
atagaagcacrattgttgaga

SEQ ID NO: 18357 - DNA, 21 bp, Hordeum vulgare
gaccgccaacrttagcgcgcc

SEQ ID NO: 18358 - DNA, 21 bp, Hordeum vulgare
tattaagctaygaaaaatatt

SEQ ID NO: 18359 - DNA, 21 bp, Hordeum vulgare
ttactgcgacscacgcacaga

SEQ ID NO: 18360 - DNA, 21 bp, Hordeum vulgare
tagagtcgcgscatcttttgt

SEQ ID NO: 18361 - DNA, 21 bp, Hordeum vulgare
gtcttacaccmgatacttggg

SEQ ID NO: 18362 - DNA, 21 bp, Hordeum vulgare
aagctagcagstctcaaggac

SEQ ID NO: 18363 - DNA, 21 bp, Hordeum vulgare
gtactagggasacctcccaca

SEQ ID NO: 18364 - DNA, 21 bp, Hordeum vulgare
acagcgcacascgagacgacg

SEQ ID NO: 18365 - DNA, 21 bp, Hordeum vulgare
tctgtgctcayatggaatggg

SEQ ID NO: 18366 - DNA, 21 bp, Hordeum vulgare
aatatgaaaaygagaagtaac

SEQ ID NO: 18367 - DNA, 21 bp, Hordeum vulgare
caaaaaactamcacgagcaga

SEQ ID NO: 18368 - DNA, 21 bp, Hordeum vulgare
aactaaaatayactttaacgg

SEQ ID NO: 18369 - DNA, 21 bp, Hordeum vulgare
gtctctgacgrgcattcatga

SEQ ID NO: 18370 - DNA, 21 bp, Hordeum vulgare
tttctcatcgrtatctcccga

SEQ ID NO: 18371 - DNA, 21 bp, Hordeum vulgare
tgtaacttggmaccactcttg

SEQ ID NO: 18372 - DNA, 21 bp, Hordeum vulgare
aggtgtgtatsaaataccact

SEQ ID NO: 18373 - DNA, 21 bp, Hordeum vulgare
gtttagactgracagcaaagc

SEQ ID NO: 18374 - DNA, 21 bp, Hordeum vulgare
tttctttttcmaatccagaaa

SEQ ID NO: 18375 - DNA, 21 bp, Hordeum vulgare
ctgaaattatwttactaacat

SEQ ID NO: 18376 - DNA, 21 bp, Hordeum vulgare
ccatagatttrggtgactgga

SEQ ID NO: 18377 - DNA, 21 bp, Hordeum vulgare
ataatattaamaccttgatat

SEQ ID NO: 18378 - DNA, 21 bp, Hordeum vulgare
aacaacagttsctgttgacag

SEQ ID NO: 18379 - DNA, 21 bp, Hordeum vulgare
acaagaggcasataaattgag

SEQ ID NO: 18380 - DNA, 21 bp, Hordeum vulgare
ttttttttttwtttttttttt

SEQ ID NO: 18381 - DNA, 21 bp, Hordeum vulgare
cctggatcatwgcatagatgt

SEQ ID NO: 18382 - DNA, 21 bp, Hordeum vulgare
agttggggtgyaactctgata

SEQ ID NO: 18383 - DNA, 21 bp, Hordeum vulgare
ctacttgggtrtaaagctgtt

SEQ ID NO: 18384 - DNA, 21 bp, Hordeum vulgare
ctacatagaarcatgcaggtg

SEQ ID NO: 18385 - DNA, 21 bp, Hordeum vulgare
tcggagggagwattataattt

SEQ ID NO: 18386 - DNA, 21 bp, Hordeum vulgare
tgtatgccaaycgtaccttct

SEQ ID NO: 18387 - DNA, 21 bp, Hordeum vulgare
gtacaaaataycatacatata

SEQ ID NO: 18388 - DNA, 21 bp, Hordeum vulgare
ggttattgcamataaaagtga

SEQ ID NO: 18389 - DNA, 21 bp, Hordeum vulgare
aacaaatgcakgagttgcaga

SEQ ID NO: 18390 - DNA, 21 bp, Hordeum vulgare
gatatgttccsatgcattttt

SEQ ID NO: 18391 - DNA, 21 bp, Hordeum vulgare
tttatctcgtyatatgacgct

SEQ ID NO: 18392 - DNA, 21 bp, Hordeum vulgare
tcgcacgccgwctcaatttta

SEQ ID NO: 18393 - DNA, 21 bp, Hordeum vulgare
gatacggaatytacctctcag

SEQ ID NO: 18394 - DNA, 21 bp, Hordeum vulgare
gctcgtccggwtggatacgga

SEQ ID NO: 18395 - DNA, 21 bp, Hordeum vulgare
gcgtaagtagrtcatcaaaac

SEQ ID NO: 18396 - DNA, 21 bp, Hordeum vulgare
gaaatccttcrgcatagtttg

SEQ ID NO: 18397 - DNA, 21 bp, Hordeum vulgare
caaacatccgraaatgcacag

SEQ ID NO: 18398 - DNA, 21 bp, Hordeum vulgare
atyaagagatygcccgaacaa

SEQ ID NO: 18399 - DNA, 20 bp, Hordeum vulgare
caccactaaggacagaccac

SEQ ID NO: 18400 - DNA, 21 bp, Hordeum vulgare
caccactaagagacagaccac

SEQ ID NO: 18401 - DNA, 21 bp, Hordeum vulgare
tgcgaaatctytggttcctga

SEQ ID NO: 18402 - DNA, 21 bp, Hordeum vulgare
aaagcacaatrgactatctcg

SEQ ID NO: 18403 - DNA, 21 bp, Hordeum vulgare
tatgtccagaygaggtgatac

SEQ ID NO: 18404 - DNA, 21 bp, Hordeum vulgare
ttcccagcggycgctgctgcc

SEQ ID NO: 18405 - DNA, 21 bp, Hordeum vulgare
aacttaagagrtctacagctt

SEQ ID NO: 18406 - DNA, 21 bp, Hordeum vulgare
ccgcgttgcgytggaactcga

SEQ ID NO: 18407 - DNA, 21 bp, Hordeum vulgare
cttccttttcrccttataacg

SEQ ID NO: 18408 - DNA, 21 bp, Hordeum vulgare
ctctttccagmagtttggtcc

SEQ ID NO: 18409 - DNA, 21 bp, Hordeum vulgare
gttaagcaggkgctggatcct

SEQ ID NO: 18410 - DNA, 21 bp, Hordeum vulgare
taactgacttytacaagaaaa

SEQ ID NO: 18411 - DNA, 21 bp, Hordeum vulgare
agattattgawcggaccacat

SEQ ID NO: 18412 - DNA, 21 bp, Hordeum vulgare
gccaaaactawgagaggacga

SEQ ID NO: 18413 - DNA, 21 bp, Hordeum vulgare
gttggtgtcayagaagattat

SEQ ID NO: 18414 - DNA, 21 bp, Hordeum vulgare
ttttggagcamtgacacgagc

SEQ ID NO: 18415 - DNA, 21 bp, Hordeum vulgare
aagaagtagaycaatcctcag

SEQ ID NO: 18416 - DNA, 21 bp, Hordeum vulgare
tataagagcayttgggtcact

SEQ ID NO: 18417 - DNA, 21 bp, Hordeum vulgare
gcttattggtraactgcatca

SEQ ID NO: 18418 - DNA, 21 bp, Hordeum vulgare
aactatgaatmttagaccctt

SEQ ID NO: 18419 - DNA, 21 bp, Hordeum vulgare
ttacaaaatcragaaacaagt

SEQ ID NO: 18420 - DNA, 21 bp, Hordeum vulgare
tcgatatagaycaaataagaa

SEQ ID NO: 18421 - DNA, 21 bp, Hordeum vulgare
aaacgcactcgtggcccacac

SEQ ID NO: 18422 - DNA, 20 bp, Hordeum vulgare
aaacgcactctggcccacac

SEQ ID NO: 18423 - DNA, 21 bp, Hordeum vulgare
aaactctaagwtgggagacca

SEQ ID NO: 18424 - DNA, 21 bp, Hordeum vulgare
  MISC_FEATURE (11): n is SNP, in which the one is a and the other is t or g or c
ctcgattggcntgggatcaac

SEQ ID NO: 18425 - DNA, 21 bp, Hordeum vulgare
ggtgcgaatcsatggtccttc

SEQ ID NO: 18426 - DNA, 21 bp, Hordeum vulgare
tcttcgctttytgattgatgg

SEQ ID NO: 18427 - DNA, 21 bp, Hordeum vulgare
caaaagagtcyagtaaatttg

SEQ ID NO: 18428 - DNA, 21 bp, Hordeum vulgare
cagctcatccrcatcgctgga

SEQ ID NO: 18429 - DNA, 21 bp, Hordeum vulgare
agaagcattgrtcagatgacc

SEQ ID NO: 18430 - DNA, 21 bp, Hordeum vulgare
tccacacgatytcagcaactt

SEQ ID NO: 18431 - DNA, 21 bp, Hordeum vulgare
tgagcccctgsgcgagcgtgc

SEQ ID NO: 18432 - DNA, 21 bp, Hordeum vulgare
aggcttcagartggccgtttg

SEQ ID NO: 18433 - DNA, 21 bp, Hordeum vulgare
gcttatttccmcacgggttct

SEQ ID NO: 18434 - DNA, 21 bp, Hordeum vulgare
cccacgcacarttcggaagca

SEQ ID NO: 18435 - DNA, 21 bp, Hordeum vulgare
aagacgccatrtcagaataag

SEQ ID NO: 18436 - DNA, 21 bp, Hordeum vulgare
caaaatgaccraacacatgaa

SEQ ID NO: 18437 - DNA, 21 bp, Hordeum vulgare
ttcgatcactyctcagatcat

SEQ ID NO: 18438 - DNA, 21 bp, Hordeum vulgare
tcgggttcagrcatgcaatga

SEQ ID NO: 18439 - DNA, 21 bp, Hordeum vulgare
tttagtgaatycgtattttgt

SEQ ID NO: 18440 - DNA, 21 bp, Hordeum vulgare
ttgcttacagytatggttccc

SEQ ID NO: 18441 - DNA, 21 bp, Hordeum vulgare
tgccacggctrccgtaagggt

SEQ ID NO: 18442 - DNA, 21 bp, Hordeum vulgare
tctaggccgcyaagctcacga

SEQ ID NO: 18443 - DNA, 21 bp, Hordeum vulgare
tcccagctgayccaaccatta

SEQ ID NO: 18444 - DNA, 20 bp, Hordeum vulgare
actctacaagatcttgaatt

SEQ ID NO: 18445 - DNA, 21 bp, Hordeum vulgare
actgtacaagttcttgaaatt

SEQ ID NO: 18446 - DNA, 21 bp, Hordeum vulgare
tgatgtgccgrtgaaatccct

SEQ ID NO: 18447 - DNA, 21 bp, Hordeum vulgare
aaaagaacttyatgttctcgc

SEQ ID NO: 18448 - DNA, 21 bp, Hordeum vulgare
ggattgggcamagatgatatt

SEQ ID NO: 18449 - DNA, 21 bp, Hordeum vulgare
cacgtctctargacaagaaac

SEQ ID NO: 18450 - DNA, 21 bp, Hordeum vulgare
ggtcgctcccrggtccttcgc

SEQ ID NO: 18451 - DNA, 21 bp, Hordeum vulgare
ggaccgtgtgsccctttgggt

SEQ ID NO: 18452 - DNA, 21 bp, Hordeum vulgare
ggtcgctcccrggtccttcgc

SEQ ID NO: 18453 - DNA, 21 bp, Hordeum vulgare
tggtggtgacsgcggcctgca

SEQ ID NO: 18454 - DNA, 21 bp, Hordeum vulgare
cttgaaaactmtggcagtatc

SEQ ID NO: 18455 - DNA, 21 bp, Hordeum vulgare
tatggtacaayagaaacaatt

SEQ ID NO: 18456 - DNA, 21 bp, Hordeum vulgare
taaaccgaccmttgatgtagc

SEQ ID NO: 18457 - DNA, 21 bp, Hordeum vulgare
gctcgagtctmaatcgtctcc

SEQ ID NO: 18458 - DNA, 21 bp, Hordeum vulgare
ttcattcatckgttctaacac

SEQ ID NO: 18459 - DNA, 21 bp, Hordeum vulgare
ctcctagggaytcaagaccct

SEQ ID NO: 18460 - DNA, 21 bp, Hordeum vulgare
tctctcttttycagcatgaag

SEQ ID NO: 18461 - DNA, 21 bp, Hordeum vulgare
cgtaatcttargattcatata

SEQ ID NO: 18462 - DNA, 21 bp, Hordeum vulgare
aggatctagcratacaccgtt

SEQ ID NO: 18463 - DNA, 21 bp, Hordeum vulgare
tggcggacgcrccgtcgcgca

SEQ ID NO: 18464 - DNA, 21 bp, Hordeum vulgare
cgcacacgggktgcagttcac

SEQ ID NO: 18465 - DNA, 21 bp, Hordeum vulgare
ggataccaagrgtcctggaga

SEQ ID NO: 18466 - DNA, 21 bp, Hordeum vulgare
cttgcatacckcttaccgatt

SEQ ID NO: 18467 - DNA, 21 bp, Hordeum vulgare
attagcatttytgttaacatg

SEQ ID NO: 18468 - DNA, 21 bp, Hordeum vulgare
cctccctgctkctttgctggc

SEQ ID NO: 18469 - DNA, 21 bp, Hordeum vulgare
ttacatacctwcccccctcct

SEQ ID NO: 18470 - DNA, 21 bp, Hordeum vulgare
cagatattctragctagatta

SEQ ID NO: 18471 - DNA, 21 bp, Hordeum vulgare
atccctgtcgmcatatcttgg

SEQ ID NO: 18472 - DNA, 21 bp, Hordeum vulgare
catgggtgccratgagcccaa

SEQ ID NO: 18473 - DNA, 21 bp, Hordeum vulgare
attgagtgatkggtctatgac

SEQ ID NO: 18474 - DNA, 21 bp, Hordeum vulgare
cgtcaccaaayttgtcagaaa

SEQ ID NO: 18475 - DNA, 21 bp, Hordeum vulgare
atggttggagygcgacgctgg

SEQ ID NO: 18476 - DNA, 21 bp, Hordeum vulgare
accacaaaaawtctggctttc

SEQ ID NO: 18477 - DNA, 21 bp, Hordeum vulgare
atccatgatcygtgttgcctg

SEQ ID NO: 18478 - DNA, 21 bp, Hordeum vulgare
gctgcctggargcaattttcc

SEQ ID NO: 18479 - DNA, 21 bp, Hordeum vulgare
cacgatctatrcatgtgttcc

SEQ ID NO: 18480 - DNA, 21 bp, Hordeum vulgare
ggcccgagtgrttgcgatgca

SEQ ID NO: 18481 - DNA, 21 bp, Hordeum vulgare
gagcggcgcgyggtacggtgg

SEQ ID NO: 18482 - DNA, 21 bp, Hordeum vulgare
gtacgtagctygcttggtcgc

SEQ ID NO: 18483 - DNA, 21 bp, Hordeum vulgare
tatcgtattgwgtgcttttca

SEQ ID NO: 18484 - DNA, 21 bp, Hordeum vulgare
tttatcagctktgcataagtt

SEQ ID NO: 18485 - DNA, 21 bp, Hordeum vulgare
gaatggatgasaaccacgatg

SEQ ID NO: 18486 - DNA, 21 bp, Hordeum vulgare
taccagaacaratgtcatttt

SEQ ID NO: 18487 - DNA, 21 bp, Hordeum vulgare
gccatctaatrgtattagcat

SEQ ID NO: 18488 - DNA, 21 bp, Hordeum vulgare
tcctctttctyccttctcctt

SEQ ID NO: 18489 - DNA, 21 bp, Hordeum vulgare
atatctattcrcaggtaagac

SEQ ID NO: 18490 - DNA, 21 bp, Hordeum vulgare
ttaaacaggaragatagagag

SEQ ID NO: 18491 - DNA, 21 bp, Hordeum vulgare
gtgttactggktacttatcat

SEQ ID NO: 18492 - DNA, 21 bp, Hordeum vulgare
gtactaccagktagccgccat

SEQ ID NO: 18493 - DNA, 21 bp, Hordeum vulgare
atagagagagktttatttata

SEQ ID NO: 18494 - DNA, 21 bp, Hordeum vulgare
ttgacaactarttatatctat

SEQ ID NO: 18495 - DNA, 21 bp, Hordeum vulgare
gcttggcatgratggcgcaca

SEQ ID NO: 18496 - DNA, 21 bp, Hordeum vulgare
caaaataaaargctatcaact

SEQ ID NO: 18497 - DNA, 21 bp, Hordeum vulgare
aaatgcatgtraagcaccagc

SEQ ID NO: 18498 - DNA, 21 bp, Hordeum vulgare
tcagctggcawgcttgaaggc

SEQ ID NO: 18499 - DNA, 21 bp, Hordeum vulgare
gttgcgttttytcaccatctt

SEQ ID NO: 18500 - DNA, 21 bp, Hordeum vulgare
gcctacttacygtgatgaaaa

SEQ ID NO: 18501 - DNA, 21 bp, Hordeum vulgare
cagcaccaggrgatgatgcat

SEQ ID NO: 18502 - DNA, 21 bp, Hordeum vulgare
tcggaagagtraatgtatctt

SEQ ID NO: 18503 - DNA, 21 bp, Hordeum vulgare
tgatcacagcmgtgaggattc

SEQ ID NO: 18504 - DNA, 21 bp, Hordeum vulgare
catctttggarcatgctacag

SEQ ID NO: 18505 - DNA, 21 bp, Hordeum vulgare
cgacaactaaytccggacgga

SEQ ID NO: 18506 - DNA, 21 bp, Hordeum vulgare
atcggcgataygatattagat

SEQ ID NO: 18507 - DNA, 21 bp, Hordeum vulgare
tattggtcaamtttatactac

SEQ ID NO: 18508 - DNA, 21 bp, Hordeum vulgare
gaattaactcytgcccctcct

SEQ ID NO: 18509 - DNA, 21 bp, Hordeum vulgare
ctctaggcgakaatcaccatc

SEQ ID NO: 18510 - DNA, 21 bp, Hordeum vulgare
cacaatgattytattttaaaa

SEQ ID NO: 18511 - DNA, 21 bp, Hordeum vulgare
gattcttctcratctgacgga

SEQ ID NO: 18512 - DNA, 21 bp, Hordeum vulgare
tgcgccaccgyctccgggttg

SEQ ID NO: 18513 - DNA, 21 bp, Hordeum vulgare
tcatcttggcmgtttcaccac

SEQ ID NO: 18514 - DNA, 21 bp, Hordeum vulgare
gtcgctgttcmgtctgtggaa

SEQ ID NO: 18515 - DNA, 21 bp, Hordeum vulgare
ttccacagackgaacagcgac

SEQ ID NO: 18516 - DNA, 21 bp, Hordeum vulgare
cgtctggtgaytctgcctttg

SEQ ID NO: 18517 - DNA, 21 bp, Hordeum vulgare
cgtctggtgaytctgcctttg

SEQ ID NO: 18518 - DNA, 21 bp, Hordeum vulgare
ccttggtgtcraaatgagacg

SEQ ID NO: 18519 - DNA, 21 bp, Hordeum vulgare
tgccactacargtatatgcag

SEQ ID NO: 18520 - DNA, 21 bp, Hordeum vulgare
actcaagcttscattttttct

SEQ ID NO: 18521 - DNA, 21 bp, Hordeum vulgare
ctttctctgamgaagaaacaa

SEQ ID NO: 18522 - DNA, 21 bp, Hordeum vulgare
gtggtatattytccaaactca

SEQ ID NO: 18523 - DNA, 21 bp, Hordeum vulgare
tctcacaatcsctgatatgtt

SEQ ID NO: 18524 - DNA, 21 bp, Hordeum vulgare
atgcacatttwccgtgcgcgc

SEQ ID NO: 18525 - DNA, 21 bp, Hordeum vulgare
attgtcggggraaaatgtatg

SEQ ID NO: 18526 - DNA, 21 bp, Hordeum vulgare
ctggagactcragcagatgca

SEQ ID NO: 18527 - DNA, 21 bp, Hordeum vulgare
ttcttagacaygcattatgtg

SEQ ID NO: 18528 - DNA, 21 bp, Hordeum vulgare
tgcacatgaargaaatagatg

SEQ ID NO: 18529 - DNA, 21 bp, Hordeum vulgare
atgtctgttgrtgtacttgtg

SEQ ID NO: 18530 - DNA, 21 bp, Hordeum vulgare
catggaagttytcatagggat

SEQ ID NO: 18531 - DNA, 21 bp, Hordeum vulgare
tacatctatayaatgtcatgg

SEQ ID NO: 18532 - DNA, 21 bp, Hordeum vulgare
gtgataaattytctgtgtcat

SEQ ID NO: 18533 - DNA, 21 bp, Hordeum vulgare
taaacaaagawaagcttgatg

SEQ ID NO: 18534 - DNA, 21 bp, Hordeum vulgare
actatgtatgyacagacgcgc

SEQ ID NO: 18535 - DNA, 21 bp, Hordeum vulgare
cacaaacaaasgggaccccca

SEQ ID NO: 18536 - DNA, 21 bp, Hordeum vulgare
gtttgcttatwtactatacac

SEQ ID NO: 18537 - DNA, 21 bp, Hordeum vulgare
gcatcgtgcgyggtgctcacc

SEQ ID NO: 18538 - DNA, 21 bp, Hordeum vulgare
gacactcaagyagtgcgtcga

SEQ ID NO: 18539 - DNA, 21 bp, Hordeum vulgare
accagaagctytctactacca

SEQ ID NO: 18540 - DNA, 21 bp, Hordeum vulgare
cagccgaaccsctggctggct

SEQ ID NO: 18541 - DNA, 21 bp, Hordeum vulgare
tcagtctgagtactaatcaaa

SEQ ID NO: 18542 - DNA, 20 bp, Hordeum vulgare
tcagtctgagactaatcaaa

SEQ ID NO: 18543 - DNA, 21 bp, Hordeum vulgare
gatttggcatyaatgttacaa

SEQ ID NO: 18544 - DNA, 21 bp, Hordeum vulgare
gtgtcaaaggraactccaaaa

SEQ ID NO: 18545 - DNA, 21 bp, Hordeum vulgare
caccgcaccgrctttctcgtt

SEQ ID NO: 18546 - DNA, 21 bp, Hordeum vulgare
ataaaaaaaawtcgatcttta

SEQ ID NO: 18547 - DNA, 21 bp, Hordeum vulgare
ggcgacgccgraaccaacgaa

SEQ ID NO: 18548 - DNA, 21 bp, Hordeum vulgare
catgcctccasgccaatctcc

SEQ ID NO: 18549 - DNA, 21 bp, Hordeum vulgare
tccttcttttmaaaaaaaaaa

SEQ ID NO: 18550 - DNA, 21 bp, Hordeum vulgare
cgtagtcttcmggtgttagtg

SEQ ID NO: 18551 - DNA, 21 bp, Hordeum vulgare
acggcaaaccsagacgagaac

SEQ ID NO: 18552 - DNA, 21 bp, Hordeum vulgare
aagaaggatawctatgagacg

SEQ ID NO: 18553 - DNA, 21 bp, Hordeum vulgare
tgtgtgtgtgrtgatcggttt

SEQ ID NO: 18554 - DNA, 21 bp, Hordeum vulgare
ctacgtcaccracgacagaaa

SEQ ID NO: 18555 - DNA, 21 bp, Hordeum vulgare
ttyttttmaamatcctsgggg

SEQ ID NO: 18556 - DNA, 21 bp, Hordeum vulgare
gatgcctcctsgccctcggcg

SEQ ID NO: 18557 - DNA, 21 bp, Hordeum vulgare
ctcagtctcaraccacaccta

SEQ ID NO: 18558 - DNA, 21 bp, Hordeum vulgare
aaaatcaataytaaatactcc

SEQ ID NO: 18559 - DNA, 21 bp, Hordeum vulgare
accaagcaackcgcatcaact

SEQ ID NO: 18560 - DNA, 21 bp, Hordeum vulgare
tttgcttcacrccggggttct

SEQ ID NO: 18561 - DNA, 21 bp, Hordeum vulgare
tcaaaaagcaraagtgggctc

SEQ ID NO: 18562 - DNA, 21 bp, Hordeum vulgare
taagaaagctmtgtatcagca

SEQ ID NO: 18563 - DNA, 21 bp, Hordeum vulgare
tacaaacagtraataagcctg

SEQ ID NO: 18564 - DNA, 21 bp, Hordeum vulgare
caggaagttcktgcagattgc

SEQ ID NO: 18565 - DNA, 21 bp, Hordeum vulgare
ataataatagytcaaacaggg

SEQ ID NO: 18566 - DNA, 21 bp, Hordeum vulgare
gtgggctccgrtgtatgtaac

SEQ ID NO: 18567 - DNA, 21 bp, Hordeum vulgare
ttaacacttgrttactggtga

SEQ ID NO: 18568 - DNA, 21 bp, Hordeum vulgare
ataagcctgtratctagatat

SEQ ID NO: 18569 - DNA, 21 bp, Hordeum vulgare
tgagtttgtaytgctgcaaat

SEQ ID NO: 18570 - DNA, 21 bp, Hordeum vulgare
tgctacaatayaaatggaatg

SEQ ID NO: 18571 - DNA, 21 bp, Hordeum vulgare
gaatgatcgcrtagcgagaac

SEQ ID NO: 18572 - DNA, 21 bp, Hordeum vulgare
caataatcgcragttggtgca

SEQ ID NO: 18573 - DNA, 21 bp, Hordeum vulgare
tgagaaacacrgcaaacgatg

SEQ ID NO: 18574 - DNA, 21 bp, Hordeum vulgare
tacaccttgtsgattaatata

SEQ ID NO: 18575 - DNA, 21 bp, Hordeum vulgare
actcaaattgmacggtcagta

SEQ ID NO: 18576 - DNA, 21 bp, Hordeum vulgare
cgttcactgtrtacgggccaa

SEQ ID NO: 18577 - DNA, 21 bp, Hordeum vulgare
cctcggtctcyccttgtctct

SEQ ID NO: 18578 - DNA, 21 bp, Hordeum vulgare
cggtcagtaaytgtgtctccg

SEQ ID NO: 18579 - DNA, 21 bp, Hordeum vulgare
tgagtacactyattaacctgt

SEQ ID NO: 18580 - DNA, 21 bp, Hordeum vulgare
acagagcttcwgataattggt

SEQ ID NO: 18581 - DNA, 21 bp, Hordeum vulgare
tgtcaatcaakgacttgtact

SEQ ID NO: 18582 - DNA, 21 bp, Hordeum vulgare
ttcagcaagtmattgaagtgt

SEQ ID NO: 18583 - DNA, 21 bp, Hordeum vulgare
atcacgtgccygcaaccgcca

SEQ ID NO: 18584 - DNA, 21 bp, Hordeum vulgare
gccacttgtcratgcaggcgc

SEQ ID NO: 18585 - DNA, 21 bp, Hordeum vulgare
aaggtctcatyaaaaaggtga

SEQ ID NO: 18586 - DNA, 21 bp, Hordeum vulgare
accttccaatraaatttagtt

SEQ ID NO: 18587 - DNA, 21 bp, Hordeum vulgare
  MISC_FEATURE (11): n is SNP, in which the one is t and the other is a or g or c
acttggccagnggtcacagca

SEQ ID NO: 18588 - DNA, 21 bp, Hordeum vulgare
caccacctgaycatcagattg

SEQ ID NO: 18589 - DNA, 21 bp, Hordeum vulgare
  MISC_FEATURE (11): n is SNP, in which the one is t and the other is a or g or c
ccgagtccggntgattctggc

SEQ ID NO: 18590 - DNA, 21 bp, Hordeum vulgare
gattctggcgrgctcctgctc

SEQ ID NO: 18591 - DNA, 21 bp, Hordeum vulgare
actgccctccstccttttacg

SEQ ID NO: 18592 - DNA, 21 bp, Hordeum vulgare
ggagtagtttrcaacactgcc

SEQ ID NO: 18593 - DNA, 21 bp, Hordeum vulgare
atttctaaaakgtcttatatt

SEQ ID NO: 18594 - DNA, 21 bp, Hordeum vulgare
ccgcattctcyccttcaaaca

SEQ ID NO: 18595 - DNA, 21 bp, Hordeum vulgare
gagctcgtgcsgctgccgtca

SEQ ID NO: 18596 - DNA, 21 bp, Hordeum vulgare
gcccgtgtggrcactgggcac

SEQ ID NO: 18597 - DNA, 21 bp, Hordeum vulgare
ttgattcctgyasccttttcc

SEQ ID NO: 18598 - DNA, 21 bp, Hordeum vulgare
ccggcatctcyggtactgytt

SEQ ID NO: 18599 - DNA, 21 bp, Hordeum vulgare
gattcctgyasccttttcctg

SEQ ID NO: 18600 - DNA, 21 bp, Hordeum vulgare
ataaccctacractcagaagg

SEQ ID NO: 18601 - DNA, 21 bp, Hordeum vulgare
gccgaccccgwtactagcacg

SEQ ID NO: 18602 - DNA, 21 bp, Hordeum vulgare
gagagcaggamatatctatca

SEQ ID NO: 18603 - DNA, 21 bp, Hordeum vulgare
atctatcattycaggccaaat

SEQ ID NO: 18604 - DNA, 21 bp, Hordeum vulgare
tatctcctggsacagcgtttt

SEQ ID NO: 18605 - DNA, 21 bp, Hordeum vulgare
ggagcgtcagraactgattca

SEQ ID NO: 18606 - DNA, 21 bp, Hordeum vulgare
gctaagatccrgagaaaagga

SEQ ID NO: 18607 - DNA, 21 bp, Hordeum vulgare
gcaccgtagcrgaggacatcc

SEQ ID NO: 18608 - DNA, 21 bp, Hordeum vulgare
tttggatggtsccccaacact

SEQ ID NO: 18609 - DNA, 21 bp, Hordeum vulgare
aaactgttackctaccgaaca

SEQ ID NO: 18610 - DNA, 21 bp, Hordeum vulgare
ctaggatctcrgtcagcagct

SEQ ID NO: 18611 - DNA, 21 bp, Hordeum vulgare
gttcagtcttkaaatgcccga

SEQ ID NO: 18612 - DNA, 21 bp, Hordeum vulgare
gcatccttgtyaaggtaccct

SEQ ID NO: 18613 - DNA, 21 bp, Hordeum vulgare
aaatgcttcamaaagatatca

SEQ ID NO: 18614 - DNA, 21 bp, Hordeum vulgare
gcgtgcatgtyaccagtatag

SEQ ID NO: 18615 - DNA, 21 bp, Hordeum vulgare
catcaagaacrgtatgaacca

SEQ ID NO: 18616 - DNA, 21 bp, Hordeum vulgare
acataacataktccgtatacg

SEQ ID NO: 18617 - DNA, 21 bp, Hordeum vulgare
attacacatgycacataacat

SEQ ID NO: 18618 - DNA, 21 bp, Hordeum vulgare
tgcaccctcakgcatccatac

SEQ ID NO: 18619 - DNA, 21 bp, Hordeum vulgare
ccctgcggcarttgttcctca

SEQ ID NO: 18620 - DNA, 21 bp, Hordeum vulgare
gggcggcccakgttccagggg

SEQ ID NO: 18621 - DNA, 21 bp, Hordeum vulgare
ccgacggaacmaaacaatcag

SEQ ID NO: 18622 - DNA, 21 bp, Hordeum vulgare
taatacacgasgacacgtgtg

SEQ ID NO: 18623 - DNA, 21 bp, Hordeum vulgare
aaaagggttakgaaattaccc

SEQ ID NO: 18624 - DNA, 21 bp, Hordeum vulgare
ggccgagaggkgtccggtaaa

SEQ ID NO: 18625 - DNA, 21 bp, Hordeum vulgare
gactttggccrggggatcgct

SEQ ID NO: 18626 - DNA, 21 bp, Hordeum vulgare
ctatgctctgygctataacca

SEQ ID NO: 18627 - DNA, 21 bp, Hordeum vulgare
agagcagtgcrcacacttgtg

SEQ ID NO: 18628 - DNA, 21 bp, Hordeum vulgare
tgagatagggrccccaggaat

SEQ ID NO: 18629 - DNA, 21 bp, Hordeum vulgare
tgtactggtgmtaagcatgcc

SEQ ID NO: 18630 - DNA, 21 bp, Hordeum vulgare
cggcaccggcrccgtgtgccg

SEQ ID NO: 18631 - DNA, 21 bp, Hordeum vulgare
aagaagatgcrcgaggatagc

SEQ ID NO: 18632 - DNA, 21 bp, Hordeum vulgare
cgagcgatccraaggtgttct

SEQ ID NO: 18633 - DNA, 21 bp, Hordeum vulgare
aacgtgtctcrttccagcttc

SEQ ID NO: 18634 - DNA, 21 bp, Hordeum vulgare
tcaagtcccgwagcagaggaa

SEQ ID NO: 18635 - DNA, 21 bp, Hordeum vulgare
tcactcttcargacagagtgt

SEQ ID NO: 18636 - DNA, 21 bp, Hordeum vulgare
acctctcagcytcaagcatcg

SEQ ID NO: 18637 - DNA, 21 bp, Hordeum vulgare
cgcgcgtcctygccggcaagg

SEQ ID NO: 18638 - DNA, 21 bp, Hordeum vulgare
gaagaaacaastaccccactg

SEQ ID NO: 18639 - DNA, 21 bp, Hordeum vulgare
ctactttatcmacatgctgcg

SEQ ID NO: 18640 - DNA, 21 bp, Hordeum vulgare
aatacatcagmccctgagcta

SEQ ID NO: 18641 - DNA, 21 bp, Hordeum vulgare
aaaaggaaaakcaacacatga

SEQ ID NO: 18642 - DNA, 21 bp, Hordeum vulgare
ggccgatagcrgggatcccag

SEQ ID NO: 18643 - DNA, 21 bp, Hordeum vulgare
atgcctgtacwtggacaccag

SEQ ID NO: 18644 - DNA, 21 bp, Hordeum vulgare
aagctcatatraagttaatca

SEQ ID NO: 18645 - DNA, 21 bp, Hordeum vulgare
ggtcaaaccaycaaaaagatt

SEQ ID NO: 18646 - DNA, 21 bp, Hordeum vulgare
ttactccttcrcagtgatgca

SEQ ID NO: 18647 - DNA, 21 bp, Hordeum vulgare
taacaagtaayggtaaaaact

SEQ ID NO: 18648 - DNA, 21 bp, Hordeum vulgare
tttacagccgrgagatgagca

SEQ ID NO: 18649 - DNA, 21 bp, Hordeum vulgare
tacctgcatgwtaacacaagg

SEQ ID NO: 18650 - DNA, 21 bp, Hordeum vulgare
tcaccatgacwggtttagact

SEQ ID NO: 18651 - DNA, 21 bp, Hordeum vulgare
cagattcccaratggctcgtc

SEQ ID NO: 18652 - DNA, 21 bp, Hordeum vulgare
ttcgtgccgcstgatgcagcc

SEQ ID NO: 18653 - DNA, 21 bp, Hordeum vulgare
gctcacttgcktttcagtgtg

SEQ ID NO: 18654 - DNA, 21 bp, Hordeum vulgare
ggaggtcgccraacgtcttgg

SEQ ID NO: 18655 - DNA, 21 bp, Hordeum vulgare
catcccgaaayttgtcacaga

SEQ ID NO: 18656 - DNA, 21 bp, Hordeum vulgare
ctaacttattwttgttactaa

SEQ ID NO: 18657 - DNA, 21 bp, Hordeum vulgare
catcctgacaraagagagcaa

SEQ ID NO: 18658 - DNA, 21 bp, Hordeum vulgare
tcaaatagagygtgcagctac

SEQ ID NO: 18659 - DNA, 21 bp, Hordeum vulgare
agcaaaatcargacaggcagt

SEQ ID NO: 18660 - DNA, 21 bp, Hordeum vulgare
ccatggtggtycatttttgct

SEQ ID NO: 18661 - DNA, 21 bp, Hordeum vulgare
tgatcttctgyctgtagaata

SEQ ID NO: 18662 - DNA, 21 bp, Hordeum vulgare
ctgataggtargctgattcat

SEQ ID NO: 18663 - DNA, 21 bp, Hordeum vulgare
tccataacttycccttgcaca

SEQ ID NO: 18664 - DNA, 21 bp, Hordeum vulgare
tacagggtgtscgaattcaga

SEQ ID NO: 18665 - DNA, 21 bp, Hordeum vulgare
gcaacatttgygtcaccatcc

SEQ ID NO: 18666 - DNA, 21 bp, Hordeum vulgare
tgactgttacragaaatactg

SEQ ID NO: 18667 - DNA, 21 bp, Hordeum vulgare
aaatcagccasacactgactg

SEQ ID NO: 18668 - DNA, 21 bp, Hordeum vulgare
ccctctctctstctatcgaca

SEQ ID NO: 18669 - DNA, 21 bp, Hordeum vulgare
ttcagtatgcragaattaacc

SEQ ID NO: 18670 - DNA, 21 bp, Hordeum vulgare
gcaccggcagyagcacctgca

SEQ ID NO: 18671 - DNA, 21 bp, Hordeum vulgare
atagtaaccascagcagcacc

SEQ ID NO: 18672 - DNA, 21 bp, Hordeum vulgare
ttgctgaaacrattaaaagta

SEQ ID NO: 18673 - DNA, 21 bp, Hordeum vulgare
atatgttgcasatacaagtgc

SEQ ID NO: 18674 - DNA, 21 bp, Hordeum vulgare
tacaagtgccsacaaatgctg

SEQ ID NO: 18675 - DNA, 21 bp, Hordeum vulgare
ccctgttcctrgaaaatggaa

SEQ ID NO: 18676 - DNA, 21 bp, Hordeum vulgare
tgcttctgaayatttgagccc

SEQ ID NO: 18677 - DNA, 21 bp, Hordeum vulgare
attaggkyatyaatsctatac

SEQ ID NO: 18678 - DNA, 21 bp, Hordeum vulgare
tcaagtccatrtgcctctgat

SEQ ID NO: 18679 - DNA, 21 bp, Hordeum vulgare
agagactcagraaactagaag

SEQ ID NO: 18680 - DNA, 21 bp, Hordeum vulgare
aracacaaatmttcctacaat

SEQ ID NO: 18681 - DNA, 21 bp, Hordeum vulgare
aatcatcaagktcgatcaagg

SEQ ID NO: 18682 - DNA, 21 bp, Hordeum vulgare
ctggcctcttkgctggcctgt

SEQ ID NO: 18683 - DNA, 21 bp, Hordeum vulgare
ttgcatacgawactgaaacat

SEQ ID NO: 18684 - DNA, 21 bp, Hordeum vulgare
tttcgactttkgctgactctg

SEQ ID NO: 18685 - DNA, 21 bp, Hordeum vulgare
atcatccttcraacaacatcc

SEQ ID NO: 18686 - DNA, 21 bp, Hordeum vulgare
ggcattgcgcsgcggccaaca

SEQ ID NO: 18687 - DNA, 21 bp, Hordeum vulgare
ttccatttcaratctgatgct

SEQ ID NO: 18688 - DNA, 21 bp, Hordeum vulgare
ttcactacacwtatttgagca

SEQ ID NO: 18689 - DNA, 21 bp, Hordeum vulgare
tggagtactasacttggatct

SEQ ID NO: 18690 - DNA, 21 bp, Hordeum vulgare
ttgagcatgargcactatatt

SEQ ID NO: 18691 - DNA, 21 bp, Hordeum vulgare
gcaccctcctyttccccgcca

SEQ ID NO: 18692 - DNA, 21 bp, Hordeum vulgare
gttggcaacakcataaactag

SEQ ID NO: 18693 - DNA, 21 bp, Hordeum vulgare
aggtaaccagytttagccatt

SEQ ID NO: 18694 - DNA, 21 bp, Hordeum vulgare
tataacccggrgagagataga

SEQ ID NO: 18695 - DNA, 21 bp, Hordeum vulgare
cacgcacatgkccctgttcaa

SEQ ID NO: 18696 - DNA, 21 bp, Hordeum vulgare
attatacctgwaattcaagga

SEQ ID NO: 18697 - DNA, 21 bp, Hordeum vulgare
tctttgttggrattacaccca

SEQ ID NO: 18698 - DNA, 21 bp, Hordeum vulgare
ttataccacakgcggcccggg

SEQ ID NO: 18699 - DNA, 21 bp, Hordeum vulgare
acctgtaccawacagagcagt

SEQ ID NO: 18700 - DNA, 21 bp, Hordeum vulgare
gcaccgtcagyacagaagaac

SEQ ID NO: 18701 - DNA, 21 bp, Hordeum vulgare
tagtagtcatstctggaaata

SEQ ID NO: 18702 - DNA, 21 bp, Hordeum vulgare
gaagaacagawactgaatcag

SEQ ID NO: 18703 - DNA, 21 bp, Hordeum vulgare
gcacctttctycgctgccctg

SEQ ID NO: 18704 - DNA, 21 bp, Hordeum vulgare
tttacagtccrgtagatttgg

SEQ ID NO: 18705 - DNA, 21 bp, Hordeum vulgare
cctttgaattmtttgtaattt

SEQ ID NO: 18706 - DNA, 21 bp, Hordeum vulgare
cagattgaccrtacctggtta

SEQ ID NO: 18707 - DNA, 21 bp, Hordeum vulgare
aaggcatgtamgtatgtcatc

SEQ ID NO: 18708 - DNA, 21 bp, Hordeum vulgare
catgcgcagcwgagagaagtg

SEQ ID NO: 18709 - DNA, 21 bp, Hordeum vulgare
atatacatagscaagaggttt

SEQ ID NO: 18710 - DNA, 21 bp, Hordeum vulgare
gggttgtcatrattttatttg

SEQ ID NO: 18711 - DNA, 21 bp, Hordeum vulgare
ttcaccacggwgccgtcgacc

SEQ ID NO: 18712 - DNA, 21 bp, Hordeum vulgare
actggagctgkagctcgacct

SEQ ID NO: 18713 - DNA, 21 bp, Hordeum vulgare
gcctgacgcgsccttggagcc

SEQ ID NO: 18714 - DNA, 21 bp, Hordeum vulgare
tccaccagcgrcccgatgtcc

SEQ ID NO: 18715 - DNA, 21 bp, Hordeum vulgare
tctatgtctgwtccaacctgc

SEQ ID NO: 18716 - DNA, 21 bp, Hordeum vulgare
tctcgttctcrttagccagtt

SEQ ID NO: 18717 - DNA, 21 bp, Hordeum vulgare
cttctgaragmttacttttcg

SEQ ID NO: 18718 - DNA, 21 bp, Hordeum vulgare
tcccggtgccrtagggagctt

SEQ ID NO: 18719 - DNA, 21 bp, Hordeum vulgare
aggtggcgccsgggcgggtgt

SEQ ID NO: 18720 - DNA, 21 bp, Hordeum vulgare
cgacctgcgcyttcggattcc

SEQ ID NO: 18721 - DNA, 21 bp, Hordeum vulgare
aggacatgttycgtatggtcc

SEQ ID NO: 18722 - DNA, 21 bp, Hordeum vulgare
cgctctgaaamtgacagacag

SEQ ID NO: 18723 - DNA, 21 bp, Hordeum vulgare
tctaaaacctyaatcttattg

SEQ ID NO: 18724 - DNA, 21 bp, Hordeum vulgare
cggcaaaaccrctctaaggtg

SEQ ID NO: 18725 - DNA, 21 bp, Hordeum vulgare
tccaagattaygacacggagt

SEQ ID NO: 18726 - DNA, 21 bp, Hordeum vulgare
cacatttattytgtactagaa

SEQ ID NO: 18727 - DNA, 21 bp, Hordeum vulgare
ctcatcatctrgttctctaca

SEQ ID NO: 18728 - DNA, 21 bp, Hordeum vulgare
tttgttttcawtcacattcca

SEQ ID NO: 18729 - DNA, 21 bp, Hordeum vulgare
tgtatcattgrtacatggata

SEQ ID NO: 18730 - DNA, 21 bp, Hordeum vulgare
acaatgtgtcyctctgtatca

SEQ ID NO: 18731 - DNA, 21 bp, Hordeum vulgare
gaaagtacatratttgagtgt

SEQ ID NO: 18732 - DNA, 21 bp, Hordeum vulgare
aaacactgaaratagggatga

SEQ ID NO: 18733 - DNA, 21 bp, Hordeum vulgare
ggatgcatcakaggagactca

SEQ ID NO: 18734 - DNA, 21 bp, Hordeum vulgare
tcctaccagaraagggacgat

SEQ ID NO: 18735 - DNA, 21 bp, Hordeum vulgare
tcttggtacarggatgcatca

SEQ ID NO: 18736 - DNA, 21 bp, Hordeum vulgare
atgttactcamgagttgagat

SEQ ID NO: 18737 - DNA, 21 bp, Hordeum vulgare
cctaggagaaytcttcctacc

SEQ ID NO: 18738 - DNA, 21 bp, Hordeum vulgare
agtattagaawactgagagct

SEQ ID NO: 18739 - DNA, 21 bp, Hordeum vulgare
ctgcctgaggyggtggaatat

SEQ ID NO: 18740 - DNA, 21 bp, Hordeum vulgare
tgctgggaatrtagaggccag

SEQ ID NO: 18741 - DNA, 21 bp, Hordeum vulgare
tagaaaatggygccagaatgc

SEQ ID NO: 18742 - DNA, 21 bp, Hordeum vulgare
caatggcttcracaatccgga

SEQ ID NO: 18743 - DNA, 21 bp, Hordeum vulgare
ttataaagaasatacttgaga

SEQ ID NO: 18744 - DNA, 21 bp, Hordeum vulgare
tgacatcatamccacattaat

SEQ ID NO: 18745 - DNA, 21 bp, Hordeum vulgare
catgaagcaayaaaaccagtt

SEQ ID NO: 18746 - DNA, 21 bp, Hordeum vulgare
cctcgcataaytatcaacatg

SEQ ID NO: 18747 - DNA, 21 bp, Hordeum vulgare
ctttgtgcgtmccgaaacttt

SEQ ID NO: 18748 - DNA, 21 bp, Hordeum vulgare
tcagatgtaawtaggtgtttt

SEQ ID NO: 18749 - DNA, 21 bp, Hordeum vulgare
ccataccatcrtcagttatca

SEQ ID NO: 18750 - DNA, 21 bp, Hordeum vulgare
catcgtctaayttggggcgga

SEQ ID NO: 18751 - DNA, 21 bp, Hordeum vulgare
cagcctgcagrtgtgtccata

SEQ ID NO: 18752 - DNA, 21 bp, Hordeum vulgare
cagcctgcagrtgtgtccata

SEQ ID NO: 18753 - DNA, 21 bp, Hordeum vulgare
catcgtctaayttggggcgga

SEQ ID NO: 18754 - DNA, 21 bp, Hordeum vulgare
ccataccatcrtcagttatca

SEQ ID NO: 18755 - DNA, 21 bp, Hordeum vulgare
cgttcttatgrattttactcc

SEQ ID NO: 18756 - DNA, 21 bp, Hordeum vulgare
ttctttgcatrctcggcatca

SEQ ID NO: 18757 - DNA, 21 bp, Hordeum vulgare
atgtaactcartccgcatcat

SEQ ID NO: 18758 - DNA, 21 bp, Hordeum vulgare
tttgttttcawtcacattcca

SEQ ID NO: 18759 - DNA, 21 bp, Hordeum vulgare
ctcatcatctrgttctctaca

SEQ ID NO: 18760 - DNA, 21 bp, Hordeum vulgare
gaaagtacatratttgagtgt

SEQ ID NO: 18761 - DNA, 21 bp, Hordeum vulgare
ggatgcctcasgcttgtcgat

SEQ ID NO: 18762 - DNA, 21 bp, Hordeum vulgare
ccattttgcakacagaaacat

SEQ ID NO: 18763 - DNA, 21 bp, Hordeum vulgare
cctcaccctcrcctatttgtt

SEQ ID NO: 18764 - DNA, 21 bp, Hordeum vulgare
ggacgtcgaakggcttcactt

SEQ ID NO: 18765 - DNA, 21 bp, Hordeum vulgare
gcatgaagtcrtgccgtgtta

SEQ ID NO: 18766 - DNA, 21 bp, Hordeum vulgare
catgattataracaacttgcc

SEQ ID NO: 18767 - DNA, 21 bp, Hordeum vulgare
cgatcttgacratcttctccg

SEQ ID NO: 18768 - DNA, 21 bp, Hordeum vulgare
attttatctarctagtctgta

SEQ ID NO: 18769 - DNA, 21 bp, Hordeum vulgare
cgttcttatgrattttactcc

SEQ ID NO: 18770 - DNA, 21 bp, Hordeum vulgare
ttctttgcatrctcggcatca

SEQ ID NO: 18771 - DNA, 21 bp, Hordeum vulgare
tgaactcctcrgctatcgaga

SEQ ID NO: 18772 - DNA, 21 bp, Hordeum vulgare
tcgactgaatktactctgcca

SEQ ID NO: 18773 - DNA, 21 bp, Hordeum vulgare
tgttaagactycagaatgact

SEQ ID NO: 18774 - DNA, 21 bp, Hordeum vulgare
cgataagtaayttgcccgtga

SEQ ID NO: 18775 - DNA, 21 bp, Hordeum vulgare
gcatggaaccrgtgtcggctt

SEQ ID NO: 18776 - DNA, 21 bp, Hordeum vulgare
tggcataggaraacacatata

SEQ ID NO: 18777 - DNA, 21 bp, Hordeum vulgare
cgaaataccamcagtgaagtg

SEQ ID NO: 18778 - DNA, 21 bp, Hordeum vulgare
acgccttgttkgggagtcggc

SEQ ID NO: 18779 - DNA, 21 bp, Hordeum vulgare
caccagctcakgacggaccaa

SEQ ID NO: 18780 - DNA, 21 bp, Hordeum vulgare
ttcactatgaragtcatgcag

SEQ ID NO: 18781 - DNA, 21 bp, Hordeum vulgare
ggaaccttacygacattaccc

SEQ ID NO: 18782 - DNA, 21 bp, Hordeum vulgare
ctccaccggcrgcgggtacct

SEQ ID NO: 18783 - DNA, 21 bp, Hordeum vulgare
cgacggtgccsaccaccgtca

SEQ ID NO: 18784 - DNA, 21 bp, Hordeum vulgare
cctccttggcmgggccgacgg

SEQ ID NO: 18785 - DNA, 21 bp, Hordeum vulgare
ccctgtggcgsgtctcctgct

SEQ ID NO: 18786 - DNA, 21 bp, Hordeum vulgare
cttgtcttcgrgctgcaaaga

SEQ ID NO: 18787 - DNA, 21 bp, Hordeum vulgare
gcacccagggycgtctgccac

SEQ ID NO: 18788 - DNA, 21 bp, Hordeum vulgare
acaggcaggayaggacagcga

SEQ ID NO: 18789 - DNA, 21 bp, Hordeum vulgare
ctatcgatgcrgtgcaactgg

SEQ ID NO: 18790 - DNA, 21 bp, Hordeum vulgare
ttgtctggtgkctaggtagat

SEQ ID NO: 18791 - DNA, 21 bp, Hordeum vulgare
ataaaactgawttggaaaagt

SEQ ID NO: 18792 - DNA, 21 bp, Hordeum vulgare
cagttcatctrattttggttt

SEQ ID NO: 18793 - DNA, 21 bp, Hordeum vulgare
acccgaaatakaggtgatcca

SEQ ID NO: 18794 - DNA, 21 bp, Hordeum vulgare
cagcaacatcwaagctaacat

SEQ ID NO: 18795 - DNA, 21 bp, Hordeum vulgare
acaggctacakcatttacagg

SEQ ID NO: 18796 - DNA, 21 bp, Hordeum vulgare
aggctttcaarggcttgaagt

SEQ ID NO: 18797 - DNA, 21 bp, Hordeum vulgare
tcgattactayctgagactgc

SEQ ID NO: 18798 - DNA, 21 bp, Hordeum vulgare
ctcggcctgtygaataaccat

SEQ ID NO: 18799 - DNA, 21 bp, Hordeum vulgare
ggccatgcagkatcagtccag

SEQ ID NO: 18800 - DNA, 21 bp, Hordeum vulgare
aaggctggcgycggcttggac

SEQ ID NO: 18801 - DNA, 21 bp, Hordeum vulgare
gggtcgctackaaggcgaggt

SEQ ID NO: 18802 - DNA, 21 bp, Hordeum vulgare
gatccgggcaygggacgatcc

SEQ ID NO: 18803 - DNA, 21 bp, Hordeum vulgare
gtatgctatgytgtgcaacaa

SEQ ID NO: 18804 - DNA, 21 bp, Hordeum vulgare
gtttcccctasgacattatat

SEQ ID NO: 18805 - DNA, 21 bp, Hordeum vulgare
ttcccctcgamaccgtatgga

SEQ ID NO: 18806 - DNA, 21 bp, Hordeum vulgare
gagcggaaccsgatataagct

SEQ ID NO: 18807 - DNA, 21 bp, Hordeum vulgare
ggcagatcgaygcgaccggct

SEQ ID NO: 18808 - DNA, 21 bp, Hordeum vulgare
gtcacgccgtmaacgacgcgt

SEQ ID NO: 18809 - DNA, 21 bp, Hordeum vulgare
accacaattartacctggagc

SEQ ID NO: 18810 - DNA, 21 bp, Hordeum vulgare
ggatgggctgsccgaagtgga

SEQ ID NO: 18811 - DNA, 21 bp, Hordeum vulgare
gtacagtgctmaacggtgtgc

SEQ ID NO: 18812 - DNA, 21 bp, Hordeum vulgare
ccacgttcagmttcaccaagg

SEQ ID NO: 18813 - DNA, 21 bp, Hordeum vulgare
actgcgaagartatgaaattt

SEQ ID NO: 18814 - DNA, 21 bp, Hordeum vulgare
aggagccgagsgagttggggt

SEQ ID NO: 18815 - DNA, 21 bp, Hordeum vulgare
cgtgcacagayccagagtggt

SEQ ID NO: 18816 - DNA, 21 bp, Hordeum vulgare
agttggggtcrgttccccacc

SEQ ID NO: 18817 - DNA, 21 bp, Hordeum vulgare
atctaaagctwtaccggctcg

SEQ ID NO: 18818 - DNA, 21 bp, Hordeum vulgare
gacattagcgrttagaacctg

SEQ ID NO: 18819 - DNA, 21 bp, Hordeum vulgare
atgctgcagcraaaataaaca

SEQ ID NO: 18820 - DNA, 21 bp, Hordeum vulgare
tggcatcctcrattgagtcaa

SEQ ID NO: 18821 - DNA, 21 bp, Hordeum vulgare
cacacatgtcrgtggttattt

SEQ ID NO: 18822 - DNA, 21 bp, Hordeum vulgare
gcctttttcgrtaaacaagaa

SEQ ID NO: 18823 - DNA, 21 bp, Hordeum vulgare
ctggatttcckgctgcccgat

SEQ ID NO: 18824 - DNA, 21 bp, Hordeum vulgare
gccggaaggtrctcttgaatc

SEQ ID NO: 18825 - DNA, 21 bp, Hordeum vulgare
caacaagctcrgcagcttcga

SEQ ID NO: 18826 - DNA, 21 bp, Hordeum vulgare
atgtgaggcamaggtacatgt

SEQ ID NO: 18827 - DNA, 21 bp, Hordeum vulgare
ctattactcaygagctagcgt

SEQ ID NO: 18828 - DNA, 21 bp, Hordeum vulgare
aagattgaagrtgtcttgaga

SEQ ID NO: 18829 - DNA, 21 bp, Hordeum vulgare
atggcatacartctgcgcaac

SEQ ID NO: 18830 - DNA, 21 bp, Hordeum vulgare
tatttttccamaaataaatat

SEQ ID NO: 18831 - DNA, 21 bp, Hordeum vulgare
cctggtttacyctgtcatcat

SEQ ID NO: 18832 - DNA, 21 bp, Hordeum vulgare
gaatgcctacmtcgatcgtct

SEQ ID NO: 18833 - DNA, 21 bp, Hordeum vulgare
gcgcttacatrcggcgcggct

SEQ ID NO: 18834 - DNA, 21 bp, Hordeum vulgare
gacgccactgstgatctcttk

SEQ ID NO: 18835 - DNA, 21 bp, Hordeum vulgare
tcattcaagcyggcaatagca

SEQ ID NO: 18836 - DNA, 21 bp, Hordeum vulgare
ggacgacgacrgcatcgccgg

SEQ ID NO: 18837 - DNA, 21 bp, Hordeum vulgare
ttcggtgtggscgatgacaag

SEQ ID NO: 18838 - DNA, 21 bp, Hordeum vulgare
ctcacagagcrcggcacgcag

SEQ ID NO: 18839 - DNA, 21 bp, Hordeum vulgare
agtttttaacwaagtgcttcc

SEQ ID NO: 18840 - DNA, 21 bp, Hordeum vulgare
ttgcttgaggmagagacgtct

SEQ ID NO: 18841 - DNA, 21 bp, Hordeum vulgare
tttattattayaaccaatccc

SEQ ID NO: 18842 - DNA, 21 bp, Hordeum vulgare
ttactgaggcratgtgtactt

SEQ ID NO: 18843 - DNA, 21 bp, Hordeum vulgare
accaatcccakttcttcctgc

SEQ ID NO: 18844 - DNA, 21 bp, Hordeum vulgare
cctgtgaagakcccggatgct

SEQ ID NO: 18845 - DNA, 21 bp, Hordeum vulgare
agcctgcaatygatatcactc

SEQ ID NO: 18846 - DNA, 21 bp, Hordeum vulgare
ggtcatccgcsgcgccgtggt

SEQ ID NO: 18847 - DNA, 21 bp, Hordeum vulgare
acctcctcctscttgtgcctg

SEQ ID NO: 18848 - DNA, 21 bp, Hordeum vulgare
tttccgttaaygccgtctaat

SEQ ID NO: 18849 - DNA, 21 bp, Hordeum vulgare
actcagtcacrctacactttt

SEQ ID NO: 18850 - DNA, 21 bp, Hordeum vulgare
agggataccayggaaacaaaa

SEQ ID NO: 18851 - DNA, 21 bp, Hordeum vulgare
tgatgctgccrctgctccggt

SEQ ID NO: 18852 - DNA, 21 bp, Hordeum vulgare
gggggccgcaragaagaagct

SEQ ID NO: 18853 - DNA, 21 bp, Hordeum vulgare
atgcctgttcytaagctgatc

SEQ ID NO: 18854 - DNA, 21 bp, Hordeum vulgare
gaaacataatwcagctacaaa

SEQ ID NO: 18855 - DNA, 21 bp, Hordeum vulgare
aacgctgccgkggacgctacc

SEQ ID NO: 18856 - DNA, 21 bp, Hordeum vulgare
caccgagggcwcactcggata

SEQ ID NO: 18857 - DNA, 21 bp, Hordeum vulgare
agcgggttctygaggcccaca

SEQ ID NO: 18858 - DNA, 21 bp, Hordeum vulgare
tgaacaggatmgcccagtatc

SEQ ID NO: 18859 - DNA, 21 bp, Hordeum vulgare
aatcatctgcrctagcatttc

SEQ ID NO: 18860 - DNA, 21 bp, Hordeum vulgare
cactctcagcrttccttgtga

SEQ ID NO: 18861 - DNA, 21 bp, Hordeum vulgare
atgcacgcagygaagaagagc

SEQ ID NO: 18862 - DNA, 21 bp, Hordeum vulgare
ctgctcaagcrctgtgtgaaa

SEQ ID NO: 18863 - DNA, 21 bp, Hordeum vulgare
atactatctakggtgcaatct

SEQ ID NO: 18864 - DNA, 21 bp, Hordeum vulgare
agaggctatcrcttccgtcgg

SEQ ID NO: 18865 - DNA, 21 bp, Hordeum vulgare
tcttgtcttargattgtctag

SEQ ID NO: 18866 - DNA, 21 bp, Hordeum vulgare
tgcaaggcgcmtgccaaaaag

SEQ ID NO: 18867 - DNA, 21 bp, Hordeum vulgare
tattatattakgactgctcat

SEQ ID NO: 18868 - DNA, 21 bp, Hordeum vulgare
agcatggcagsaagtagcaga

SEQ ID NO: 18869 - DNA, 21 bp, Hordeum vulgare
catactagtartgcttacggc

SEQ ID NO: 18870 - DNA, 21 bp, Hordeum vulgare
tcctgtactcrggtttcacca

SEQ ID NO: 18871 - DNA, 21 bp, Hordeum vulgare
acacgtgccaygggttggcgg

SEQ ID NO: 18872 - DNA, 21 bp, Hordeum vulgare
tagagcgtgtrgcatgccatc

SEQ ID NO: 18873 - DNA, 21 bp, Hordeum vulgare
agctgcccggsgaaaaaccca

SEQ ID NO: 18874 - DNA, 21 bp, Hordeum vulgare
ctcatgtacarttagtacaca

SEQ ID NO: 18875 - DNA, 21 bp, Hordeum vulgare
tgcaggtcggrgcacactgct

SEQ ID NO: 18876 - DNA, 21 bp, Hordeum vulgare
ttaccgccggyggcaacgtcc

SEQ ID NO: 18877 - DNA, 21 bp, Hordeum vulgare
ccatggacggyccgcaggact

SEQ ID NO: 18878 - DNA, 21 bp, Hordeum vulgare
gcatgcggtamctagttaccg

SEQ ID NO: 18879 - DNA, 21 bp, Hordeum vulgare
gggcgtgcatmggggcgggac

SEQ ID NO: 18880 - DNA, 21 bp, Hordeum vulgare
cgacctggacrgcaggcaggt

SEQ ID NO: 18881 - DNA, 21 bp, Hordeum vulgare
tgcaggttttsgggcactcga

SEQ ID NO: 18882 - DNA, 21 bp, Hordeum vulgare
cgacgtactgrtcctggcaga

SEQ ID NO: 18883 - DNA, 21 bp, Hordeum vulgare
gacgtgacggytcgggttgat

SEQ ID NO: 18884 - DNA, 21 bp, Hordeum vulgare
tctcctatgcytcgatgtgca

SEQ ID NO: 18885 - DNA, 21 bp, Hordeum vulgare
gctctataaawttaaattaga

SEQ ID NO: 18886 - DNA, 21 bp, Hordeum vulgare
cgagagctggrccataatgga

SEQ ID NO: 18887 - DNA, 21 bp, Hordeum vulgare
cgacgtactgrtcctggcaga

SEQ ID NO: 18888 - DNA, 21 bp, Hordeum vulgare
gtaaaaccggmtgacagttat

SEQ ID NO: 18889 - DNA, 21 bp, Hordeum vulgare
cagaraaacargcaaaaacag

SEQ ID NO: 18890 - DNA, 21 bp, Hordeum vulgare
atagataattmgatatgtgaa

SEQ ID NO: 18891 - DNA, 21 bp, Hordeum vulgare
gccgcaacgawtcacagtccg

SEQ ID NO: 18892 - DNA, 21 bp, Hordeum vulgare
catccaatacktatatatgtt

SEQ ID NO: 18893 - DNA, 21 bp, Hordeum vulgare
gaatgctgctmcaagcatgtg

SEQ ID NO: 18894 - DNA, 21 bp, Hordeum vulgare
tttcacatgartggtcatacc

SEQ ID NO: 18895 - DNA, 21 bp, Hordeum vulgare
agagagcgccstccacgatct

SEQ ID NO: 18896 - DNA, 21 bp, Hordeum vulgare
tcgctcatcarcttgtacatg

SEQ ID NO: 18897 - DNA, 21 bp, Hordeum vulgare
gcagtctaatkaatgaacatc

SEQ ID NO: 18898 - DNA, 21 bp, Hordeum vulgare
ccggatcgccrcaccggatgt

SEQ ID NO: 18899 - DNA, 21 bp, Hordeum vulgare
catcccagctmacgctcttgg

SEQ ID NO: 18900 - DNA, 21 bp, Hordeum vulgare
caacaatcaarcaaactttat

SEQ ID NO: 18901 - DNA, 21 bp, Hordeum vulgare
tcaaggcacckgcctttgggt

SEQ ID NO: 18902 - DNA, 21 bp, Hordeum vulgare
tgaagacatcragtgatccca

SEQ ID NO: 18903 - DNA, 21 bp, Hordeum vulgare
tctctgattcyttcaaatact

SEQ ID NO: 18904 - DNA, 21 bp, Hordeum vulgare
gagacaggtcsagcgattcta

SEQ ID NO: 18905 - DNA, 21 bp, Hordeum vulgare
acgccttcttyctcatgctct

SEQ ID NO: 18906 - DNA, 21 bp, Hordeum vulgare
ccaccttggcrtcctccggca

SEQ ID NO: 18907 - DNA, 21 bp, Hordeum vulgare
atctgctatarctatatgaaa

SEQ ID NO: 18908 - DNA, 21 bp, Hordeum vulgare
aacacagcagytctttgattc

SEQ ID NO: 18909 - DNA, 21 bp, Hordeum vulgare
ttctctggaamgaggcatatg

SEQ ID NO: 18910 - DNA, 21 bp, Hordeum vulgare
aaatagaaatktgggagaaat

SEQ ID NO: 18911 - DNA, 21 bp, Hordeum vulgare
agttattgcayaatattaatt

SEQ ID NO: 18912 - DNA, 21 bp, Hordeum vulgare
tgcccaatcayaccatccaat

SEQ ID NO: 18913 - DNA, 21 bp, Hordeum vulgare
actccagatgmatgcttgatt

SEQ ID NO: 18914 - DNA, 21 bp, Hordeum vulgare
ttccagattcsaaatcatttc

SEQ ID NO: 18915 - DNA, 21 bp, Hordeum vulgare
acggcacggtyagtgtcaggt

SEQ ID NO: 18916 - DNA, 21 bp, Hordeum vulgare
attttagacaktgtwtggatc

SEQ ID NO: 18917 - DNA, 21 bp, Hordeum vulgare
aacactggtamcttgttagct

SEQ ID NO: 18918 - DNA, 21 bp, Hordeum vulgare
ctaaactcgtsgtccgtcaac

SEQ ID NO: 18919 - DNA, 21 bp, Hordeum vulgare
aacactggtamcttgttagct

SEQ ID NO: 18920 - DNA, 20 bp, Hordeum vulgare
gatcgctggggctataggca

SEQ ID NO: 18921 - DNA, 21 bp, Hordeum vulgare
gatcgctgggcgctataggca

SEQ ID NO: 18922 - DNA, 21 bp, Hordeum vulgare
tctgcacagcrcctggttgct

SEQ ID NO: 18923 - DNA, 21 bp, Hordeum vulgare
cagtcgacacyggcgctgatc

SEQ ID NO: 18924 - DNA, 21 bp, Hordeum vulgare
ccgtgtgccaygcattgcctc

SEQ ID NO: 18925 - DNA, 21 bp, Hordeum vulgare
taaggcgaagkcacctagggc

SEQ ID NO: 18926 - DNA, 21 bp, Hordeum vulgare
aaaatcatacrgatccattct

SEQ ID NO: 18927 - DNA, 21 bp, Hordeum vulgare
aggcccacacmgtaacgtcgg

SEQ ID NO: 18928 - DNA, 21 bp, Hordeum vulgare
aacatttcaaraattctaaat

SEQ ID NO: 18929 - DNA, 21 bp, Hordeum vulgare
attctaaattytgtggtagaa

SEQ ID NO: 18930 - DNA, 21 bp, Hordeum vulgare
gagatatctgyggaacaacaa

SEQ ID NO: 18931 - DNA, 21 bp, Hordeum vulgare
cttgcttgtcrgcggtgctct

SEQ ID NO: 18932 - DNA, 21 bp, Hordeum vulgare
gccttgccagygtttaaccca

SEQ ID NO: 18933 - DNA, 21 bp, Hordeum vulgare
gttgcccgcgratctgcaccg

SEQ ID NO: 18934 - DNA, 21 bp, Hordeum vulgare
cttaatttcamctatctgagc

SEQ ID NO: 18935 - DNA, 21 bp, Hordeum vulgare
tctctttcatycttgttcttt

SEQ ID NO: 18936 - DNA, 21 bp, Hordeum vulgare
cgaccacacgygtcccagcag

SEQ ID NO: 18937 - DNA, 21 bp, Hordeum vulgare
gcataaatatkaattacatgc

SEQ ID NO: 18938 - DNA, 21 bp, Hordeum vulgare
tggtgctaggrtgcttgcaga

SEQ ID NO: 18939 - DNA, 21 bp, Hordeum vulgare
aggtgaactcraggtttgggc

SEQ ID NO: 18940 - DNA, 21 bp, Hordeum vulgare
tcatggtaagyttgcaatgtg

SEQ ID NO: 18941 - DNA, 21 bp, Hordeum vulgare
tcatggtaagyttgcaatgtg

SEQ ID NO: 18942 - DNA, 21 bp, Hordeum vulgare
gataagcatgyacatacacat

SEQ ID NO: 18943 - DNA, 21 bp, Hordeum vulgare
caagcatatasaacatcagca

SEQ ID NO: 18944 - DNA, 21 bp, Hordeum vulgare
caagctatggyttgtgttctt

SEQ ID NO: 18945 - DNA, 21 bp, Hordeum vulgare
ttacccaggamattgaaatgg

SEQ ID NO: 18946 - DNA, 21 bp, Hordeum vulgare
tggtggcaacragctccatca

SEQ ID NO: 18947 - DNA, 21 bp, Hordeum vulgare
tctgaccatcytcagcagtct

SEQ ID NO: 18948 - DNA, 21 bp, Hordeum vulgare
aattcaagtgrttggaattac

SEQ ID NO: 18949 - DNA, 21 bp, Hordeum vulgare
gccgccacggyaaggaagacg

SEQ ID NO: 18950 - DNA, 21 bp, Hordeum vulgare
ctgtagtgctycttcgtcagg

SEQ ID NO: 18951 - DNA, 21 bp, Hordeum vulgare
ctgtagtgctycttcgtcagg

SEQ ID NO: 18952 - DNA, 21 bp, Hordeum vulgare
aataattcatygattaacaaa

SEQ ID NO: 18953 - DNA, 21 bp, Hordeum vulgare
ggattgcttgsacataccgag

SEQ ID NO: 18954 - DNA, 21 bp, Hordeum vulgare
tctgctttgtyggtgtcatct

SEQ ID NO: 18955 - DNA, 21 bp, Hordeum vulgare
agaccagtgaygttcagcaat

SEQ ID NO: 18956 - DNA, 21 bp, Hordeum vulgare
cagaaagtcgwccatgaggga

SEQ ID NO: 18957 - DNA, 21 bp, Hordeum vulgare
cctacgccttycccttctttc

SEQ ID NO: 18958 - DNA, 21 bp, Hordeum vulgare
gcggctcgctytgaaggtgtc

SEQ ID NO: 18959 - DNA, 21 bp, Hordeum vulgare
ctggctgactsagaaaaagga

SEQ ID NO: 18960 - DNA, 21 bp, Hordeum vulgare
ctgaaaccctrgatgcggctc

SEQ ID NO: 18961 - DNA, 21 bp, Hordeum vulgare
atgctgcctaraaccactttg

SEQ ID NO: 18962 - DNA, 21 bp, Hordeum vulgare
tggcctagaakcatgctgcct

SEQ ID NO: 18963 - DNA, 21 bp, Hordeum vulgare
ggccttcgacrctaagctttg

SEQ ID NO: 18964 - DNA, 21 bp, Hordeum vulgare
atatttgcatsatatcaaggt

SEQ ID NO: 18965 - DNA, 21 bp, Hordeum vulgare
cggtcaaggcwatgagatgcc

SEQ ID NO: 18966 - DNA, 21 bp, Hordeum vulgare
cgaggtgttayacttcatagc

SEQ ID NO: 18967 - DNA, 21 bp, Hordeum vulgare
cttttctgacmaagcgcatgt

SEQ ID NO: 18968 - DNA, 21 bp, Hordeum vulgare
gcacgcttcamaagattaacg

SEQ ID NO: 18969 - DNA, 21 bp, Hordeum vulgare
gtggtgttgcsgcagactgcg

SEQ ID NO: 18970 - DNA, 21 bp, Hordeum vulgare
ggcaggaaacrgaacattgag

SEQ ID NO: 18971 - DNA, 21 bp, Hordeum vulgare
gcgatcctacygtaatgtact

SEQ ID NO: 18972 - DNA, 21 bp, Hordeum vulgare
gaccttttgcscttctttcca

SEQ ID NO: 18973 - DNA, 21 bp, Hordeum vulgare
tggaacaagtycagtagaaat

SEQ ID NO: 18974 - DNA, 21 bp, Hordeum vulgare
gatgaaatagwggcgtcgtta

SEQ ID NO: 18975 - DNA, 21 bp, Hordeum vulgare
acttgcgcgaygcgatcgcat

SEQ ID NO: 18976 - DNA, 21 bp, Hordeum vulgare
cggatttctaycagacaagaa

SEQ ID NO: 18977 - DNA, 21 bp, Hordeum vulgare
atttttagaawtaggtgcaga

SEQ ID NO: 18978 - DNA, 21 bp, Hordeum vulgare
taagatgagcrtgccattttt

SEQ ID NO: 18979 - DNA, 21 bp, Hordeum vulgare
aagatttgggyttctacttat

SEQ ID NO: 18980 - DNA, 21 bp, Hordeum vulgare
acatatattaytggctgcttt

SEQ ID NO: 18981 - DNA, 21 bp, Hordeum vulgare
tatggatctayggcgcagctt

SEQ ID NO: 18982 - DNA, 21 bp, Hordeum vulgare
atcagcgtggytgctgatgac

SEQ ID NO: 18983 - DNA, 21 bp, Hordeum vulgare
ctccgtacttygcaacaagtt

SEQ ID NO: 18984 - DNA, 21 bp, Hordeum vulgare
agaggagttcrcactggtaat

SEQ ID NO: 18985 - DNA, 21 bp, Hordeum vulgare
actttgagccrgaagatttcg

SEQ ID NO: 18986 - DNA, 21 bp, Hordeum vulgare
tgaatacgaakggtgagatcc

SEQ ID NO: 18987 - DNA, 21 bp, Hordeum vulgare
cacatagacaktctcttagaa

SEQ ID NO: 18988 - DNA, 21 bp, Hordeum vulgare
caaggctttgytaggtactac

SEQ ID NO: 18989 - DNA, 21 bp, Hordeum vulgare
ccaagatgcayggtctacttc

SEQ ID NO: 18990 - DNA, 21 bp, Hordeum vulgare
tatcatttcayaacccaagat

SEQ ID NO: 18991 - DNA, 21 bp, Hordeum vulgare
agctcatggtygaagccgcga

SEQ ID NO: 18992 - DNA, 21 bp, Hordeum vulgare
ccacatctggmaggtgttcag

SEQ ID NO: 18993 - DNA, 21 bp, Hordeum vulgare
gccttcaagcyttcatacgca

SEQ ID NO: 18994 - DNA, 21 bp, Hordeum vulgare
ctgctgtagcytagctgagac

SEQ ID NO: 18995 - DNA, 21 bp, Hordeum vulgare
tgctgcaagcmaatttctttt

SEQ ID NO: 18996 - DNA, 21 bp, Hordeum vulgare
ccccctcctayttctttgttt

SEQ ID NO: 18997 - DNA, 21 bp, Hordeum vulgare
gggaagctcarctgtggtggt

SEQ ID NO: 18998 - DNA, 21 bp, Hordeum vulgare
cgagcttgacracctgcttgc

SEQ ID NO: 18999 - DNA, 21 bp, Hordeum vulgare
aggttcaagggccgggagatt

SEQ ID NO: 19000 - DNA, 20 bp, Hordeum vulgare
aggttcaaggccgggagatt

SEQ ID NO: 19001 - DNA, 21 bp, Hordeum vulgare
tctagacgtayttagtgctac

SEQ ID NO: 19002 - DNA, 21 bp, Hordeum vulgare
cccaaagctgratccaccaca

SEQ ID NO: 19003 - DNA, 21 bp, Hordeum vulgare
ttcacctattsagggaactaa

SEQ ID NO: 19004 - DNA, 21 bp, Hordeum vulgare
attttctttcrgctccttatg

SEQ ID NO: 19005 - DNA, 21 bp, Hordeum vulgare
cgatttcgatygccttgggtt

SEQ ID NO: 19006 - DNA, 21 bp, Hordeum vulgare
cgagggcaccraatctgcagt

SEQ ID NO: 19007 - DNA, 21 bp, Hordeum vulgare
tctgttccacstccatgtcgc

SEQ ID NO: 19008 - DNA, 21 bp, Hordeum vulgare
ttatgatcgcsttgcctcggg

SEQ ID NO: 19009 - DNA, 21 bp, Hordeum vulgare
atagcctgctygttctgccta

SEQ ID NO: 19010 - DNA, 21 bp, Hordeum vulgare
ctccttctggwgattttcatt

SEQ ID NO: 19011 - DNA, 21 bp, Hordeum vulgare
ccatgacagtmtcccttgtct

SEQ ID NO: 19012 - DNA, 21 bp, Hordeum vulgare
caaacacaagyaaactcttgg

SEQ ID NO: 19013 - DNA, 21 bp, Hordeum vulgare
tacggccgggyacgtttactc

SEQ ID NO: 19014 - DNA, 21 bp, Hordeum vulgare
tcttgtcgagrcctgatgtgt

SEQ ID NO: 19015 - DNA, 21 bp, Hordeum vulgare
cttgatgatgwtataagggcc

SEQ ID NO: 19016 - DNA, 21 bp, Hordeum vulgare
atggagatttwtaaacttcca

SEQ ID NO: 19017 - DNA, 21 bp, Hordeum vulgare
ggacttcatgygccactccag

SEQ ID NO: 19018 - DNA, 21 bp, Hordeum vulgare
atccgcgctascttttagcta

SEQ ID NO: 19019 - DNA, 21 bp, Hordeum vulgare
ccatcgagtarggtgaatcga

SEQ ID NO: 19020 - DNA, 21 bp, Hordeum vulgare
ggcaaaagaaytgaagaaact

SEQ ID NO: 19021 - DNA, 21 bp, Hordeum vulgare
accctgcatgyaagtcaccgg

SEQ ID NO: 19022 - DNA, 21 bp, Hordeum vulgare
ccatcttaccrcctgcatcga

SEQ ID NO: 19023 - DNA, 21 bp, Hordeum vulgare
gaacggtggtktatggtgttg

SEQ ID NO: 19024 - DNA, 21 bp, Hordeum vulgare
cgagctgttaraaaatagctg

SEQ ID NO: 19025 - DNA, 21 bp, Hordeum vulgare
agactcgtcaraagacgacca

SEQ ID NO: 19026 - DNA, 21 bp, Hordeum vulgare
gcccgtaaacrtcttgctggc

SEQ ID NO: 19027 - DNA, 21 bp, Hordeum vulgare
tgggaggattkaaaacttact

SEQ ID NO: 19028 - DNA, 21 bp, Hordeum vulgare
gattcgtctcrgatttgcagg

SEQ ID NO: 19029 - DNA, 21 bp, Hordeum vulgare
cgaccttcgcrccgcccttgc

SEQ ID NO: 19030 - DNA, 21 bp, Hordeum vulgare
atctgacaacytcaaaatcgt

SEQ ID NO: 19031 - DNA, 21 bp, Hordeum vulgare
  MISC_FEATURE (14),(19): n is SNP, in which the one is a and the other is t or g or c
ggaagagaaarcanaacanag

SEQ ID NO: 19032 - DNA, 21 bp, Hordeum vulgare
tcactttccgracagaaaaca

SEQ ID NO: 19033 - DNA, 21 bp, Hordeum vulgare
aacctttgtamacttggcacc

SEQ ID NO: 19034 - DNA, 21 bp, Hordeum vulgare
accaaatgagytcatggaatc

SEQ ID NO: 19035 - DNA, 21 bp, Hordeum vulgare
ccttccgacarattcaacacc

SEQ ID NO: 19036 - DNA, 21 bp, Hordeum vulgare
attcgccgttyactgcgtcat

SEQ ID NO: 19037 - DNA, 21 bp, Hordeum vulgare
agcatatctcytcttcgggtc

SEQ ID NO: 19038 - DNA, 21 bp, Hordeum vulgare
tctctgctcayaagcttcata

SEQ ID NO: 19039 - DNA, 21 bp, Hordeum vulgare
cggtacgccckaatttcctgg

SEQ ID NO: 19040 - DNA, 21 bp, Hordeum vulgare
gtatatgtttsgcgccaggag

SEQ ID NO: 19041 - DNA, 21 bp, Hordeum vulgare
aagctcctgayggcgacgcag

SEQ ID NO: 19042 - DNA, 21 bp, Hordeum vulgare
ttgtagctacsgcctgcgtgt

SEQ ID NO: 19043 - DNA, 21 bp, Hordeum vulgare
ttccattgtcrgaacataagc

SEQ ID NO: 19044 - DNA, 21 bp, Hordeum vulgare
gcagcttcagsagctcctctc

SEQ ID NO: 19045 - DNA, 21 bp, Hordeum vulgare
tcaagaaggaktatacgttta

SEQ ID NO: 19046 - DNA, 21 bp, Hordeum vulgare
attatcaaacrgaatagtccc

SEQ ID NO: 19047 - DNA, 21 bp, Hordeum vulgare
atttggcatgyctcagaaatt

SEQ ID NO: 19048 - DNA, 21 bp, Hordeum vulgare
tgcattctctygttcgacagg

SEQ ID NO: 19049 - DNA, 21 bp, Hordeum vulgare
agtcccactcrctgagcagat

SEQ ID NO: 19050 - DNA, 21 bp, Hordeum vulgare
taataatatarttaagcgcaa

SEQ ID NO: 19051 - DNA, 21 bp, Hordeum vulgare
agctcactccktttgagccac

SEQ ID NO: 19052 - DNA, 21 bp, Hordeum vulgare
agcaataaaaracgtattggc

SEQ ID NO: 19053 - DNA, 21 bp, Hordeum vulgare
ttgctatgtcsggccgatgct

SEQ ID NO: 19054 - DNA, 21 bp, Hordeum vulgare
tgcgattttayataacgaaat

SEQ ID NO: 19055 - DNA, 21 bp, Hordeum vulgare
taataatatarttaagcgcaa

SEQ ID NO: 19056 - DNA, 21 bp, Hordeum vulgare
catgtaaaaastgacctcctg

SEQ ID NO: 19057 - DNA, 21 bp, Hordeum vulgare
tggcccaagawccctagctgg

SEQ ID NO: 19058 - DNA, 21 bp, Hordeum vulgare
cttgctctttycttcttatct

SEQ ID NO: 19059 - DNA, 21 bp, Hordeum vulgare
tgagctacgarggatattata

SEQ ID NO: 19060 - DNA, 21 bp, Hordeum vulgare
ccatctgcgtkttcgtgcatc

SEQ ID NO: 19061 - DNA, 21 bp, Hordeum vulgare
ctgtaaaagargatcaaacag

SEQ ID NO: 19062 - DNA, 21 bp, Hordeum vulgare
catcatccttygctcgaggaa

SEQ ID NO: 19063 - DNA, 21 bp, Hordeum vulgare
cctcttcattygacaatacat

SEQ ID NO: 19064 - DNA, 21 bp, Hordeum vulgare
tacgttgggcrgatgacaagt

SEQ ID NO: 19065 - DNA, 21 bp, Hordeum vulgare
gctgcaacacmaatggaaaag

SEQ ID NO: 19066 - DNA, 21 bp, Hordeum vulgare
ccgtggcttcrctgtcaaacg

SEQ ID NO: 19067 - DNA, 21 bp, Hordeum vulgare
actcctcaagytcgacgatta

SEQ ID NO: 19068 - DNA, 21 bp, Hordeum vulgare
taattatgacsagagagacaa

SEQ ID NO: 19069 - DNA, 21 bp, Hordeum vulgare
agcacctgcgrggagtaagtg

SEQ ID NO: 19070 - DNA, 21 bp, Hordeum vulgare
acatgcgaatmtttttttaat

SEQ ID NO: 19071 - DNA, 21 bp, Hordeum vulgare
gcattcatgcsgctcatcttt

SEQ ID NO: 19072 - DNA, 21 bp, Hordeum vulgare
gacaaactagycatcaaatgc

SEQ ID NO: 19073 - DNA, 21 bp, Hordeum vulgare
gatggacactyggtagcaaaa

SEQ ID NO: 19074 - DNA, 21 bp, Hordeum vulgare
accacccagawtatataatcc

SEQ ID NO: 19075 - DNA, 21 bp, Hordeum vulgare
actagcactakcactagcact

SEQ ID NO: 19076 - DNA, 21 bp, Hordeum vulgare
gatgtatctasacacgtttta

SEQ ID NO: 19077 - DNA, 21 bp, Hordeum vulgare
tcatgtacgcraagaaaacag

SEQ ID NO: 19078 - DNA, 21 bp, Hordeum vulgare
aaagcaatgtscggttaagtt

SEQ ID NO: 19079 - DNA, 21 bp, Hordeum vulgare
cttgtggattsaagtacatga

SEQ ID NO: 19080 - DNA, 21 bp, Hordeum vulgare
gggttctggtkgacatacaaa

SEQ ID NO: 19081 - DNA, 21 bp, Hordeum vulgare
caaaaagagaygaggcgaggc

SEQ ID NO: 19082 - DNA, 21 bp, Hordeum vulgare
tcgaacgcggmaggcaacggc

SEQ ID NO: 19083 - DNA, 21 bp, Hordeum vulgare
ttatctttcckggggtaacca

SEQ ID NO: 19084 - DNA, 21 bp, Hordeum vulgare
tgtcccacgcrctgttgatcg

SEQ ID NO: 19085 - DNA, 21 bp, Hordeum vulgare
gaaaaaactgygcctctacaa

SEQ ID NO: 19086 - DNA, 21 bp, Hordeum vulgare
cgagcttcacycggtcaccat

SEQ ID NO: 19087 - DNA, 21 bp, Hordeum vulgare
gatgataactycatttgcgca

SEQ ID NO: 19088 - DNA, 21 bp, Hordeum vulgare
cacttacaaargacttcatca

SEQ ID NO: 19089 - DNA, 21 bp, Hordeum vulgare
tgttaacactyacgaccagga

SEQ ID NO: 19090 - DNA, 21 bp, Hordeum vulgare
actctacggarcggtcgacct

SEQ ID NO: 19091 - DNA, 21 bp, Hordeum vulgare
atgtttataayatgatacagg

SEQ ID NO: 19092 - DNA, 21 bp, Hordeum vulgare
acgagtgttcyaacgagtggt

SEQ ID NO: 19093 - DNA, 21 bp, Hordeum vulgare
agtcaaactcmagtgaggaac

SEQ ID NO: 19094 - DNA, 21 bp, Hordeum vulgare
gatgattgggsatctgttgat

SEQ ID NO: 19095 - DNA, 21 bp, Hordeum vulgare
acagattttgygcagcatgtt

SEQ ID NO: 19096 - DNA, 21 bp, Hordeum vulgare
aggccttggcragcacgtcgt

SEQ ID NO: 19097 - DNA, 21 bp, Hordeum vulgare
ttgtgctaccrggcttgaata

SEQ ID NO: 19098 - DNA, 21 bp, Hordeum vulgare
agctgagcgcrattccttgtg

SEQ ID NO: 19099 - DNA, 21 bp, Hordeum vulgare
caggtgtagcyccatatctgg

SEQ ID NO: 19100 - DNA, 21 bp, Hordeum vulgare
ttccggggatycttccagcta

SEQ ID NO: 19101 - DNA, 21 bp, Hordeum vulgare
tctggtacaartccttcaacc

SEQ ID NO: 19102 - DNA, 21 bp, Hordeum vulgare
gttaaataaarcctcaaaatt

SEQ ID NO: 19103 - DNA, 21 bp, Hordeum vulgare
catggtgaacmggkgagtctt

SEQ ID NO: 19104 - DNA, 21 bp, Hordeum vulgare
acatacaagargcaataaaaa

SEQ ID NO: 19105 - DNA, 21 bp, Hordeum vulgare
gtaatcaactrattcctttgg

SEQ ID NO: 19106 - DNA, 21 bp, Hordeum vulgare
gaaaacaggarccaaaggacg

SEQ ID NO: 19107 - DNA, 21 bp, Hordeum vulgare
caacattccgyttcgaaagaa

SEQ ID NO: 19108 - DNA, 21 bp, Hordeum vulgare
gccaacttgtygtcgatgtag

SEQ ID NO: 19109 - DNA, 21 bp, Hordeum vulgare
tctcttttctragcttcagat

SEQ ID NO: 19110 - DNA, 21 bp, Hordeum vulgare
gtgtagcacawatacagttag

SEQ ID NO: 19111 - DNA, 21 bp, Hordeum vulgare
tactgggctcmcactgatgag

SEQ ID NO: 19112 - DNA, 21 bp, Hordeum vulgare
agaaagtgctktactgggctc

SEQ ID NO: 19113 - DNA, 21 bp, Hordeum vulgare
actgcatggcraataatgcag

SEQ ID NO: 19114 - DNA, 21 bp, Hordeum vulgare
tactgccgtamagtatattta

SEQ ID NO: 19115 - DNA, 21 bp, Hordeum vulgare
ccgataggccwcacttgtcaa

SEQ ID NO: 19116 - DNA, 21 bp, Hordeum vulgare
cagaattctgytccttagtgc

SEQ ID NO: 19117 - DNA, 21 bp, Hordeum vulgare
caggagaatayggaagtcaga

SEQ ID NO: 19118 - DNA, 21 bp, Hordeum vulgare
tcgaggtttcsactttctaga

SEQ ID NO: 19119 - DNA, 21 bp, Hordeum vulgare
atcatgtacaratatgtcagg

SEQ ID NO: 19120 - DNA, 21 bp, Hordeum vulgare
gtggactgtgyaacccagtta

SEQ ID NO: 19121 - DNA, 21 bp, Hordeum vulgare
aatggtagtgstttgggaaaa

SEQ ID NO: 19122 - DNA, 21 bp, Hordeum vulgare
tgtgcttcaayttcctcgtca

SEQ ID NO: 19123 - DNA, 21 bp, Hordeum vulgare
gatcatcatamgcaacaggca

SEQ ID NO: 19124 - DNA, 21 bp, Hordeum vulgare
aatattcatarttaatacaca

SEQ ID NO: 19125 - DNA, 21 bp, Hordeum vulgare
atattgcagcrgtcatttact

SEQ ID NO: 19126 - DNA, 21 bp, Hordeum vulgare
gacctaccaasgtttgctaaa

SEQ ID NO: 19127 - DNA, 21 bp, Hordeum vulgare
cttgtatatartgacctacca

SEQ ID NO: 19128 - DNA, 21 bp, Hordeum vulgare
tactcccttcyagttcagttt

SEQ ID NO: 19129 - DNA, 21 bp, Hordeum vulgare
cttgcaattartaaatgaatg

SEQ ID NO: 19130 - DNA, 21 bp, Hordeum vulgare
aatttctgaaygattcacctg

SEQ ID NO: 19131 - DNA, 21 bp, Hordeum vulgare
aaaacgattcrcggttcagct

SEQ ID NO: 19132 - DNA, 21 bp, Hordeum vulgare
caagagaaaargatcatgtgg

SEQ ID NO: 19133 - DNA, 20 bp, Hordeum vulgare
atccgtagcccaaggatcct

SEQ ID NO: 19134 - DNA, 21 bp, Hordeum vulgare
atccgtagccacaaggatcct

SEQ ID NO: 19135 - DNA, 21 bp, Hordeum vulgare
gcatcccacarccgaagaagt

SEQ ID NO: 19136 - DNA, 21 bp, Hordeum vulgare
tttttaacacratttttaaca

SEQ ID NO: 19137 - DNA, 21 bp, Hordeum vulgare
gatttaaacasctcatttcgt

SEQ ID NO: 19138 - DNA, 21 bp, Hordeum vulgare
catagcactcsgatttccttc

SEQ ID NO: 19139 - DNA, 21 bp, Hordeum vulgare
agctttagggwaaatacatat

SEQ ID NO: 19140 - DNA, 21 bp, Hordeum vulgare
atttcccgtgmtgtctgaaac

SEQ ID NO: 19141 - DNA, 21 bp, Hordeum vulgare
taacatacaamaccagagaaa

SEQ ID NO: 19142 - DNA, 21 bp, Hordeum vulgare
cgatttctgtrtaccttcttc

SEQ ID NO: 19143 - DNA, 21 bp, Hordeum vulgare
gaaccagataycatggtgtat

SEQ ID NO: 19144 - DNA, 21 bp, Hordeum vulgare
tacaggcaagygaaccacctc

SEQ ID NO: 19145 - DNA, 21 bp, Hordeum vulgare
atcagctagakttggcataca

SEQ ID NO: 19146 - DNA, 21 bp, Hordeum vulgare
acgcctactcmccgcgccccg

SEQ ID NO: 19147 - DNA, 21 bp, Hordeum vulgare
acccctccgcstcccgatctc

SEQ ID NO: 19148 - DNA, 21 bp, Hordeum vulgare
cctagaggagrgaaggcaaga

SEQ ID NO: 19149 - DNA, 21 bp, Hordeum vulgare
ccctcgcctakaacccctccg

SEQ ID NO: 19150 - DNA, 21 bp, Hordeum vulgare
agaactgtggmgcatactact

SEQ ID NO: 19151 - DNA, 21 bp, Hordeum vulgare
accagctgcasgttataccct

SEQ ID NO: 19152 - DNA, 21 bp, Hordeum vulgare
cggggccgcaratatacattg

SEQ ID NO: 19153 - DNA, 21 bp, Hordeum vulgare
aatgaacccakaaaggagatt

SEQ ID NO: 19154 - DNA, 21 bp, Hordeum vulgare
acagggaacgrctataaaagc

SEQ ID NO: 19155 - DNA, 21 bp, Hordeum vulgare
cctaacagtakaaatgctatg

SEQ ID NO: 19156 - DNA, 21 bp, Hordeum vulgare
tactactaacrcgttactggg

SEQ ID NO: 19157 - DNA, 21 bp, Hordeum vulgare
cattgtgtctygagtcaatgg

SEQ ID NO: 19158 - DNA, 21 bp, Hordeum vulgare
ggagaacaagrtctgcctcga

SEQ ID NO: 19159 - DNA, 21 bp, Hordeum vulgare
ctccctctgtraaactttcag

SEQ ID NO: 19160 - DNA, 21 bp, Hordeum vulgare
gacataaccaytattagttgc

SEQ ID NO: 19161 - DNA, 21 bp, Hordeum vulgare
cagagctcctmtgaagtttcg

SEQ ID NO: 19162 - DNA, 21 bp, Hordeum vulgare
ctgcattaaamaattgagtgt

SEQ ID NO: 19163 - DNA, 21 bp, Hordeum vulgare
cattcggaacrtaccaaccac

SEQ ID NO: 19164 - DNA, 21 bp, Hordeum vulgare
acctggaatayaaaaacatcg

SEQ ID NO: 19165 - DNA, 21 bp, Hordeum vulgare
tcgcttcagamagcatcatta

SEQ ID NO: 19166 - DNA, 21 bp, Hordeum vulgare
aggccgggccrggccggagat

SEQ ID NO: 19167 - DNA, 21 bp, Hordeum vulgare
caaaaatcacrgaacagcaag

SEQ ID NO: 19168 - DNA, 21 bp, Hordeum vulgare
gcctgggccarcggacgatga

SEQ ID NO: 19169 - DNA, 21 bp, Hordeum vulgare
cagcaggtgayttcggggact

SEQ ID NO: 19170 - DNA, 21 bp, Hordeum vulgare
ggccacattaytcttggtggc

SEQ ID NO: 19171 - DNA, 21 bp, Hordeum vulgare
attttgctccrtatgtagact

SEQ ID NO: 19172 - DNA, 21 bp, Hordeum vulgare
ataagtcattygcgtagtttt

SEQ ID NO: 19173 - DNA, 21 bp, Hordeum vulgare
agagaaaataygggacggcag

SEQ ID NO: 19174 - DNA, 21 bp, Hordeum vulgare
tcaagcctgamaatacgacaa

SEQ ID NO: 19175 - DNA, 21 bp, Hordeum vulgare
ttcacatgttygctttcctct

SEQ ID NO: 19176 - DNA, 21 bp, Hordeum vulgare
ggccataagawatttcacacc

SEQ ID NO: 19177 - DNA, 21 bp, Hordeum vulgare
ttcatttactrgatactccat

SEQ ID NO: 19178 - DNA, 21 bp, Hordeum vulgare
gtagcactgamatggaagttc

SEQ ID NO: 19179 - DNA, 21 bp, Hordeum vulgare
tctgcatactktcgatttggt

SEQ ID NO: 19180 - DNA, 21 bp, Hordeum vulgare
ataaagaggaratggttaggc

SEQ ID NO: 19181 - DNA, 21 bp, Hordeum vulgare
gaacgctcacraggactgaac

SEQ ID NO: 19182 - DNA, 21 bp, Hordeum vulgare
ctctaggtgaraacgtgacta

SEQ ID NO: 19183 - DNA, 21 bp, Hordeum vulgare
gatctgttacrtctacagcat

SEQ ID NO: 19184 - DNA, 21 bp, Hordeum vulgare
taacaatcctyatattgtgga

SEQ ID NO: 19185 - DNA, 21 bp, Hordeum vulgare
aaatacaacarcatatgaaaa

SEQ ID NO: 19186 - DNA, 21 bp, Hordeum vulgare
aagccacgcamatagatctgt

SEQ ID NO: 19187 - DNA, 21 bp, Hordeum vulgare
cttacaaaatktagacaagca

SEQ ID NO: 19188 - DNA, 21 bp, Hordeum vulgare
tcgatccggtyccaaagagct

SEQ ID NO: 19189 - DNA, 21 bp, Hordeum vulgare
gacatgacacyaggtccagca

SEQ ID NO: 19190 - DNA, 21 bp, Hordeum vulgare
ctccatcagcraggaacttca

SEQ ID NO: 19191 - DNA, 21 bp, Hordeum vulgare
cagctatagtyatggaaataa

SEQ ID NO: 19192 - DNA, 21 bp, Hordeum vulgare
ttttctcctgyactctagctg

SEQ ID NO: 19193 - DNA, 21 bp, Hordeum vulgare
gtgccggacaycgctgttgtt

SEQ ID NO: 19194 - DNA, 21 bp, Hordeum vulgare
gaaggctagcrtgaagttgca

SEQ ID NO: 19195 - DNA, 21 bp, Hordeum vulgare
atatagtttcmcagcatacta

SEQ ID NO: 19196 - DNA, 21 bp, Hordeum vulgare
tatcgtcggcstgaatctgat

SEQ ID NO: 19197 - DNA, 21 bp, Hordeum vulgare
ctttcacagtyttgatttgag

SEQ ID NO: 19198 - DNA, 21 bp, Hordeum vulgare
tgaatcgatgrgtagtgacta

SEQ ID NO: 19199 - DNA, 21 bp, Hordeum vulgare
gctccctgcartccatattaa

SEQ ID NO: 19200 - DNA, 21 bp, Hordeum vulgare
cattgcaatcrtagcaaaaag

SEQ ID NO: 19201 - DNA, 21 bp, Hordeum vulgare
tgaagacatartaatcagcag

SEQ ID NO: 19202 - DNA, 21 bp, Hordeum vulgare
cagggcttgtkaatagtttta

SEQ ID NO: 19203 - DNA, 21 bp, Hordeum vulgare
atctcactgaraacagagcat

SEQ ID NO: 19204 - DNA, 21 bp, Hordeum vulgare
gggaacatgtwcatgcttcgg

SEQ ID NO: 19205 - DNA, 21 bp, Hordeum vulgare
tccgcagggcctgtctcccag

SEQ ID NO: 19206 - DNA, 20 bp, Hordeum vulgare
tccgcagggctgtctcccag

SEQ ID NO: 19207 - DNA, 21 bp, Hordeum vulgare
tgcatcacagcacgatcaaca

SEQ ID NO: 19208 - DNA, 20 bp, Hordeum vulgare
tgcatcacagacgatcaaca

SEQ ID NO: 19209 - DNA, 21 bp, Hordeum vulgare
gaatcgtcctmttttgctgcc

SEQ ID NO: 19210 - DNA, 21 bp, Hordeum vulgare
cctttcctgtygcctcccttg

SEQ ID NO: 19211 - DNA, 21 bp, Hordeum vulgare
tgcaaggtacyatcccaggat

SEQ ID NO: 19212 - DNA, 21 bp, Hordeum vulgare
cagcaccgccrggagtttgct

SEQ ID NO: 19213 - DNA, 21 bp, Hordeum vulgare
acatcaaaggrtcactataat

SEQ ID NO: 19214 - DNA, 21 bp, Hordeum vulgare
tgaaactggtraggagatata

SEQ ID NO: 19215 - DNA, 21 bp, Hordeum vulgare
aaactaccaargttgtatcca

SEQ ID NO: 19216 - DNA, 21 bp, Hordeum vulgare
tgatacaaaaratgtttgcat

SEQ ID NO: 19217 - DNA, 21 bp, Hordeum vulgare
cctggtatttygctatcagaa

SEQ ID NO: 19218 - DNA, 21 bp, Hordeum vulgare
acatatgagtwagtccgatga

SEQ ID NO: 19219 - DNA, 21 bp, Hordeum vulgare
ttgtcactcawgaaatactca

SEQ ID NO: 19220 - DNA, 21 bp, Hordeum vulgare
ctcagcttcastatttctgaa

SEQ ID NO: 19221 - DNA, 21 bp, Hordeum vulgare
ttttacgtttycctcagcttc

SEQ ID NO: 19222 - DNA, 21 bp, Hordeum vulgare
gcccagcagtrttctcctgaa

SEQ ID NO: 19223 - DNA, 21 bp, Hordeum vulgare
ccacccctctwccatctcctt

SEQ ID NO: 19224 - DNA, 21 bp, Hordeum vulgare
ccatgtcgacrtcggccggct

SEQ ID NO: 19225 - DNA, 21 bp, Hordeum vulgare
cggcagctcgyggtaccgctc

SEQ ID NO: 19226 - DNA, 21 bp, Hordeum vulgare
acacacacacraagagagaga

SEQ ID NO: 19227 - DNA, 21 bp, Hordeum vulgare
ctttgtcagaygcagccacag

SEQ ID NO: 19228 - DNA, 21 bp, Hordeum vulgare
agagctcacawatccattttc

SEQ ID NO: 19229 - DNA, 20 bp, Hordeum vulgare
  MISC_FEATURE (20): n stands for any base
cagctctgaagaacctcgtn

SEQ ID NO: 19230 - DNA, 21 bp, Hordeum vulgare
  MISC_FEATURE (21): n stands for any base
cagctctgaaagaacctcgtn

SEQ ID NO: 19231 - DNA, 20 bp, Hordeum vulgare
gtatcgaatagttaattaat

SEQ ID NO: 19232 - DNA, 21 bp, Hordeum vulgare
gaatcgaataagttaattaat

SEQ ID NO: 19233 - DNA, 20 bp, Hordeum vulgare
cctgtatgtgaaaatgaaaa

SEQ ID NO: 19234 - DNA, 21 bp, Hordeum vulgare
cctgtatgtgtaaaatgagaa

SEQ ID NO: 19235 - DNA, 21 bp, Hordeum vulgare
gttgtttgggsgtgcagagaa

SEQ ID NO: 19236 - DNA, 21 bp, Hordeum vulgare
ttagaacttasgcatgcaatg

SEQ ID NO: 19237 - DNA, 21 bp, Hordeum vulgare
cctggtatttygctatcagaa

SEQ ID NO: 19238 - DNA, 21 bp, Hordeum vulgare
ttgtttcagamagacttagta

SEQ ID NO: 19239 - DNA, 21 bp, Hordeum vulgare
tgtcttagttrtacattaatc

SEQ ID NO: 19240 - DNA, 21 bp, Hordeum vulgare
tatacagagakggttttacta

SEQ ID NO: 19241 - DNA, 21 bp, Hordeum vulgare
atcacacaaaycgtacatgaa

SEQ ID NO: 19242 - DNA, 21 bp, Hordeum vulgare
ggatcagcagwggcaaacaga

SEQ ID NO: 19243 - DNA, 21 bp, Hordeum vulgare
caattaagtgraactgcacct

SEQ ID NO: 19244 - DNA, 21 bp, Hordeum vulgare
gtgccgagtaygccacttgta

SEQ ID NO: 19245 - DNA, 21 bp, Hordeum vulgare
aaacgcttgtrggcaaccgcc

SEQ ID NO: 19246 - DNA, 21 bp, Hordeum vulgare
tagcggagccrccggaatcgt

SEQ ID NO: 19247 - DNA, 21 bp, Hordeum vulgare
gttcctcgttyggttttgtcg

SEQ ID NO: 19248 - DNA, 21 bp, Hordeum vulgare
aatcgtaatgmagcacggatg

SEQ ID NO: 19249 - DNA, 21 bp, Hordeum vulgare
ttgctacgaawccaagagaaa

SEQ ID NO: 19250 - DNA, 21 bp, Hordeum vulgare
cacatagaaaytatcacgcca

SEQ ID NO: 19251 - DNA, 21 bp, Hordeum vulgare
acctggagacwacatagatta

SEQ ID NO: 19252 - DNA, 21 bp, Hordeum vulgare
agatatctaamacctggagac

SEQ ID NO: 19253 - DNA, 21 bp, Hordeum vulgare
tttctcattakctgcaaaaaa

SEQ ID NO: 19254 - DNA, 21 bp, Hordeum vulgare
cagcggagccrgtcataggtt

SEQ ID NO: 19255 - DNA, 21 bp, Hordeum vulgare
atatttctggktcatggattt

SEQ ID NO: 19256 - DNA, 21 bp, Hordeum vulgare
ggtcggggcckggctggctat

SEQ ID NO: 19257 - DNA, 21 bp, Hordeum vulgare
tggctatcgarctccggcgac

SEQ ID NO: 19258 - DNA, 21 bp, Hordeum vulgare
agcatgtgctwgaaatgccgg

SEQ ID NO: 19259 - DNA, 21 bp, Hordeum vulgare
  MISC_FEATURE (11): n is SNP, in which the one is a and the other is t or g or c
cacaaacgaangcgcgtcttg

SEQ ID NO: 19260 - DNA, 21 bp, Hordeum vulgare
gccacgcatgygcacaagaaa

SEQ ID NO: 19261 - DNA, 21 bp, Hordeum vulgare
cagacgccatracccatctga

SEQ ID NO: 19262 - DNA, 21 bp, Hordeum vulgare
tcaaggtcaayaagtttcaca

SEQ ID NO: 19263 - DNA, 21 bp, Hordeum vulgare
gaggaattggwcaaacgccaa

SEQ ID NO: 19264 - DNA, 21 bp, Hordeum vulgare
acatagaggakaggatacacc

SEQ ID NO: 19265 - DNA, 21 bp, Hordeum vulgare
ggatttacacraccgattttg

SEQ ID NO: 19266 - DNA, 21 bp, Hordeum vulgare
agacgacttcwgctcttgatg

SEQ ID NO: 19267 - DNA, 21 bp, Hordeum vulgare
cttcttccccyacatctgcat

SEQ ID NO: 19268 - DNA, 21 bp, Hordeum vulgare
aattccacccyagaaaatcca

SEQ ID NO: 19269 - DNA, 21 bp, Hordeum vulgare
gagccctctgyccttggtcct

SEQ ID NO: 19270 - DNA, 21 bp, Hordeum vulgare
ccctgagtgcmttgccgccct

SEQ ID NO: 19271 - DNA, 21 bp, Hordeum vulgare
tgccgccctcrgacgccatga

SEQ ID NO: 19272 - DNA, 21 bp, Hordeum vulgare
cggcagctgcraccttcgccg

SEQ ID NO: 19273 - DNA, 21 bp, Hordeum vulgare
ccgcgtacagmggccagcata

SEQ ID NO: 19274 - DNA, 21 bp, Hordeum vulgare
cttcattgtakcctctcatct

SEQ ID NO: 19275 - DNA, 21 bp, Hordeum vulgare
cccttaaccasctcttcattg

SEQ ID NO: 19276 - DNA, 21 bp, Hordeum vulgare
ttccacctccwcgcccttaac

SEQ ID NO: 19277 - DNA, 21 bp, Hordeum vulgare
ccttgagcgcstcggcagctg

SEQ ID NO: 19278 - DNA, 21 bp, Hordeum vulgare
gtagggtctcytcttgggcag

SEQ ID NO: 19279 - DNA, 21 bp, Hordeum vulgare
tgacggggatsgcgggaggcc

SEQ ID NO: 19280 - DNA, 21 bp, Hordeum vulgare
gacactctgastctcaaccgc

SEQ ID NO: 19281 - DNA, 21 bp, Hordeum vulgare
tgccgctccgmgccatcatca

SEQ ID NO: 19282 - DNA, 21 bp, Hordeum vulgare
tcatcaggttygcgcaggagc

SEQ ID NO: 19283 - DNA, 21 bp, Hordeum vulgare
acctcacctcsgacatgcacg

SEQ ID NO: 19284 - DNA, 21 bp, Hordeum vulgare
gggcaggtcckccaggcacct

SEQ ID NO: 19285 - DNA, 21 bp, Hordeum vulgare
tgcacgcgaasgactgggact

SEQ ID NO: 19286 - DNA, 21 bp, Hordeum vulgare
agtcaaagggyttagaaacca

SEQ ID NO: 19287 - DNA, 21 bp, Hordeum vulgare
gacacacaaarataatggtac

SEQ ID NO: 19288 - DNA, 21 bp, Hordeum vulgare
cgtcgccggcyggcttgatgc

SEQ ID NO: 19289 - DNA, 21 bp, Hordeum vulgare
ggaggacgtgsagatcatccc

SEQ ID NO: 19290 - DNA, 21 bp, Hordeum vulgare
acttgctcagsgaggagtggt

SEQ ID NO: 19291 - DNA, 21 bp, Hordeum vulgare
tggcaataagmatcccgatgc

SEQ ID NO: 19292 - DNA, 21 bp, Hordeum vulgare
tagtgcatctyttgcaatggc

SEQ ID NO: 19293 - DNA, 21 bp, Hordeum vulgare
ttacatgatarggtcattacc

SEQ ID NO: 19294 - DNA, 21 bp, Hordeum vulgare
tagagtatcaratggaaatat

SEQ ID NO: 19295 - DNA, 21 bp, Hordeum vulgare
ttcatgagttyacaattattt

SEQ ID NO: 19296 - DNA, 21 bp, Hordeum vulgare
atagaatccaragtgtcaact

SEQ ID NO: 19297 - DNA, 21 bp, Hordeum vulgare
tggaaatattrtaaatgacga

SEQ ID NO: 19298 - DNA, 21 bp, Hordeum vulgare
tgacgaaataragtacacagc

SEQ ID NO: 19299 - DNA, 21 bp, Hordeum vulgare
cctggtcacckccaccctgcg

SEQ ID NO: 19300 - DNA, 21 bp, Hordeum vulgare
caacctacgcygtggctatca

SEQ ID NO: 19301 - DNA, 21 bp, Hordeum vulgare
taaagaagggraaaattaacg

SEQ ID NO: 19302 - DNA, 21 bp, Hordeum vulgare
cctggtcacckccaccctgcg

SEQ ID NO: 19303 - DNA, 21 bp, Hordeum vulgare
gacggccttamcttcttcacc

SEQ ID NO: 19304 - DNA, 21 bp, Hordeum vulgare
gaactagccayaggttgcact

SEQ ID NO: 19305 - DNA, 21 bp, Hordeum vulgare
cagatagtacytcgatcctct

SEQ ID NO: 19306 - DNA, 21 bp, Hordeum vulgare
gaataaggaaygttcttagaa

SEQ ID NO: 19307 - DNA, 21 bp, Hordeum vulgare
gtcttaataarctaatgatag

SEQ ID NO: 19308 - DNA, 21 bp, Hordeum vulgare
ttaaatctgascttatgaaga

SEQ ID NO: 19309 - DNA, 21 bp, Hordeum vulgare
tggaatgcagyttcatatgcg

SEQ ID NO: 19310 - DNA, 21 bp, Hordeum vulgare
attagcatcgktttagacaag

SEQ ID NO: 19311 - DNA, 21 bp, Hordeum vulgare
gaactagccayaggttgcact

SEQ ID NO: 19312 - DNA, 21 bp, Hordeum vulgare
tcaacactttkgtatagaagg

SEQ ID NO: 19313 - DNA, 21 bp, Hordeum vulgare
tctccaggtgkttctgcatga

SEQ ID NO: 19314 - DNA, 21 bp, Hordeum vulgare
ggtaagcgtcraacagagatg

SEQ ID NO: 19315 - DNA, 21 bp, Hordeum vulgare
ttaacataatyagaggattga

SEQ ID NO: 19316 - DNA, 21 bp, Hordeum vulgare
aaacaactagrtagtgaaaac

SEQ ID NO: 19317 - DNA, 21 bp, Hordeum vulgare
ttatcactgcmccagatcctt

SEQ ID NO: 19318 - DNA, 21 bp, Hordeum vulgare
ttgcgacgttkaagatattcg

SEQ ID NO: 19319 - DNA, 21 bp, Hordeum vulgare
gggctttgttytccactcagg

SEQ ID NO: 19320 - DNA, 21 bp, Hordeum vulgare
ccattttgacrtatgtttgtg

SEQ ID NO: 19321 - DNA, 21 bp, Hordeum vulgare
ccgtcatgacrgatatacagg

SEQ ID NO: 19322 - DNA, 21 bp, Hordeum vulgare
agaattgagcrgcgactctaa

SEQ ID NO: 19323 - DNA, 21 bp, Hordeum vulgare
ccatccccacygtttctttca

SEQ ID NO: 19324 - DNA, 21 bp, Hordeum vulgare
  MISC_FEATURE (11): n is SNP, in which the one is g and the other is a or t or c
cgtagtaggcntgcgtccggt

SEQ ID NO: 19325 - DNA, 21 bp, Hordeum vulgare
tagcgtgagtkatgaagttat

SEQ ID NO: 19326 - DNA, 21 bp, Hordeum vulgare
tgatagttcakatacaaaaca

SEQ ID NO: 19327 - DNA, 21 bp, Hordeum vulgare
cctgtgtgcarcccaaaaaca

SEQ ID NO: 19328 - DNA, 21 bp, Hordeum vulgare
ataaaatttgwactaacgtag

SEQ ID NO: 19329 - DNA, 21 bp, Hordeum vulgare
gctagagaagycaacaagtag

SEQ ID NO: 19330 - DNA, 21 bp, Hordeum vulgare
aacaccaagcytcgtgagaat

SEQ ID NO: 19331 - DNA, 21 bp, Hordeum vulgare
aatcccttgcycaaggcttga

SEQ ID NO: 19332 - DNA, 21 bp, Hordeum vulgare
atatgtagaargagcatgaca

SEQ ID NO: 19333 - DNA, 21 bp, Hordeum vulgare
gaaatccaaarccctagccca

SEQ ID NO: 19334 - DNA, 21 bp, Hordeum vulgare
ccttcctgctsgggtcttcat

SEQ ID NO: 19335 - DNA, 21 bp, Hordeum vulgare
ccatggagggmcgatcagcag

SEQ ID NO: 19336 - DNA, 21 bp, Hordeum vulgare
caaaccagcartgggaagcga

SEQ ID NO: 19337 - DNA, 21 bp, Hordeum vulgare
gttgacaaacrgtatagcgtg

SEQ ID NO: 19338 - DNA, 21 bp, Hordeum vulgare
aacacactgtrcgctgaatac

SEQ ID NO: 19339 - DNA, 21 bp, Hordeum vulgare
tccctataatsagtatgaaac

SEQ ID NO: 19340 - DNA, 21 bp, Hordeum vulgare
ctgatgatacyagagcagcca

SEQ ID NO: 19341 - DNA, 21 bp, Hordeum vulgare
ttgtagagctygcacaatctt

SEQ ID NO: 19342 - DNA, 21 bp, Hordeum vulgare
actccaagagygtccgccttc

SEQ ID NO: 19343 - DNA, 21 bp, Hordeum vulgare
atggaaaagarcaatgtcgac

SEQ ID NO: 19344 - DNA, 21 bp, Hordeum vulgare
ccatgtggctyaccatggaaa

SEQ ID NO: 19345 - DNA, 21 bp, Hordeum vulgare
tccggacggarggagtactac

SEQ ID NO: 19346 - DNA, 21 bp, Hordeum vulgare
cctagaaatgratgtatctag

SEQ ID NO: 19347 - DNA, 21 bp, Hordeum vulgare
cattttctatytgaaatcttg

SEQ ID NO: 19348 - DNA, 21 bp, Hordeum vulgare
aaacacacacmcgcaacccaa

SEQ ID NO: 19349 - DNA, 21 bp, Hordeum vulgare
acttcaggaayaccgagttct

SEQ ID NO: 19350 - DNA, 21 bp, Hordeum vulgare
gctgctgtggrccgaaggtcg

SEQ ID NO: 19351 - DNA, 21 bp, Hordeum vulgare
ggttgtaaacrtcatgtgtct

SEQ ID NO: 19352 - DNA, 21 bp, Hordeum vulgare
cctcgaggccrgacttgaggc

SEQ ID NO: 19353 - DNA, 21 bp, Hordeum vulgare
tgttggccacmcggatcatgt

SEQ ID NO: 19354 - DNA, 21 bp, Hordeum vulgare
ataaagttctkgaaacaatgg

SEQ ID NO: 19355 - DNA, 21 bp, Hordeum vulgare
gctcgtactcyggcgcggtgt

SEQ ID NO: 19356 - DNA, 21 bp, Hordeum vulgare
ttcctggccgscggcgccctc

SEQ ID NO: 19357 - DNA, 21 bp, Hordeum vulgare
tggcgatgccsctgccgcgct

SEQ ID NO: 19358 - DNA, 21 bp, Hordeum vulgare
tcggcccattyccgcagggcc

SEQ ID NO: 19359 - DNA, 21 bp, Hordeum vulgare
tcagcagtttycatccctcac

SEQ ID NO: 19360 - DNA, 21 bp, Hordeum vulgare
ggcaatctcarggacgagagg

SEQ ID NO: 19361 - DNA, 21 bp, Hordeum vulgare
agggtcgtccsggttagggtc

SEQ ID NO: 19362 - DNA, 21 bp, Hordeum vulgare
gcagcgagcasattgaaagca

SEQ ID NO: 19363 - DNA, 21 bp, Hordeum vulgare
catacttctgsgtccagctgc

SEQ ID NO: 19364 - DNA, 21 bp, Hordeum vulgare
tgcgggctgtygtctcgtact

SEQ ID NO: 19365 - DNA, 21 bp, Hordeum vulgare
gtttccacaaygcaaggctac

SEQ ID NO: 19366 - DNA, 21 bp, Hordeum vulgare
agcattgtcarttcttggacg

SEQ ID NO: 19367 - DNA, 21 bp, Hordeum vulgare
ccgtggaagcytgtcgggtcc

SEQ ID NO: 19368 - DNA, 21 bp, Hordeum vulgare
cctggaagccrtggaggttca

SEQ ID NO: 19369 - DNA, 21 bp, Hordeum vulgare
caggctgaagygtgtgcgagg

SEQ ID NO: 19370 - DNA, 21 bp, Hordeum vulgare
ggcccagagargaagatttca

SEQ ID NO: 19371 - DNA, 21 bp, Hordeum vulgare
gcttggccgcstctcccctgc

SEQ ID NO: 19372 - DNA, 21 bp, Hordeum vulgare
ctcttcagcargctctgcagc

SEQ ID NO: 19373 - DNA, 21 bp, Hordeum vulgare
cgtacagtagycatactgtga

SEQ ID NO: 19374 - DNA, 21 bp, Hordeum vulgare
ttttggacgascagatttgtg

SEQ ID NO: 19375 - DNA, 21 bp, Hordeum vulgare
atactccatcsgtcccgaatt

SEQ ID NO: 19376 - DNA, 21 bp, Hordeum vulgare
gattcatgacraaattccttc

SEQ ID NO: 19377 - DNA, 21 bp, Hordeum vulgare
aggactttggwatattattaa

SEQ ID NO: 19378 - DNA, 21 bp, Hordeum vulgare
caccatcagaygtgctgcctg

SEQ ID NO: 19379 - DNA, 21 bp, Hordeum vulgare
taatgtcagamatcatgagaa

SEQ ID NO: 19380 - DNA, 21 bp, Hordeum vulgare
ccacactgctmaagggactcc

SEQ ID NO: 19381 - DNA, 21 bp, Hordeum vulgare
aaaaatgttckcaaggatgtt

SEQ ID NO: 19382 - DNA, 21 bp, Hordeum vulgare
cagaaacaagwcattatggtc

SEQ ID NO: 19383 - DNA, 21 bp, Hordeum vulgare
atttgcaatarttagtatatc

SEQ ID NO: 19384 - DNA, 21 bp, Hordeum vulgare
acacgctactyatagtcgaca

SEQ ID NO: 19385 - DNA, 21 bp, Hordeum vulgare
aactcccacakgtataaatga

SEQ ID NO: 19386 - DNA, 21 bp, Hordeum vulgare
tgatggtcagyggataataat

SEQ ID NO: 19387 - DNA, 21 bp, Hordeum vulgare
tcatacacatrgtcgcacaaa

SEQ ID NO: 19388 - DNA, 21 bp, Hordeum vulgare
cgaggagggtraagaggatga

SEQ ID NO: 19389 - DNA, 21 bp, Hordeum vulgare
gttcattgatmgtgtaaaatt

SEQ ID NO: 19390 - DNA, 21 bp, Hordeum vulgare
caaggtgcggwggacatcagc

SEQ ID NO: 19391 - DNA, 21 bp, Hordeum vulgare
ctgtctgccgycggacatgaa

SEQ ID NO: 19392 - DNA, 21 bp, Hordeum vulgare
gaccatcagawatggagtgtt

SEQ ID NO: 19393 - DNA, 21 bp, Hordeum vulgare
tgttatcgtcsccctcgtatg

SEQ ID NO: 19394 - DNA, 21 bp, Hordeum vulgare
cctcgctctcraactgcacga

SEQ ID NO: 19395 - DNA, 21 bp, Hordeum vulgare
gatccctcgakcttgctcgca

SEQ ID NO: 19396 - DNA, 21 bp, Hordeum vulgare
cctaaccacasaaataaataa

SEQ ID NO: 19397 - DNA, 21 bp, Hordeum vulgare
tttttgacccygcactctcct

SEQ ID NO: 19398 - DNA, 21 bp, Hordeum vulgare
catcaaacatmcattccttct

SEQ ID NO: 19399 - DNA, 21 bp, Hordeum vulgare
acgcaaatgcyatcgccaatt

SEQ ID NO: 19400 - DNA, 21 bp, Hordeum vulgare
actgatgcacytgacccttaa

SEQ ID NO: 19401 - DNA, 21 bp, Hordeum vulgare
aatctctcgascagtgacctg

SEQ ID NO: 19402 - DNA, 21 bp, Hordeum vulgare
gccttggatgrgatttatctc

SEQ ID NO: 19403 - DNA, 21 bp, Hordeum vulgare
aggaactcctycaggtaagct

SEQ ID NO: 19404 - DNA, 21 bp, Hordeum vulgare
ctatgaatcaygctcataaca

SEQ ID NO: 19405 - DNA, 21 bp, Hordeum vulgare
tcctaatagcrgcagcaacaa

SEQ ID NO: 19406 - DNA, 21 bp, Hordeum vulgare
tagatgaagakacatccattt

SEQ ID NO: 19407 - DNA, 21 bp, Hordeum vulgare
agaaggtgggrtgattatcag

SEQ ID NO: 19408 - DNA, 21 bp, Hordeum vulgare
caaatatttcaatgaaaatac

SEQ ID NO: 19409 - DNA, 20 bp, Hordeum vulgare
caaattttcgatgaaaatac

SEQ ID NO: 19410 - DNA, 21 bp, Hordeum vulgare
ggtcgagcgtsatgcgatgca

SEQ ID NO: 19411 - DNA, 21 bp, Hordeum vulgare
gccatgagaargagctcgagg

SEQ ID NO: 19412 - DNA, 21 bp, Hordeum vulgare
agtacttgtcytcactcgcct

SEQ ID NO: 19413 - DNA, 21 bp, Hordeum vulgare
atcatcaaatygtttactata

SEQ ID NO: 19414 - DNA, 21 bp, Hordeum vulgare
tgaagcacacratgtggcagt

SEQ ID NO: 19415 - DNA, 21 bp, Hordeum vulgare
tccgacttatrcagcggaaag

SEQ ID NO: 19416 - DNA, 21 bp, Hordeum vulgare
ctacaccgccwtttattctct

SEQ ID NO: 19417 - DNA, 21 bp, Hordeum vulgare
aatacctatcmacttgttgta

SEQ ID NO: 19418 - DNA, 21 bp, Hordeum vulgare
tgtataatgasacaatgcatg

SEQ ID NO: 19419 - DNA, 21 bp, Hordeum vulgare
tagacccaagygagccaaaag

SEQ ID NO: 19420 - DNA, 21 bp, Hordeum vulgare
gatcgtatatmaaataaaaca

SEQ ID NO: 19421 - DNA, 21 bp, Hordeum vulgare
ccagtgcagakgtctcaagga

SEQ ID NO: 19422 - DNA, 21 bp, Hordeum vulgare
ctttctcagaraatgcttggc

SEQ ID NO: 19423 - DNA, 21 bp, Hordeum vulgare
cgttaatagtsctttccttgc

SEQ ID NO: 19424 - DNA, 21 bp, Hordeum vulgare
ttggcggattsttgacgcggc

SEQ ID NO: 19425 - DNA, 21 bp, Hordeum vulgare
ctcctcccctytttacaccta

SEQ ID NO: 19426 - DNA, 21 bp, Hordeum vulgare
agcacttcacyttctcccgcg

SEQ ID NO: 19427 - DNA, 21 bp, Hordeum vulgare
tgcactaactrttcctgtgaa

SEQ ID NO: 19428 - DNA, 21 bp, Hordeum vulgare
gacaacatagyaaaatagtat

SEQ ID NO: 19429 - DNA, 21 bp, Hordeum vulgare
aacaaaaaagraaaatgaact

SEQ ID NO: 19430 - DNA, 21 bp, Hordeum vulgare
taaccaagtcrtctagaacaa

SEQ ID NO: 19431 - DNA, 21 bp, Hordeum vulgare
aggaggaggargaagaagaag

SEQ ID NO: 19432 - DNA, 21 bp, Hordeum vulgare
gatcatcaacrtactcaaact

SEQ ID NO: 19433 - DNA, 21 bp, Hordeum vulgare
ccataatcctscaagaattcc

SEQ ID NO: 19434 - DNA, 21 bp, Hordeum vulgare
cgtcccggcgycccagatcca

SEQ ID NO: 19435 - DNA, 21 bp, Hordeum vulgare
agaatggcacsggagactaga

SEQ ID NO: 19436 - DNA, 21 bp, Hordeum vulgare
atgtacatatrgttcgtgtat

SEQ ID NO: 19437 - DNA, 21 bp, Hordeum vulgare
ttttagccgtragaaaagaat

SEQ ID NO: 19438 - DNA, 21 bp, Hordeum vulgare
aatttcatgtyttctttcccg

SEQ ID NO: 19439 - DNA, 21 bp, Hordeum vulgare
ggaatttatgyggctgcgcta

SEQ ID NO: 19440 - DNA, 21 bp, Hordeum vulgare
catcctgcaarcagtgttgac

SEQ ID NO: 19441 - DNA, 21 bp, Hordeum vulgare
tggcgaagtgrcaactgatct

SEQ ID NO: 19442 - DNA, 21 bp, Hordeum vulgare
tgggtgctgaycaacgacaca

SEQ ID NO: 19443 - DNA, 21 bp, Hordeum vulgare
acgactgagaycttgtgtacc

SEQ ID NO: 19444 - DNA, 21 bp, Hordeum vulgare
atttgcagcayacagagagca

SEQ ID NO: 19445 - DNA, 21 bp, Hordeum vulgare
acagagttcasggccgatatc

SEQ ID NO: 19446 - DNA, 21 bp, Hordeum vulgare
tattagatgtkcggtttgatg

SEQ ID NO: 19447 - DNA, 21 bp, Hordeum vulgare
cgcggcagaawgggcacgact

SEQ ID NO: 19448 - DNA, 21 bp, Hordeum vulgare
tgtcggggackatgaggggca

SEQ ID NO: 19449 - DNA, 21 bp, Hordeum vulgare
tagtagaccarcaggaggttg

SEQ ID NO: 19450 - DNA, 21 bp, Hordeum vulgare
aaagccagagmaacaaataat

SEQ ID NO: 19451 - DNA, 21 bp, Hordeum vulgare
cgcttgctggyggcagcttgc

SEQ ID NO: 19452 - DNA, 21 bp, Hordeum vulgare
cattcatcagsgaatgcacag

SEQ ID NO: 19453 - DNA, 21 bp, Hordeum vulgare
tgtgtcaccckcaacctccag

SEQ ID NO: 19454 - DNA, 21 bp, Hordeum vulgare
taccttgaatkatccatcata

SEQ ID NO: 19455 - DNA, 21 bp, Hordeum vulgare
ccagctggacmcagtgcttag

SEQ ID NO: 19456 - DNA, 21 bp, Hordeum vulgare
acaaatagacmcatgatttag

SEQ ID NO: 19457 - DNA, 21 bp, Hordeum vulgare
tggtgctaaaraagtgtttgc

SEQ ID NO: 19458 - DNA, 20 bp, Hordeum vulgare
tcttggtcgccccggggcga

SEQ ID NO: 19459 - DNA, 21 bp, Hordeum vulgare
tcttggtcgcgcccggggcga

SEQ ID NO: 19460 - DNA, 21 bp, Hordeum vulgare
aatgagtggtrcacggtcgtg

SEQ ID NO: 19461 - DNA, 21 bp, Hordeum vulgare
ataacttttakctgctttcag

SEQ ID NO: 19462 - DNA, 21 bp, Hordeum vulgare
tctcatatctstagtctcgag

SEQ ID NO: 19463 - DNA, 21 bp, Hordeum vulgare
aacacctgaarccacttttct

SEQ ID NO: 19464 - DNA, 21 bp, Hordeum vulgare
aggtgctgatrgtgttttttg

SEQ ID NO: 19465 - DNA, 21 bp, Hordeum vulgare
ctcttttgctwgagcaattag

SEQ ID NO: 19466 - DNA, 21 bp, Hordeum vulgare
tctaacaacawatagatacgt

SEQ ID NO: 19467 - DNA, 21 bp, Hordeum vulgare
gatgaatttasataaatgaca

SEQ ID NO: 19468 - DNA, 21 bp, Hordeum vulgare
gcaattagctstgcttgcatc

SEQ ID NO: 19469 - DNA, 21 bp, Hordeum vulgare
tggcatagcawgtcagaggtc

SEQ ID NO: 19470 - DNA, 21 bp, Hordeum vulgare
ggcggatcatyggtatgcatc

SEQ ID NO: 19471 - DNA, 21 bp, Hordeum vulgare
tcagaggtcawccataacaca

SEQ ID NO: 19472 - DNA, 21 bp, Hordeum vulgare
gcagctcattkagctccgtct

SEQ ID NO: 19473 - DNA, 21 bp, Hordeum vulgare
tggtcttcttycgcagctcat

SEQ ID NO: 19474 - DNA, 21 bp, Hordeum vulgare
gcctggcgacrcagacatgtc

SEQ ID NO: 19475 - DNA, 21 bp, Hordeum vulgare
tcatgttaaaytcacggttca

SEQ ID NO: 19476 - DNA, 21 bp, Hordeum vulgare
gttcaggaaawagcacaaagt

SEQ ID NO: 19477 - DNA, 21 bp, Hordeum vulgare
atacaccaatktgaacctact

SEQ ID NO: 19478 - DNA, 21 bp, Hordeum vulgare
ggtggaaacarttcacggtta

SEQ ID NO: 19479 - DNA, 21 bp, Hordeum vulgare
gctgattttaycatacatgat

SEQ ID NO: 19480 - DNA, 21 bp, Hordeum vulgare
tacatgatatstgtgaagtac

SEQ ID NO: 19481 - DNA, 21 bp, Hordeum vulgare
ccatctgatcwgcagcacccg

SEQ ID NO: 19482 - DNA, 21 bp, Hordeum vulgare
tgcagactggrcagctaaact

SEQ ID NO: 19483 - DNA, 21 bp, Hordeum vulgare
tgtggccacakatggttgatg

SEQ ID NO: 19484 - DNA, 21 bp, Hordeum vulgare
cttcagtactkaagttaaaca

SEQ ID NO: 19485 - DNA, 21 bp, Hordeum vulgare
gcatgctggamtactactact

SEQ ID NO: 19486 - DNA, 21 bp, Hordeum vulgare
agtctgttttyattcaggtag

SEQ ID NO: 19487 - DNA, 21 bp, Hordeum vulgare
cggaaattacytcctggatac

SEQ ID NO: 19488 - DNA, 21 bp, Hordeum vulgare
agacccccatyggggccgcca

SEQ ID NO: 19489 - DNA, 21 bp, Hordeum vulgare
gcgacgccgasgcggagtagc

SEQ ID NO: 19490 - DNA, 21 bp, Hordeum vulgare
gggtgaactcraaaatgctaa

SEQ ID NO: 19491 - DNA, 21 bp, Hordeum vulgare
tcaccagactygcaagcctgt

SEQ ID NO: 19492 - DNA, 21 bp, Hordeum vulgare
gaggggtcgcsacatggacat

SEQ ID NO: 19493 - DNA, 21 bp, Hordeum vulgare
atgaggggtcrcaacgtggac

SEQ ID NO: 19494 - DNA, 21 bp, Hordeum vulgare
ccaggccatascgggtgctgt

SEQ ID NO: 19495 - DNA, 21 bp, Hordeum vulgare
tatgcaagttwttggctgaaa

SEQ ID NO: 19496 - DNA, 21 bp, Hordeum vulgare
gctgctaccaratcagctact

SEQ ID NO: 19497 - DNA, 21 bp, Hordeum vulgare
tggtacttaamgcccctgagg

SEQ ID NO: 19498 - DNA, 21 bp, Hordeum vulgare
gcttttactgyccttcaggcc

SEQ ID NO: 19499 - DNA, 21 bp, Hordeum vulgare
cagagaagtgraaaaaaaaag

SEQ ID NO: 19500 - DNA, 21 bp, Hordeum vulgare
actacaaagcwtatggtactt

SEQ ID NO: 19501 - DNA, 21 bp, Hordeum vulgare
gcaggtgacaraactgrcagt

SEQ ID NO: 19502 - DNA, 21 bp, Hordeum vulgare
gacaraactgrcagtaacaac

SEQ ID NO: 19503 - DNA, 21 bp, Hordeum vulgare
tgttgaagtcycgggtgttgt

SEQ ID NO: 19504 - DNA, 21 bp, Hordeum vulgare
atgcagtgctmaattccaagc

SEQ ID NO: 19505 - DNA, 21 bp, Hordeum vulgare
agatgcaggtmaacttcatgc

SEQ ID NO: 19506 - DNA, 21 bp, Hordeum vulgare
agtacaagacrgaaaacggaa

SEQ ID NO: 19507 - DNA, 21 bp, Hordeum vulgare
tttcatctatrttaccttcca

SEQ ID NO: 19508 - DNA, 21 bp, Hordeum vulgare
agcttcgagcwaagaacacat

SEQ ID NO: 19509 - DNA, 21 bp, Hordeum vulgare
tgagcttgtckcgcttggacc

SEQ ID NO: 19510 - DNA, 21 bp, Hordeum vulgare
ctgcgtctatrgccccgatgt

SEQ ID NO: 19511 - DNA, 21 bp, Hordeum vulgare
gggcatcctcragccttgccc

SEQ ID NO: 19512 - DNA, 21 bp, Hordeum vulgare
ttgccctggartcctcaagct

SEQ ID NO: 19513 - DNA, 21 bp, Hordeum vulgare
aggaagggctytcgactcgga

SEQ ID NO: 19514 - DNA, 21 bp, Hordeum vulgare
gcttcgacaamgacacaacat

SEQ ID NO: 19515 - DNA, 21 bp, Hordeum vulgare
acttgccattytcttggacat

SEQ ID NO: 19516 - DNA, 21 bp, Hordeum vulgare
tggtaaaacawctgagacaca

SEQ ID NO: 19517 - DNA, 21 bp, Hordeum vulgare
ggtcgttagcyatgcaggaac

SEQ ID NO: 19518 - DNA, 21 bp, Hordeum vulgare
tcgaccaagtyaccttcactg

SEQ ID NO: 19519 - DNA, 21 bp, Hordeum vulgare
cgtaccgtgcytgataccccg

SEQ ID NO: 19520 - DNA, 21 bp, Hordeum vulgare
tgtggatggakaataacacga

SEQ ID NO: 19521 - DNA, 21 bp, Hordeum vulgare
tgccatcctgyattgttgagc

SEQ ID NO: 19522 - DNA, 21 bp, Hordeum vulgare
tgttgaattaytgaccttatt

SEQ ID NO: 19523 - DNA, 21 bp, Hordeum vulgare
aacacgaggawtttttgttgt

SEQ ID NO: 19524 - DNA, 21 bp, Hordeum vulgare
ttggtatggaygtcaggatgc

SEQ ID NO: 19525 - DNA, 21 bp, Hordeum vulgare
atgggatggcrtcggcgaagg

SEQ ID NO: 19526 - DNA, 21 bp, Hordeum vulgare
aggcgtccccrgcctgcgcgg

SEQ ID NO: 19527 - DNA, 21 bp, Hordeum vulgare
cggcggcggcrctgtttgttg

SEQ ID NO: 19528 - DNA, 21 bp, Hordeum vulgare
gtgcatcccartcggtagtgt

SEQ ID NO: 19529 - DNA, 21 bp, Hordeum vulgare
cttccctttgktttagcaata

SEQ ID NO: 19530 - DNA, 21 bp, Hordeum vulgare
tttattacagygactttccaa

SEQ ID NO: 19531 - DNA, 21 bp, Hordeum vulgare
tgttgcagcastcgacggcat

SEQ ID NO: 19532 - DNA, 21 bp, Hordeum vulgare
tacataacttmtttacatggg

SEQ ID NO: 19533 - DNA, 21 bp, Hordeum vulgare
tttcagtgtcsaactaagggc

SEQ ID NO: 19534 - DNA, 21 bp, Hordeum vulgare
tacccagtgamgctataacaa

SEQ ID NO: 19535 - DNA, 21 bp, Hordeum vulgare
agtttcttggmctggcaggga

SEQ ID NO: 19536 - DNA, 21 bp, Hordeum vulgare
aaatagtaagytcatgtccag

SEQ ID NO: 19537 - DNA, 21 bp, Hordeum vulgare
  MISC_FEATURE (11): n is SNP, in which the one is g and the other is a or t or c
gtgcaattggntacaaatgcc

SEQ ID NO: 19538 - DNA, 21 bp, Hordeum vulgare
ttgcctcaatygacgggaaca

SEQ ID NO: 19539 - DNA, 21 bp, Hordeum vulgare
gcgagccgcgrgtatgccttg

SEQ ID NO: 19540 - DNA, 21 bp, Hordeum vulgare
aaacaaccttygataaagtat

SEQ ID NO: 19541 - DNA, 21 bp, Hordeum vulgare
gcaggaaccasgtgatgaacg

SEQ ID NO: 19542 - DNA, 21 bp, Hordeum vulgare
gtgacactacratcatcgaca

SEQ ID NO: 19543 - DNA, 21 bp, Hordeum vulgare
gtcatcagcgsccccccgcaa

SEQ ID NO: 19544 - DNA, 21 bp, Hordeum vulgare
gcaggcatgtkttacggcact

SEQ ID NO: 19545 - DNA, 21 bp, Hordeum vulgare
cgctgctgcgsccagagcatc

SEQ ID NO: 19546 - DNA, 21 bp, Hordeum vulgare
gcatcctgagmgaggcaggcc

SEQ ID NO: 19547 - DNA, 21 bp, Hordeum vulgare
gattgttgatstatgcagcaa

SEQ ID NO: 19548 - DNA, 21 bp, Hordeum vulgare
agctggatgcwtatgtgcacc

SEQ ID NO: 19549 - DNA, 21 bp, Hordeum vulgare
taataattcaragcaaatcaa

SEQ ID NO: 19550 - DNA, 21 bp, Hordeum vulgare
ccattccggcracacaagcat

SEQ ID NO: 19551 - DNA, 21 bp, Hordeum vulgare
tactcaacaargtcgatggcc

SEQ ID NO: 19552 - DNA, 21 bp, Hordeum vulgare
gaaccttgtcmcttcagccag

SEQ ID NO: 19553 - DNA, 21 bp, Hordeum vulgare
cctttctcgasgtccggcagc

SEQ ID NO: 19554 - DNA, 21 bp, Hordeum vulgare
tgaacagcccraagttcttct

SEQ ID NO: 19555 - DNA, 21 bp, Hordeum vulgare
ttattcgaccrcgaaatatcc

SEQ ID NO: 19556 - DNA, 21 bp, Hordeum vulgare
gcgtgccattsccgacgtggt

SEQ ID NO: 19557 - DNA, 21 bp, Hordeum vulgare
gtgtgctcgarggctgtatct

SEQ ID NO: 19558 - DNA, 21 bp, Hordeum vulgare
gaaaagagcartctatcaagg

SEQ ID NO: 19559 - DNA, 21 bp, Hordeum vulgare
tggacagaccrttatcgcttc

SEQ ID NO: 19560 - DNA, 20 bp, Hordeum vulgare
cagtagaggcatcacttatg

SEQ ID NO: 19561 - DNA, 21 bp, Hordeum vulgare
cagtagaggccatcacttatg

SEQ ID NO: 19562 - DNA, 21 bp, Hordeum vulgare
ctagatttgcraatatagcgc

SEQ ID NO: 19563 - DNA, 21 bp, Hordeum vulgare
taaaggatagytgcagctgca

SEQ ID NO: 19564 - DNA, 21 bp, Hordeum vulgare
tacaagcataycttttgttta

SEQ ID NO: 19565 - DNA, 21 bp, Hordeum vulgare
gacccacaaayttgacagaca

SEQ ID NO: 19566 - DNA, 21 bp, Hordeum vulgare
tgtagtggtascatcacaact

SEQ ID NO: 19567 - DNA, 21 bp, Hordeum vulgare
atgcttcatcrcacggtaatg

SEQ ID NO: 19568 - DNA, 21 bp, Hordeum vulgare
acagtgccggmcagactgttc

SEQ ID NO: 19569 - DNA, 21 bp, Hordeum vulgare
tgtctctcacygggagctccc

SEQ ID NO: 19570 - DNA, 21 bp, Hordeum vulgare
ttgctacgtaygtacgcgtat

SEQ ID NO: 19571 - DNA, 21 bp, Hordeum vulgare
gagtttgctcrtagggacgta

SEQ ID NO: 19572 - DNA, 21 bp, Hordeum vulgare
tcataagccaraaccagttgt

SEQ ID NO: 19573 - DNA, 21 bp, Hordeum vulgare
tttgcatcgcrtcacatgaaa

SEQ ID NO: 19574 - DNA, 21 bp, Hordeum vulgare
caaaggccaayaatgaaatga

SEQ ID NO: 19575 - DNA, 21 bp, Hordeum vulgare
acatgtggacyccagatataa

SEQ ID NO: 19576 - DNA, 21 bp, Hordeum vulgare
gatcactggakgaccaacctc

SEQ ID NO: 19577 - DNA, 21 bp, Hordeum vulgare
gcgcgcgactwataacttgtt

SEQ ID NO: 19578 - DNA, 21 bp, Hordeum vulgare
tgatacattaygcaaagaaat

SEQ ID NO: 19579 - DNA, 21 bp, Hordeum vulgare
tatgatatacrtgtgcgagag

SEQ ID NO: 19580 - DNA, 21 bp, Hordeum vulgare
ctggctcctcrgtgatggtaa

SEQ ID NO: 19581 - DNA, 21 bp, Hordeum vulgare
tacatccaccscaggaccaaa

SEQ ID NO: 19582 - DNA, 21 bp, Hordeum vulgare
catcaggttgraatatgccgg

SEQ ID NO: 19583 - DNA, 21 bp, Hordeum vulgare
ttgacatggtyggtcgatcgt

SEQ ID NO: 19584 - DNA, 21 bp, Hordeum vulgare
ttgaactaatrcagaaatata

SEQ ID NO: 19585 - DNA, 21 bp, Hordeum vulgare
tgccgtggccrtgcacgatga

SEQ ID NO: 19586 - DNA, 21 bp, Hordeum vulgare
gcatgccgggrccttaacacc

SEQ ID NO: 19587 - DNA, 21 bp, Hordeum vulgare
acagcagagtsgcaattacat

SEQ ID NO: 19588 - DNA, 21 bp, Hordeum vulgare
aagatagcccyttgaaaaaag

SEQ ID NO: 19589 - DNA, 21 bp, Hordeum vulgare
cgtctagcttygtcagaatga

SEQ ID NO: 19590 - DNA, 21 bp, Hordeum vulgare
ccccttcgcckacaccaacaa

SEQ ID NO: 19591 - DNA, 21 bp, Hordeum vulgare
atgtgcaattscggtgcatcg

SEQ ID NO: 19592 - DNA, 21 bp, Hordeum vulgare
tgwacagactsagctgagaga

SEQ ID NO: 19593 - DNA, 21 bp, Hordeum vulgare
ttgtccgactrcataaggaaa

SEQ ID NO: 19594 - DNA, 21 bp, Hordeum vulgare
ctccctcgcamccgctcatcc

SEQ ID NO: 19595 - DNA, 21 bp, Hordeum vulgare
acagaacattwtcctccctcg

SEQ ID NO: 19596 - DNA, 21 bp, Hordeum vulgare
tgattaagatycatctaaatt

SEQ ID NO: 19597 - DNA, 21 bp, Hordeum vulgare
aattctgctgygttccagtta

SEQ ID NO: 19598 - DNA, 21 bp, Hordeum vulgare
ctactgatatrattaaactaa

SEQ ID NO: 19599 - DNA, 21 bp, Hordeum vulgare
tgaggccacakggttattatt

SEQ ID NO: 19600 - DNA, 21 bp, Hordeum vulgare
accagaacagrgcttagttta

SEQ ID NO: 19601 - DNA, 21 bp, Hordeum vulgare
tctaggctagcatacaacaat

SEQ ID NO: 19602 - DNA, 20 bp, Hordeum vulgare
cttattctagatacaacaat

SEQ ID NO: 19603 - DNA, 21 bp, Hordeum vulgare
aacaattggctacaaataacg

SEQ ID NO: 19604 - DNA, 20 bp, Hordeum vulgare
aacaattggcacaaataaca

SEQ ID NO: 19605 - DNA, 21 bp, Hordeum vulgare
agaactagccrtgcaagttty

SEQ ID NO: 19606 - DNA, 21 bp, Hordeum vulgare
ttgtcaaaacyaaaaacasat

SEQ ID NO: 19607 - DNA, 21 bp, Hordeum vulgare
acyaaaaacasatgatgaatg

SEQ ID NO: 19608 - DNA, 21 bp, Hordeum vulgare
cgcatcatgamaaktttgcta

SEQ ID NO: 19609 - DNA, 21 bp, Hordeum vulgare
atcatgamaaktttgctaaga

SEQ ID NO: 19610 - DNA, 21 bp, Hordeum vulgare
tgatagctgartwactgtcag

SEQ ID NO: 19611 - DNA, 21 bp, Hordeum vulgare
tatsttattcwaacctcataa

SEQ ID NO: 19612 - DNA, 21 bp, Hordeum vulgare
ctgcagatatsttattcwaac

SEQ ID NO: 19613 - DNA, 21 bp, Hordeum vulgare
taaatcrgtgraatgggaata

SEQ ID NO: 19614 - DNA, 21 bp, Hordeum vulgare
atttggccagrcgaacaaccg

SEQ ID NO: 19615 - DNA, 21 bp, Hordeum vulgare
cgcccctctcractgcatccc

SEQ ID NO: 19616 - DNA, 21 bp, Hordeum vulgare
tcatgtgtttkcctatgatcc

SEQ ID NO: 19617 - DNA, 21 bp, Hordeum vulgare
attactcagcyacacacctat

SEQ ID NO: 19618 - DNA, 21 bp, Hordeum vulgare
tcccaccaggyatcgctccct

SEQ ID NO: 19619 - DNA, 21 bp, Hordeum vulgare
ttcccaacttmtaatttgcat

SEQ ID NO: 19620 - DNA, 21 bp, Hordeum vulgare
ctgcaatgtckttgcaccacc

SEQ ID NO: 19621 - DNA, 21 bp, Hordeum vulgare
aggtctatgtwatctttgttt

SEQ ID NO: 19622 - DNA, 21 bp, Hordeum vulgare
  MISC_FEATURE (12): n stands for any base
tcaactccgcrnacgacactt

SEQ ID NO: 19623 - DNA, 21 bp, Hordeum vulgare
tcgattcctcscgcatctata

SEQ ID NO: 19624 - DNA, 21 bp, Hordeum vulgare
ctccatttttyttaatcaact

SEQ ID NO: 19625 - DNA, 21 bp, Hordeum vulgare
tctaccacaayccagaatatc

SEQ ID NO: 19626 - DNA, 21 bp, Hordeum vulgare
gaagataacamcatcttagaa

SEQ ID NO: 19627 - DNA, 21 bp, Hordeum vulgare
ttagaaaacgmtgtgacgtca

SEQ ID NO: 19628 - DNA, 21 bp, Hordeum vulgare
gtgacgtcatytagggtcagt

SEQ ID NO: 19629 - DNA, 21 bp, Hordeum vulgare
tgcatcaagamtcatccaatt

SEQ ID NO: 19630 - DNA, 21 bp, Hordeum vulgare
ggctctgtgaytctgcatcaa

SEQ ID NO: 19631 - DNA, 21 bp, Hordeum vulgare
tccggggcgaygttggccgcg

SEQ ID NO: 19632 - DNA, 21 bp, Hordeum vulgare
gggggcatccwggggctccgg

SEQ ID NO: 19633 - DNA, 21 bp, Hordeum vulgare
tcttcccctcygggtacttca

SEQ ID NO: 19634 - DNA, 21 bp, Hordeum vulgare
ctcaaaagttygaaggattga

SEQ ID NO: 19635 - DNA, 21 bp, Hordeum vulgare
aaccggttttscgaggcttca

SEQ ID NO: 19636 - DNA, 21 bp, Hordeum vulgare
cgtcctccgayggcaggaagt

SEQ ID NO: 19637 - DNA, 21 bp, Hordeum vulgare
tggcctcgtakgcgtcctccg

SEQ ID NO: 19638 - DNA, 21 bp, Hordeum vulgare
ggtagataackctcttgacac

SEQ ID NO: 19639 - DNA, 21 bp, Hordeum vulgare
agcatgctgakttttgtttac

SEQ ID NO: 19640 - DNA, 21 bp, Hordeum vulgare
ctccctctatwaactaatata

SEQ ID NO: 19641 - DNA, 21 bp, Hordeum vulgare
gcagctaaacwggctaggcat

SEQ ID NO: 19642 - DNA, 21 bp, Hordeum vulgare
tatgcttgcasaccctctgca

SEQ ID NO: 19643 - DNA, 21 bp, Hordeum vulgare
tgtaaataaaytttgtaataa

SEQ ID NO: 19644 - DNA, 21 bp, Hordeum vulgare
cactacaaaaytatgatgcta

SEQ ID NO: 19645 - DNA, 21 bp, Hordeum vulgare
aaatccccackaaaaacttat

SEQ ID NO: 19646 - DNA, 21 bp, Hordeum vulgare
tctcgccgacrtagtactcgt

SEQ ID NO: 19647 - DNA, 21 bp, Hordeum vulgare
aacttattcakctcttgaacc

SEQ ID NO: 19648 - DNA, 21 bp, Hordeum vulgare
ccgttctccgscgccatctcc

SEQ ID NO: 19649 - DNA, 21 bp, Hordeum vulgare
ctaacaatctyaaacccaaaa

SEQ ID NO: 19650 - DNA, 21 bp, Hordeum vulgare
ggtttgctccyactgctactt

SEQ ID NO: 19651 - DNA, 21 bp, Hordeum vulgare
ggatggtcagyatttctgtgc

SEQ ID NO: 19652 - DNA, 21 bp, Hordeum vulgare
tcatgtcattmcactgatgac

SEQ ID NO: 19653 - DNA, 21 bp, Hordeum vulgare
tgcaatagctraaattgtgac

SEQ ID NO: 19654 - DNA, 21 bp, Hordeum vulgare
atgggttggtygggatgctcg

SEQ ID NO: 19655 - DNA, 21 bp, Hordeum vulgare
tttatgtgcckgtagcggttg

SEQ ID NO: 19656 - DNA, 21 bp, Hordeum vulgare
ctctgcaccgscggcctggcc

SEQ ID NO: 19657 - DNA, 21 bp, Hordeum vulgare
gcatataatcracactcaaca

SEQ ID NO: 19658 - DNA, 21 bp, Hordeum vulgare
gagtagtttcratgcgagagt

SEQ ID NO: 19659 - DNA, 21 bp, Hordeum vulgare
gctattttgcygttctcaaca

SEQ ID NO: 19660 - DNA, 21 bp, Hordeum vulgare
tcaacagagtrtaaacgataa

SEQ ID NO: 19661 - DNA, 21 bp, Hordeum vulgare
aaacccatctycatacatcag

SEQ ID NO: 19662 - DNA, 21 bp, Hordeum vulgare
tgtagttgackaagcaaagat

SEQ ID NO: 19663 - DNA, 21 bp, Hordeum vulgare
aaggcggcggracgatcatgg

SEQ ID NO: 19664 - DNA, 21 bp, Hordeum vulgare
ctcggacagcrtccacggctt

SEQ ID NO: 19665 - DNA, 21 bp, Hordeum vulgare
cttcaaggggytcgacgccgt

SEQ ID NO: 19666 - DNA, 21 bp, Hordeum vulgare
taccaagcgcrtgtctagtga

SEQ ID NO: 19667 - DNA, 21 bp, Hordeum vulgare
tggagtggatmgacaccatcc

SEQ ID NO: 19668 - DNA, 21 bp, Hordeum vulgare
gagaacacagscatagaacac

SEQ ID NO: 19669 - DNA, 21 bp, Hordeum vulgare
ccctctccatmaggtccttga

SEQ ID NO: 19670 - DNA, 21 bp, Hordeum vulgare
acaccatcctratgagccccc

SEQ ID NO: 19671 - DNA, 21 bp, Hordeum vulgare
tcaattttgcraaacccgcct

SEQ ID NO: 19672 - DNA, 21 bp, Hordeum vulgare
aggaggaggaytgaagaggag

SEQ ID NO: 19673 - DNA, 21 bp, Hordeum vulgare
ccctttccctytccctctccc

SEQ ID NO: 19674 - DNA, 21 bp, Hordeum vulgare
agaatccgacratggatgctg

SEQ ID NO: 19675 - DNA, 21 bp, Hordeum vulgare
taaatctcgargccagtatga

SEQ ID NO: 19676 - DNA, 21 bp, Hordeum vulgare
ggagatatgckgagatcctgc

SEQ ID NO: 19677 - DNA, 21 bp, Hordeum vulgare
accaacactcrccaccataag

SEQ ID NO: 19678 - DNA, 21 bp, Hordeum vulgare
aacaagacgckgccgtccttg

SEQ ID NO: 19679 - DNA, 21 bp, Hordeum vulgare
tcttcttcttstccttcttct

SEQ ID NO: 19680 - DNA, 21 bp, Hordeum vulgare
atctctcctcrcatacttgct

SEQ ID NO: 19681 - DNA, 21 bp, Hordeum vulgare
cattggccggyggcgggttca

SEQ ID NO: 19682 - DNA, 21 bp, Hordeum vulgare
cgcgcacgtcrgcaatcagcg

SEQ ID NO: 19683 - DNA, 21 bp, Hordeum vulgare
cttccgcctcyggggagacct

SEQ ID NO: 19684 - DNA, 21 bp, Hordeum vulgare
cggaagcagcacaaaaaaaaa

SEQ ID NO: 19685 - DNA, 20 bp, Hordeum vulgare
cggaagcagcgcaaaaaaaa

SEQ ID NO: 19686 - DNA, 21 bp, Hordeum vulgare
ttagtaagcartgatgaagag

SEQ ID NO: 19687 - DNA, 21 bp, Hordeum vulgare
ataactggacwcaattccttg

SEQ ID NO: 19688 - DNA, 21 bp, Hordeum vulgare
cgaacgacggyttcacgcgag

SEQ ID NO: 19689 - DNA, 21 bp, Hordeum vulgare
agaatttgccrgtctctccat

SEQ ID NO: 19690 - DNA, 21 bp, Hordeum vulgare
catcatcacamggcgcactca

SEQ ID NO: 19691 - DNA, 21 bp, Hordeum vulgare
tacagctaaartaaaatagtt

SEQ ID NO: 19692 - DNA, 21 bp, Hordeum vulgare
cgaaaaggatrgatcgataac

SEQ ID NO: 19693 - DNA, 21 bp, Hordeum vulgare
tctactcctastttgttttta

SEQ ID NO: 19694 - DNA, 21 bp, Hordeum vulgare
accttggcaaygatgtcctcc

SEQ ID NO: 19695 - DNA, 21 bp, Hordeum vulgare
gataacaatgycagttcagtt

SEQ ID NO: 19696 - DNA, 21 bp, Hordeum vulgare
gtgaattctgyccaaagatgc

SEQ ID NO: 19697 - DNA, 21 bp, Hordeum vulgare
cttaatgacastaagggttat

SEQ ID NO: 19698 - DNA, 21 bp, Hordeum vulgare
gaaaacctaamaattgcatgc

SEQ ID NO: 19699 - DNA, 21 bp, Hordeum vulgare
gctgccagccgatctgtgcga

SEQ ID NO: 19700 - DNA, 20 bp, Hordeum vulgare
gctgccagccaatctggcga

SEQ ID NO: 19701 - DNA, 21 bp, Hordeum vulgare
gtagatatccycttccccgcc

SEQ ID NO: 19702 - DNA, 21 bp, Hordeum vulgare
tgcagcagagscgacggctca

SEQ ID NO: 19703 - DNA, 21 bp, Hordeum vulgare
tctattgcatsgttgtgcaaa

SEQ ID NO: 19704 - DNA, 21 bp, Hordeum vulgare
agatcaaaacygctttattta

SEQ ID NO: 19705 - DNA, 21 bp, Hordeum vulgare
tacatgaagamacacagtgat

SEQ ID NO: 19706 - DNA, 21 bp, Hordeum vulgare
ctgcaaagacraaacagtctc

SEQ ID NO: 19707 - DNA, 21 bp, Hordeum vulgare
tatcaaaattktcttttgaga

SEQ ID NO: 19708 - DNA, 21 bp, Hordeum vulgare
cgatcatcagrctgtcaagaa

SEQ ID NO: 19709 - DNA, 21 bp, Hordeum vulgare
aggcttgctasaatccgccgg

SEQ ID NO: 19710 - DNA, 21 bp, Hordeum vulgare
aaagtaaaggygtcagcgagt

SEQ ID NO: 19711 - DNA, 21 bp, Hordeum vulgare
agaggatgacsacgagcttca

SEQ ID NO: 19712 - DNA, 21 bp, Hordeum vulgare
cttcaaggacyttgctgttcc

SEQ ID NO: 19713 - DNA, 21 bp, Hordeum vulgare
acctgcagatyagcctcgccg

SEQ ID NO: 19714 - DNA, 21 bp, Hordeum vulgare
agtcaaggcttgccgaggatt

SEQ ID NO: 19715 - DNA, 20 bp, Hordeum vulgare
agtcaaggctgccgaggatt

SEQ ID NO: 19716 - DNA, 21 bp, Hordeum vulgare
ttaaaatatarattcattgaa

SEQ ID NO: 19717 - DNA, 21 bp, Hordeum vulgare
gatcaacggaygatatcgaga

SEQ ID NO: 19718 - DNA, 21 bp, Hordeum vulgare
tatacctcatrcgcttctctg

SEQ ID NO: 19719 - DNA, 21 bp, Hordeum vulgare
  MISC_FEATURE (11): n is SNP, in which the one is a and the other is t or g or c
ttaaggtgaanggcaatagat

SEQ ID NO: 19720 - DNA, 21 bp, Hordeum vulgare
ttgtacctggytcgtgagcaa

SEQ ID NO: 19721 - DNA, 21 bp, Hordeum vulgare
gctccgggtcrtggttcatgc

SEQ ID NO: 19722 - DNA, 21 bp, Hordeum vulgare
cgtggcgaacrccctttattc

SEQ ID NO: 19723 - DNA, 21 bp, Hordeum vulgare
gaatcttgacrtagggcaaca

SEQ ID NO: 19724 - DNA, 21 bp, Hordeum vulgare
gccaccatgcrtgtccctgcg

SEQ ID NO: 19725 - DNA, 21 bp, Hordeum vulgare
atatacacacmctgatgcaaa

SEQ ID NO: 19726 - DNA, 21 bp, Hordeum vulgare
gcacaaaaaaygtggatggaa

SEQ ID NO: 19727 - DNA, 21 bp, Hordeum vulgare
ctcccagcctstgcccccggc

SEQ ID NO: 19728 - DNA, 21 bp, Hordeum vulgare
cccttcttggscttcttgcta

SEQ ID NO: 19729 - DNA, 21 bp, Hordeum vulgare
tgccgaacccragctcgtcgg

SEQ ID NO: 19730 - DNA, 21 bp, Hordeum vulgare
cccccctcggscttgcccttc

SEQ ID NO: 19731 - DNA, 21 bp, Hordeum vulgare
gtcgatctcgwtgctctcctt

SEQ ID NO: 19732 - DNA, 21 bp, Hordeum vulgare
tgtcggacttrgtggcctcga

SEQ ID NO: 19733 - DNA, 21 bp, Hordeum vulgare
cccccggcctscttcttgctc

SEQ ID NO: 19734 - DNA, 21 bp, Hordeum vulgare
gggcttagttycggccaggtt

SEQ ID NO: 19735 - DNA, 21 bp, Hordeum vulgare
ygaccgtgccrtctttcgagc

SEQ ID NO: 19736 - DNA, 21 bp, Hordeum vulgare
gcttgggtgcygccagaagyg

SEQ ID NO: 19737 - DNA, 21 bp, Hordeum vulgare
agctgacccgmgcgcatcagt

SEQ ID NO: 19738 - DNA, 21 bp, Hordeum vulgare
cgcgcgtgagsccccccggct

SEQ ID NO: 19739 - DNA, 21 bp, Hordeum vulgare
gtgctgaattyatgtttcagc

SEQ ID NO: 19740 - DNA, 21 bp, Hordeum vulgare
cgacggggaawcatttgaagg

SEQ ID NO: 19741 - DNA, 21 bp, Hordeum vulgare
cttcctttggwttggttcaag

SEQ ID NO: 19742 - DNA, 21 bp, Hordeum vulgare
acaagagtcaraactgcatcc

SEQ ID NO: 19743 - DNA, 21 bp, Hordeum vulgare
gggcacgagaygtccttttgg

SEQ ID NO: 19744 - DNA, 21 bp, Hordeum vulgare
tgcactgctgytgcacctgcc

SEQ ID NO: 19745 - DNA, 21 bp, Hordeum vulgare
cagcctcgcawagtgctcggc

SEQ ID NO: 19746 - DNA, 21 bp, Hordeum vulgare
gaatcgcttcsacaaaaagtt

SEQ ID NO: 19747 - DNA, 21 bp, Hordeum vulgare
tgtatagcttyatgaggatag

SEQ ID NO: 19748 - DNA, 21 bp, Hordeum vulgare
ttttgagtggytggcatagtt

SEQ ID NO: 19749 - DNA, 21 bp, Hordeum vulgare
caggaaatagkttttgagggg

SEQ ID NO: 19750 - DNA, 21 bp, Hordeum vulgare
ggctggatttyacctctctaa

SEQ ID NO: 19751 - DNA, 21 bp, Hordeum vulgare
gcacccacctkggcaggtcga

SEQ ID NO: 19752 - DNA, 21 bp, Hordeum vulgare
atcagtggatsttatccctga

SEQ ID NO: 19753 - DNA, 21 bp, Hordeum vulgare
ccttgtttaaktatcttttag

SEQ ID NO: 19754 - DNA, 21 bp, Hordeum vulgare
cttttagggaktgacaatttg

SEQ ID NO: 19755 - DNA, 21 bp, Hordeum vulgare
aaaaaattagytcagtattgc

SEQ ID NO: 19756 - DNA, 21 bp, Hordeum vulgare
atgcacatagkgcatgtatta

SEQ ID NO: 19757 - DNA, 21 bp, Hordeum vulgare
cggcaagatcrgcatctattt

SEQ ID NO: 19758 - DNA, 21 bp, Hordeum vulgare
ctatttgcaasttacaaatca

SEQ ID NO: 19759 - DNA, 21 bp, Hordeum vulgare
cagatgtatakcagcagcaat

SEQ ID NO: 19760 - DNA, 21 bp, Hordeum vulgare
gtgcgtgtgcrtgcgccggag

SEQ ID NO: 19761 - DNA, 21 bp, Hordeum vulgare
ccaaaccgtaragtggtaacc

SEQ ID NO: 19762 - DNA, 21 bp, Hordeum vulgare
cattttgtagmttcttctata

SEQ ID NO: 19763 - DNA, 21 bp, Hordeum vulgare
agcacgatgcygtaatgttta

SEQ ID NO: 19764 - DNA, 21 bp, Hordeum vulgare
actcagccttygcaatccaca

SEQ ID NO: 19765 - DNA, 21 bp, Hordeum vulgare
tgtcaatcttcatcctcaccg

SEQ ID NO: 19766 - DNA, 20 bp, Hordeum vulgare
actgataactgatcctacag

SEQ ID NO: 19767 - DNA, 21 bp, Hordeum vulgare
ctgctttcaartttcgctgct

SEQ ID NO: 19768 - DNA, 21 bp, Hordeum vulgare
caaatttataytcccagccaa

SEQ ID NO: 19769 - DNA, 21 bp, Hordeum vulgare
cgtgcttggcragctcgccgg

SEQ ID NO: 19770 - DNA, 21 bp, Hordeum vulgare
tcagtgaagcycatgaacttc

SEQ ID NO: 19771 - DNA, 21 bp, Hordeum vulgare
gaagtgcgggrcggcatcagc

SEQ ID NO: 19772 - DNA, 21 bp, Hordeum vulgare
ggccctttcarggggaagtgc

SEQ ID NO: 19773 - DNA, 21 bp, Hordeum vulgare
tgtggtcgtcrggcgccaggc

SEQ ID NO: 19774 - DNA, 21 bp, Hordeum vulgare
gagttacattkcaacacagct

SEQ ID NO: 19775 - DNA, 21 bp, Hordeum vulgare
tcgccgcctgrgacgacgctg

SEQ ID NO: 19776 - DNA, 21 bp, Hordeum vulgare
tggggcaccartcgacgaact

SEQ ID NO: 19777 - DNA, 21 bp, Hordeum vulgare
gcacacggccmtctggacctt

SEQ ID NO: 19778 - DNA, 21 bp, Hordeum vulgare
tgccctcgccsacgtaccagt

SEQ ID NO: 19779 - DNA, 21 bp, Hordeum vulgare
cgtcgccctcrtcaccgtcct

SEQ ID NO: 19780 - DNA, 21 bp, Hordeum vulgare
tgagacagcakgccatgtact

SEQ ID NO: 19781 - DNA, 21 bp, Hordeum vulgare
caagctgcttsggccaaccag

SEQ ID NO: 19782 - DNA, 21 bp, Hordeum vulgare
aaatttacaayacactacagg

SEQ ID NO: 19783 - DNA, 21 bp, Hordeum vulgare
gcagagaaaamcaataatgag

SEQ ID NO: 19784 - DNA, 21 bp, Hordeum vulgare
aacgagcagarttgcattcta

SEQ ID NO: 19785 - DNA, 21 bp, Hordeum vulgare
gttcagtcagwgtttctccca

SEQ ID NO: 19786 - DNA, 21 bp, Hordeum vulgare
tcagctcggcrgaagtcaggt

SEQ ID NO: 19787 - DNA, 21 bp, Hordeum vulgare
ttgttaccacygctgtctccg

SEQ ID NO: 19788 - DNA, 21 bp, Hordeum vulgare
gcgaggggcasacgccgcggc

SEQ ID NO: 19789 - DNA, 21 bp, Hordeum vulgare
aaagaatgaaycagtttttcc

SEQ ID NO: 19790 - DNA, 21 bp, Hordeum vulgare
cttcttctttsggataagaaa

SEQ ID NO: 19791 - DNA, 21 bp, Hordeum vulgare
  MISC_FEATURE (11): n is SNP, in which the one is c and the other is a or t or g
gtgtgcctttnagtgtgtagt

SEQ ID NO: 19792 - DNA, 20 bp, Hordeum vulgare
tatattttagccttcatcat

SEQ ID NO: 19793 - DNA, 21 bp, Hordeum vulgare
tatattttaggccttcatcat

SEQ ID NO: 19794 - DNA, 21 bp, Hordeum vulgare
cttcgttgccrgccggccagc

SEQ ID NO: 19795 - DNA, 21 bp, Hordeum vulgare
ttttaggaccrcaacatctcg

SEQ ID NO: 19796 - DNA, 21 bp, Hordeum vulgare
gtgacgctgamgattcgctct

SEQ ID NO: 19797 - DNA, 21 bp, Hordeum vulgare
tgtttctcggrgcacaccttg

SEQ ID NO: 19798 - DNA, 21 bp, Hordeum vulgare
ccatctgttgytccctccatt

SEQ ID NO: 19799 - DNA, 21 bp, Hordeum vulgare
aaaatgaaaawttgaaagctc

SEQ ID NO: 19800 - DNA, 21 bp, Hordeum vulgare
cggcctggtcwtggattcggg

SEQ ID NO: 19801 - DNA, 21 bp, Hordeum vulgare
gaaagctctcrctggaattgt

SEQ ID NO: 19802 - DNA, 21 bp, Hordeum vulgare
gtagcccaackcatgctacta

SEQ ID NO: 19803 - DNA, 21 bp, Hordeum vulgare
tgccccttatratcttgaagt

SEQ ID NO: 19804 - DNA, 21 bp, Hordeum vulgare
gatattccatygaagtgaaga

SEQ ID NO: 19805 - DNA, 21 bp, Hordeum vulgare
ataatttcacwgatcagaagt

SEQ ID NO: 19806 - DNA, 21 bp, Hordeum vulgare
gggatggacaycaaacaataa

SEQ ID NO: 19807 - DNA, 21 bp, Hordeum vulgare
gatcgaagggmgtmtcatata

SEQ ID NO: 19808 - DNA, 21 bp, Hordeum vulgare
cctgtttcctygacaggaaat

SEQ ID NO: 19809 - DNA, 21 bp, Hordeum vulgare
ctcgtccatgstctgcatcgg

SEQ ID NO: 19810 - DNA, 20 bp, Hordeum vulgare
ctgcacactcgattgcttaa

SEQ ID NO: 19811 - DNA, 21 bp, Hordeum vulgare
ctgcacgacttgactgcttga

SEQ ID NO: 19812 - DNA, 21 bp, Hordeum vulgare
tacagttgtcraacaattaca

SEQ ID NO: 19813 - DNA, 21 bp, Hordeum vulgare
acccacgagtrccgtctggca

SEQ ID NO: 19814 - DNA, 21 bp, Hordeum vulgare
tcttttgcttygggttgggac

SEQ ID NO: 19815 - DNA, 21 bp, Hordeum vulgare
caagtgttggwgatatatggt

SEQ ID NO: 19816 - DNA, 21 bp, Hordeum vulgare
ttccagcctcraagtacatgt

SEQ ID NO: 19817 - DNA, 21 bp, Hordeum vulgare
ttgtcaactaygcgaggatat

SEQ ID NO: 19818 - DNA, 21 bp, Hordeum vulgare
aattacggccyatccatgtgg

SEQ ID NO: 19819 - DNA, 21 bp, Hordeum vulgare
gtgaaattgtmttactttact

SEQ ID NO: 19820 - DNA, 21 bp, Hordeum vulgare
aacggagggastatttaatat

SEQ ID NO: 19821 - DNA, 21 bp, Hordeum vulgare
cacgacaagtrttttggaacg

SEQ ID NO: 19822 - DNA, 21 bp, Hordeum vulgare
aattcatttamaagaagaaga

SEQ ID NO: 19823 - DNA, 21 bp, Hordeum vulgare
gcttgctgttsctaactagca

SEQ ID NO: 19824 - DNA, 21 bp, Hordeum vulgare
cgagagcaacmgaaggtatgt

SEQ ID NO: 19825 - DNA, 21 bp, Hordeum vulgare
atccatcatcragaaatttac

SEQ ID NO: 19826 - DNA, 21 bp, Hordeum vulgare
cataaggttcrtcgaagtatt

SEQ ID NO: 19827 - DNA, 21 bp, Hordeum vulgare
gcgaggcgacraatgcgagtg

SEQ ID NO: 19828 - DNA, 21 bp, Hordeum vulgare
cctgccacgcyctgaggaaca

SEQ ID NO: 19829 - DNA, 21 bp, Hordeum vulgare
ctatgtctaaytaatgtctaa

SEQ ID NO: 19830 - DNA, 21 bp, Hordeum vulgare
atggccatagyagcagcagca

SEQ ID NO: 19831 - DNA, 21 bp, Hordeum vulgare
gacattgaacrcgaggtttgt

SEQ ID NO: 19832 - DNA, 21 bp, Hordeum vulgare
ctaaatcagtygacagcaaaa

SEQ ID NO: 19833 - DNA, 21 bp, Hordeum vulgare
tgatgtagtcracgatctcgt

SEQ ID NO: 19834 - DNA, 21 bp, Hordeum vulgare
ggcacgggctygtaattctgg

SEQ ID NO: 19835 - DNA, 21 bp, Hordeum vulgare
cccgagtaacyatcccttgac

SEQ ID NO: 19836 - DNA, 21 bp, Hordeum vulgare
ctatctgtacrtgattttctt

SEQ ID NO: 19837 - DNA, 21 bp, Hordeum vulgare
tgccaggtgcwttataccaca

SEQ ID NO: 19838 - DNA, 21 bp, Hordeum vulgare
gcagttactaygaagcttagg

SEQ ID NO: 19839 - DNA, 21 bp, Hordeum vulgare
aaacaactagygtaaaggaga

SEQ ID NO: 19840 - DNA, 21 bp, Hordeum vulgare
ttgtcaggcaragtaatatta

SEQ ID NO: 19841 - DNA, 21 bp, Hordeum vulgare
gcttcaggtcmtcttgctctg

SEQ ID NO: 19842 - DNA, 21 bp, Hordeum vulgare
atgagagaccraatatttgct

SEQ ID NO: 19843 - DNA, 21 bp, Hordeum vulgare
aacctttatttatattatgtg

SEQ ID NO: 19844 - DNA, 20 bp, Hordeum vulgare
aacctttattatattatgtg

SEQ ID NO: 19845 - DNA, 20 bp, Hordeum vulgare
ctgcactgcatcgcgcaatg

SEQ ID NO: 19846 - DNA, 21 bp, Hordeum vulgare
ctgcactgcagtcgcgcaatg

SEQ ID NO: 19847 - DNA, 21 bp, Hordeum vulgare
cccaaatggcsgcgtcggcgg

SEQ ID NO: 19848 - DNA, 21 bp, Hordeum vulgare
gagcagcagasattgtgcatg

SEQ ID NO: 19849 - DNA, 21 bp, Hordeum vulgare
cactcagatgytgtcctcgtc

SEQ ID NO: 19850 - DNA, 21 bp, Hordeum vulgare
gttccagaagkacacaatgat

SEQ ID NO: 19851 - DNA, 21 bp, Hordeum vulgare
cacggggccgmcatattcacc

SEQ ID NO: 19852 - DNA, 21 bp, Hordeum vulgare
aagtaaatgtyatctttttct

SEQ ID NO: 19853 - DNA, 21 bp, Hordeum vulgare
taaaacctgaraaccactaat

SEQ ID NO: 19854 - DNA, 21 bp, Hordeum vulgare
atgtccatgtrcatcaatagg

SEQ ID NO: 19855 - DNA, 21 bp, Hordeum vulgare
atttatctagmaatggatata

SEQ ID NO: 19856 - DNA, 21 bp, Hordeum vulgare
ggacgtacggytagacctcga

SEQ ID NO: 19857 - DNA, 21 bp, Hordeum vulgare
aagactgggtrttatccatat

SEQ ID NO: 19858 - DNA, 21 bp, Hordeum vulgare
gccgcccgccycgatttgttt

SEQ ID NO: 19859 - DNA, 21 bp, Hordeum vulgare
gaaggctgagrcgaagctgtc

SEQ ID NO: 19860 - DNA, 21 bp, Hordeum vulgare
caaaacgcagrtcctcagccc

SEQ ID NO: 19861 - DNA, 21 bp, Hordeum vulgare
tcggcgggatyacttggccat

SEQ ID NO: 19862 - DNA, 21 bp, Hordeum vulgare
ataggagagtycggcctggag

SEQ ID NO: 19863 - DNA, 21 bp, Hordeum vulgare
gcccctccctsgagttgacga

SEQ ID NO: 19864 - DNA, 21 bp, Hordeum vulgare
atgagcacgtmttaggtggta

SEQ ID NO: 19865 - DNA, 21 bp, Hordeum vulgare
tgctgagctayatgttgcaca

SEQ ID NO: 19866 - DNA, 21 bp, Hordeum vulgare
tacctccttccgctcctttct

SEQ ID NO: 19867 - DNA, 20 bp, Hordeum vulgare
acctccttcggctcctttct

SEQ ID NO: 19868 - DNA, 20 bp, Hordeum vulgare
actgatgatccttgggaaag

SEQ ID NO: 19869 - DNA, 21 bp, Hordeum vulgare
actgatgatctttggggaaag

SEQ ID NO: 19870 - DNA, 21 bp, Hordeum vulgare
ttggagttatragccagagga

SEQ ID NO: 19871 - DNA, 21 bp, Hordeum vulgare
gtgtgtatccwccgtcagttc

SEQ ID NO: 19872 - DNA, 21 bp, Hordeum vulgare
gcgtgccacckacgttgaggc

SEQ ID NO: 19873 - DNA, 21 bp, Hordeum vulgare
ttgaggctggygaatccatct

SEQ ID NO: 19874 - DNA, 21 bp, Hordeum vulgare
acttcatcagsgctacgtcga

SEQ ID NO: 19875 - DNA, 21 bp, Hordeum vulgare
gaaattctgcyacagaccaca

SEQ ID NO: 19876 - DNA, 21 bp, Hordeum vulgare
cacttggacamttctatgcaa

SEQ ID NO: 19877 - DNA, 21 bp, Hordeum vulgare
atctagtatargtttggatgc

SEQ ID NO: 19878 - DNA, 21 bp, Hordeum vulgare
ctgtcttcgcrgcagatgcga

SEQ ID NO: 19879 - DNA, 21 bp, Hordeum vulgare
gaccggtgatscgtccgcctc

SEQ ID NO: 19880 - DNA, 21 bp, Hordeum vulgare
tgaacgatccrgataaagaac

SEQ ID NO: 19881 - DNA, 21 bp, Hordeum vulgare
ccaacgactasgcaaattata

SEQ ID NO: 19882 - DNA, 21 bp, Hordeum vulgare
ttaagtggackagtgattgca

SEQ ID NO: 19883 - DNA, 21 bp, Hordeum vulgare
tgcctcctttycccgataggc

SEQ ID NO: 19884 - DNA, 21 bp, Hordeum vulgare
tcgtatcagcrataactatgc

SEQ ID NO: 19885 - DNA, 21 bp, Hordeum vulgare
gtatgtggatmttcgtatcag

SEQ ID NO: 19886 - DNA, 21 bp, Hordeum vulgare
acaggtcatcwagacgaagca

SEQ ID NO: 19887 - DNA, 21 bp, Hordeum vulgare
aatccctggcwaccttgatgt

SEQ ID NO: 19888 - DNA, 21 bp, Hordeum vulgare
tcttctgagtsgggaatttca

SEQ ID NO: 19889 - DNA, 21 bp, Hordeum vulgare
gacttggatcracagcagctt

SEQ ID NO: 19890 - DNA, 21 bp, Hordeum vulgare
cagaagacccsatgtgggttc

SEQ ID NO: 19891 - DNA, 21 bp, Hordeum vulgare
atcaatagtcytaatattgta

SEQ ID NO: 19892 - DNA, 21 bp, Hordeum vulgare
gtgagtaacckctcttctctc

SEQ ID NO: 19893 - DNA, 21 bp, Hordeum vulgare
aaggtccagascatgccctgt

SEQ ID NO: 19894 - DNA, 21 bp, Hordeum vulgare
aagcagtgaawtctctctcat

SEQ ID NO: 19895 - DNA, 21 bp, Hordeum vulgare
atgatgtctcygcaatctcat

SEQ ID NO: 19896 - DNA, 21 bp, Hordeum vulgare
tggactagatycgaaaaggca

SEQ ID NO: 19897 - DNA, 21 bp, Hordeum vulgare
gcacaaacatyatcgttttgt

SEQ ID NO: 19898 - DNA, 21 bp, Hordeum vulgare
cagccgaactkctaaaatata

SEQ ID NO: 19899 - DNA, 21 bp, Hordeum vulgare
gttgatcttgsacagcgactc

SEQ ID NO: 19900 - DNA, 21 bp, Hordeum vulgare
gctaggtacaytcgtgacatc

SEQ ID NO: 19901 - DNA, 21 bp, Hordeum vulgare
agctacaaaarcaatgatgga

SEQ ID NO: 19902 - DNA, 21 bp, Hordeum vulgare
gttacatcccrtctgctcaaa

SEQ ID NO: 19903 - DNA, 21 bp, Hordeum vulgare
acaacagatawgtgcaatgca

SEQ ID NO: 19904 - DNA, 21 bp, Hordeum vulgare
gtttgtaaaamagcaaacgta

SEQ ID NO: 19905 - DNA, 21 bp, Hordeum vulgare
gtgaagttggyccacttgaag

SEQ ID NO: 19906 - DNA, 21 bp, Hordeum vulgare
ctgtcaccgcrccttcagctg

SEQ ID NO: 19907 - DNA, 21 bp, Hordeum vulgare
ttttcgctcgwttcactcttc

SEQ ID NO: 19908 - DNA, 21 bp, Hordeum vulgare
atgatcctgakgctgaacatg

SEQ ID NO: 19909 - DNA, 21 bp, Hordeum vulgare
tcacccggtgygacgtgccaa

SEQ ID NO: 19910 - DNA, 21 bp, Hordeum vulgare
attctgaagcytacagaaaca

SEQ ID NO: 19911 - DNA, 21 bp, Hordeum vulgare
gtatgcaaatyacattagaaa

SEQ ID NO: 19912 - DNA, 21 bp, Hordeum vulgare
ttatattgtgktttaactcat

SEQ ID NO: 19913 - DNA, 21 bp, Hordeum vulgare
taactcatggraatacatggg

SEQ ID NO: 19914 - DNA, 21 bp, Hordeum vulgare
tccttgggtaytatatcaggt

SEQ ID NO: 19915 - DNA, 21 bp, Hordeum vulgare
catccattgayaggcactgca

SEQ ID NO: 19916 - DNA, 21 bp, Hordeum vulgare
atgcccggaawctgggatgtt

SEQ ID NO: 19917 - DNA, 21 bp, Hordeum vulgare
ggaaaattctygattcataaa

SEQ ID NO: 19918 - DNA, 21 bp, Hordeum vulgare
ttcttcggacrcataattttt

SEQ ID NO: 19919 - DNA, 21 bp, Hordeum vulgare
gctgcattacrgatcgcaaca

SEQ ID NO: 19920 - DNA, 21 bp, Hordeum vulgare
ccgcggcctgwgcggtttgcg

SEQ ID NO: 19921 - DNA, 21 bp, Hordeum vulgare
agagcaacacratcatctatt

SEQ ID NO: 19922 - DNA, 21 bp, Hordeum vulgare
agttgtgcgcrttgaaacaaa

SEQ ID NO: 19923 - DNA, 21 bp, Hordeum vulgare
cttctctgccragctgcggct

SEQ ID NO: 19924 - DNA, 21 bp, Hordeum vulgare
ggatctgaggmagtgcacttg

SEQ ID NO: 19925 - DNA, 21 bp, Hordeum vulgare
ggacgagccgrgcatcgactc

SEQ ID NO: 19926 - DNA, 21 bp, Hordeum vulgare
ctgccttgcgkatcaagggga

SEQ ID NO: 19927 - DNA, 21 bp, Hordeum vulgare
catctaaagamaaatgatgct

SEQ ID NO: 19928 - DNA, 21 bp, Hordeum vulgare
tgatgatgacrgtgatgacgg

SEQ ID NO: 19929 - DNA, 21 bp, Hordeum vulgare
aacaaaagaawcatgtattgt

SEQ ID NO: 19930 - DNA, 21 bp, Hordeum vulgare
aatgtctttcraacattgcta

SEQ ID NO: 19931 - DNA, 21 bp, Hordeum vulgare
gcccacctcasgcatcttgat

SEQ ID NO: 19932 - DNA, 21 bp, Hordeum vulgare
tgaatcagtaraagaacattc

SEQ ID NO: 19933 - DNA, 21 bp, Hordeum vulgare
aatatctggcraatatgcttg

SEQ ID NO: 19934 - DNA, 21 bp, Hordeum vulgare
tcctgtgtatstggcgccact

SEQ ID NO: 19935 - DNA, 21 bp, Hordeum vulgare
ctttgcaagaratcggtgaat

SEQ ID NO: 19936 - DNA, 21 bp, Hordeum vulgare
gataaaatggraacagtatta

SEQ ID NO: 19937 - DNA, 21 bp, Hordeum vulgare
agcatttgtgscgatgtctcc

SEQ ID NO: 19938 - DNA, 21 bp, Hordeum vulgare
cggccgagccratctcttaaa

SEQ ID NO: 19939 - DNA, 21 bp, Hordeum vulgare
ctgcgtttggyaatggtggga

SEQ ID NO: 19940 - DNA, 21 bp, Hordeum vulgare
gggagcacaawtttggattcg

SEQ ID NO: 19941 - DNA, 21 bp, Hordeum vulgare
atgtacctttwtctgggttag

SEQ ID NO: 19942 - DNA, 21 bp, Hordeum vulgare
cttgatgaccrttacgttcat

SEQ ID NO: 19943 - DNA, 21 bp, Hordeum vulgare
gttggttaagrttatgatgaa

SEQ ID NO: 19944 - DNA, 21 bp, Hordeum vulgare
ttaggaggatytgttagtgga

SEQ ID NO: 19945 - DNA, 21 bp, Hordeum vulgare
aaatcatcgamccagcagtca

SEQ ID NO: 19946 - DNA, 21 bp, Hordeum vulgare
ccatgatggayctatatacaa

SEQ ID NO: 19947 - DNA, 21 bp, Hordeum vulgare
tcacaaacacmaagagagttg

SEQ ID NO: 19948 - DNA, 21 bp, Hordeum vulgare
tcaatttgatygatcatttcc

SEQ ID NO: 19949 - DNA, 21 bp, Hordeum vulgare
acactagaccmaggtaaagtc

SEQ ID NO: 19950 - DNA, 21 bp, Hordeum vulgare
gaatgaggacmacgcgatggg

SEQ ID NO: 19951 - DNA, 21 bp, Hordeum vulgare
aacaaaaagamgcaccatcta

SEQ ID NO: 19952 - DNA, 21 bp, Hordeum vulgare
atcatttcctraaaaaaattg

SEQ ID NO: 19953 - DNA, 21 bp, Hordeum vulgare
actggaagagragtacctctc

SEQ ID NO: 19954 - DNA, 21 bp, Hordeum vulgare
tctggattgaraaagaatgag

SEQ ID NO: 19955 - DNA, 21 bp, Hordeum vulgare
acgcgatgggrgagaaggaac

SEQ ID NO: 19956 - DNA, 21 bp, Hordeum vulgare
atcgccctcckgattcctttt

SEQ ID NO: 19957 - DNA, 21 bp, Hordeum vulgare
tttggtctacmgggttaccgc

SEQ ID NO: 19958 - DNA, 21 bp, Hordeum vulgare
gattatagtayagcggcgacc

SEQ ID NO: 19959 - DNA, 21 bp, Hordeum vulgare
gcgcacggcgkctgccacgtc

SEQ ID NO: 19960 - DNA, 21 bp, Hordeum vulgare
acaagcatctyataagctaat

SEQ ID NO: 19961 - DNA, 21 bp, Hordeum vulgare
caagcatcagwtcagctctac

SEQ ID NO: 19962 - DNA, 21 bp, Hordeum vulgare
ttccacgctcrctaattacta

SEQ ID NO: 19963 - DNA, 21 bp, Hordeum vulgare
tgctaaacagyaactttaccg

SEQ ID NO: 19964 - DNA, 21 bp, Hordeum vulgare
accgcatatcrccttcttgca

SEQ ID NO: 19965 - DNA, 21 bp, Hordeum vulgare
cactactaagrtagatatagc

SEQ ID NO: 19966 - DNA, 21 bp, Hordeum vulgare
accgaacaagrtgcatgcaca

SEQ ID NO: 19967 - DNA, 21 bp, Hordeum vulgare
agtgcactggygctaagtatg

SEQ ID NO: 19968 - DNA, 21 bp, Hordeum vulgare
attcaaactcytccagcacgc

SEQ ID NO: 19969 - DNA, 21 bp, Hordeum vulgare
tctagagcaascactgctgct

SEQ ID NO: 19970 - DNA, 21 bp, Hordeum vulgare
caacagatgtsgcagcacgta

SEQ ID NO: 19971 - DNA, 21 bp, Hordeum vulgare
ctaattggtcmggtgtagagt

SEQ ID NO: 19972 - DNA, 21 bp, Hordeum vulgare
atgcaatgcayagtcgcttta

SEQ ID NO: 19973 - DNA, 21 bp, Hordeum vulgare
catagctgccktcaaataaaa

SEQ ID NO: 19974 - DNA, 21 bp, Hordeum vulgare
cgccaacattkatgacaccta

SEQ ID NO: 19975 - DNA, 20 bp, Hordeum vulgare
gcatgcatgaagatacaggc

SEQ ID NO: 19976 - DNA, 21 bp, Hordeum vulgare
gcatgcatgacagatacaggc

SEQ ID NO: 19977 - DNA, 20 bp, Hordeum vulgare
cgtatctgcagcgatacatg

SEQ ID NO: 19978 - DNA, 21 bp, Hordeum vulgare
cgtatctgcaagcgatacatg

SEQ ID NO: 19979 - DNA, 20 bp, Hordeum vulgare
ttcacaaatcatcatggcct

SEQ ID NO: 19980 - DNA, 21 bp, Hordeum vulgare
ttcacaaatccatcatggcct

SEQ ID NO: 19981 - DNA, 21 bp, Hordeum vulgare
gtcctttgccrtcctgctctt

SEQ ID NO: 19982 - DNA, 21 bp, Hordeum vulgare
cccagtgtcaycgttaaattt

SEQ ID NO: 19983 - DNA, 21 bp, Hordeum vulgare
ctagatcttgmgttggttggt

SEQ ID NO: 19984 - DNA, 21 bp, Hordeum vulgare
cctgctgttcytcttggcatg

SEQ ID NO: 19985 - DNA, 21 bp, Hordeum vulgare
ggctgtaattwggatctgctc

SEQ ID NO: 19986 - DNA, 21 bp, Hordeum vulgare
cagacgatctytgagagtgtc

SEQ ID NO: 19987 - DNA, 21 bp, Hordeum vulgare
acagggatttyacagacgatc

SEQ ID NO: 19988 - DNA, 21 bp, Hordeum vulgare
ggatctgctcyttgtctcttg

SEQ ID NO: 19989 - DNA, 21 bp, Hordeum vulgare
tctggggcacktggactagct

SEQ ID NO: 19990 - DNA, 21 bp, Hordeum vulgare
agttcaggtgyaattttgggt

SEQ ID NO: 19991 - DNA, 21 bp, Hordeum vulgare
tcgtcaattgytttcagacag

SEQ ID NO: 19992 - DNA, 21 bp, Hordeum vulgare
tgctgaaatcrtgcattcccc

SEQ ID NO: 19993 - DNA, 21 bp, Hordeum vulgare
cagcgccgcgrtgttcactcg

SEQ ID NO: 19994 - DNA, 21 bp, Hordeum vulgare
cagacagagaycgcagaatga

SEQ ID NO: 19995 - DNA, 21 bp, Hordeum vulgare
atgaataagcraagtacgaca

SEQ ID NO: 19996 - DNA, 21 bp, Hordeum vulgare
catggttaaayactctggtac

SEQ ID NO: 19997 - DNA, 21 bp, Hordeum vulgare
atctcaaaagsgtcgtgtacc

SEQ ID NO: 19998 - DNA, 21 bp, Hordeum vulgare
agagatttcgsgacgtaccag

SEQ ID NO: 19999 - DNA, 21 bp, Hordeum vulgare
caagatagtcmaagatgccaa

SEQ ID NO: 20000 - DNA, 21 bp, Hordeum vulgare
gcaggaatctrtggtggcctg

SEQ ID NO: 20001 - DNA, 21 bp, Hordeum vulgare
taaatccagtrgcagagatgg

SEQ ID NO: 20002 - DNA, 21 bp, Hordeum vulgare
gggcttgagcrcaagtgacag

SEQ ID NO: 20003 - DNA, 21 bp, Hordeum vulgare
cccagtaaagsatgttggaag

SEQ ID NO: 20004 - DNA, 21 bp, Hordeum vulgare
tacgactcgarcattgggcct

SEQ ID NO: 20005 - DNA, 21 bp, Hordeum vulgare
agcgatatatrtatgtcttca

SEQ ID NO: 20006 - DNA, 21 bp, Hordeum vulgare
gttcatatcayttccctgtac

SEQ ID NO: 20007 - DNA, 21 bp, Hordeum vulgare
tatctctggcrgaagaggtct

SEQ ID NO: 20008 - DNA, 21 bp, Hordeum vulgare
ccactggaggracatactgat

SEQ ID NO: 20009 - DNA, 21 bp, Hordeum vulgare
tagcacaaatrttcaagaatc

SEQ ID NO: 20010 - DNA, 21 bp, Hordeum vulgare
accctgtattmagaagagtaa

SEQ ID NO: 20011 - DNA, 21 bp, Hordeum vulgare
cagatgctggrttgtgccaac

SEQ ID NO: 20012 - DNA, 21 bp, Hordeum vulgare
agacgacccakaaattaacaa

SEQ ID NO: 20013 - DNA, 21 bp, Hordeum vulgare
attagaattcyagtacacaag

SEQ ID NO: 20014 - DNA, 21 bp, Hordeum vulgare
ctggggcgccsgagccgacgc

SEQ ID NO: 20015 - DNA, 21 bp, Hordeum vulgare
aagttactgawagttagtgta

SEQ ID NO: 20016 - DNA, 21 bp, Hordeum vulgare
ggccacaataygttggtcatt

SEQ ID NO: 20017 - DNA, 21 bp, Hordeum vulgare
acttgtatctwaagcactacg

SEQ ID NO: 20018 - DNA, 21 bp, Hordeum vulgare
gcccggcatarttaatttttt

SEQ ID NO: 20019 - DNA, 21 bp, Hordeum vulgare
tggcacctgtwgggaaaagga

SEQ ID NO: 20020 - DNA, 21 bp, Hordeum vulgare
gtacaaaacargaatctccct

SEQ ID NO: 20021 - DNA, 21 bp, Hordeum vulgare
cacaagtagtrgaagtattca

SEQ ID NO: 20022 - DNA, 21 bp, Hordeum vulgare
tcaaatgctcygagagactga

SEQ ID NO: 20023 - DNA, 21 bp, Hordeum vulgare
tttcactttcstcttcgcttt

SEQ ID NO: 20024 - DNA, 21 bp, Hordeum vulgare
accgtttctakttgcacggga

SEQ ID NO: 20025 - DNA, 21 bp, Hordeum vulgare
attaggttctsaccgtaggct

SEQ ID NO: 20026 - DNA, 21 bp, Hordeum vulgare
cagagatttcragacaataga

SEQ ID NO: 20027 - DNA, 21 bp, Hordeum vulgare
ttaacaagcgytgtgtcacct

SEQ ID NO: 20028 - DNA, 21 bp, Hordeum vulgare
taaaaacctamaaagagacag

SEQ ID NO: 20029 - DNA, 21 bp, Hordeum vulgare
agtgggcagcyctgatctcag

SEQ ID NO: 20030 - DNA, 21 bp, Hordeum vulgare
gttcatttgtygagtagacat

SEQ ID NO: 20031 - DNA, 21 bp, Hordeum vulgare
tcaggttggakccatggaggt

SEQ ID NO: 20032 - DNA, 21 bp, Hordeum vulgare
agtgggcagcyctgatctcag

SEQ ID NO: 20033 - DNA, 21 bp, Hordeum vulgare
cagccacagtyctttggatta

SEQ ID NO: 20034 - DNA, 21 bp, Hordeum vulgare
aaagactgaaytattgagttt

SEQ ID NO: 20035 - DNA, 21 bp, Hordeum vulgare
aacttaaactwttacaaagac

SEQ ID NO: 20036 - DNA, 21 bp, Hordeum vulgare
ctgtaggcaasaaaactgtaa

SEQ ID NO: 20037 - DNA, 21 bp, Hordeum vulgare
tggggttatayggcttagcgg

SEQ ID NO: 20038 - DNA, 21 bp, Hordeum vulgare
aacttaaactwttacaaagac

SEQ ID NO: 20039 - DNA, 21 bp, Hordeum vulgare
aaagactgaaytattgagttt

SEQ ID NO: 20040 - DNA, 21 bp, Hordeum vulgare
catggtttgtrcctatattac

SEQ ID NO: 20041 - DNA, 21 bp, Hordeum vulgare
cagccacagtyctttggatta

SEQ ID NO: 20042 - DNA, 21 bp, Hordeum vulgare
ctgtaggcaasaaaactgtaa

SEQ ID NO: 20043 - DNA, 21 bp, Hordeum vulgare
accggaactcrctgccgaatc

SEQ ID NO: 20044 - DNA, 21 bp, Hordeum vulgare
cttcagctgcygctgcagcgg

SEQ ID NO: 20045 - DNA, 21 bp, Hordeum vulgare
ccggagggackccccacagca

SEQ ID NO: 20046 - DNA, 21 bp, Hordeum vulgare
gtttatccagytgatgcggag

SEQ ID NO: 20047 - DNA, 21 bp, Hordeum vulgare
ctacaagggargcagcccagg

SEQ ID NO: 20048 - DNA, 21 bp, Hordeum vulgare
aaaatacagtsccgaccaaga

SEQ ID NO: 20049 - DNA, 21 bp, Hordeum vulgare
gagctagcgckggcaagacca

SEQ ID NO: 20050 - DNA, 21 bp, Hordeum vulgare
tcaggactcargaccayatag

SEQ ID NO: 20051 - DNA, 21 bp, Hordeum vulgare
caaatgctatkgcctatggct

SEQ ID NO: 20052 - DNA, 21 bp, Hordeum vulgare
tccgacgaggrtgagttcaac

SEQ ID NO: 20053 - DNA, 21 bp, Hordeum vulgare
tatagttaccrtactaatact

SEQ ID NO: 20054 - DNA, 21 bp, Hordeum vulgare
ttgcttggaartccttcatga

SEQ ID NO: 20055 - DNA, 21 bp, Hordeum vulgare
ccaagatctgrtgttgatgca

SEQ ID NO: 20056 - DNA, 21 bp, Hordeum vulgare
cgggtacggcrgcccggcgac

SEQ ID NO: 20057 - DNA, 21 bp, Hordeum vulgare
ctccgggcaasaatcttcagg

SEQ ID NO: 20058 - DNA, 21 bp, Hordeum vulgare
ttggcggcctsgccggcgagc

SEQ ID NO: 20059 - DNA, 21 bp, Hordeum vulgare
tcggaggtcakaatgatgttc

SEQ ID NO: 20060 - DNA, 21 bp, Hordeum vulgare
cgcattgcctrcacagcatag

SEQ ID NO: 20061 - DNA, 21 bp, Hordeum vulgare
agatggtacargacacagcag

SEQ ID NO: 20062 - DNA, 21 bp, Hordeum vulgare
cgggttacaasaaaagtggca

SEQ ID NO: 20063 - DNA, 21 bp, Hordeum vulgare
cgggttacaasaaaagtggca

SEQ ID NO: 20064 - DNA, 21 bp, Hordeum vulgare
cagagccagamgcagcagccg

SEQ ID NO: 20065 - DNA, 21 bp, Hordeum vulgare
atccatatccmacaatcagaa

SEQ ID NO: 20066 - DNA, 21 bp, Hordeum vulgare
aaagaaggcgmgattgcggaa

SEQ ID NO: 20067 - DNA, 21 bp, Hordeum vulgare
taggcgacggkgatgtcgaac

SEQ ID NO: 20068 - DNA, 21 bp, Hordeum vulgare
tcggctctgamcaccaaaggt

SEQ ID NO: 20069 - DNA, 21 bp, Hordeum vulgare
agcagcaaacrtataattacc

SEQ ID NO: 20070 - DNA, 21 bp, Hordeum vulgare
tgtctctctcygactccatct

SEQ ID NO: 20071 - DNA, 21 bp, Hordeum vulgare
atactctggtsgaactggagg

SEQ ID NO: 20072 - DNA, 21 bp, Hordeum vulgare
gaagacatgtyaaccacacca

SEQ ID NO: 20073 - DNA, 21 bp, Hordeum vulgare
tatactccggwtcttcatgct

SEQ ID NO: 20074 - DNA, 21 bp, Hordeum vulgare
gcttgtcacgraggtgcggct

SEQ ID NO: 20075 - DNA, 21 bp, Hordeum vulgare
gcatcttggcrtcgttgcaga

SEQ ID NO: 20076 - DNA, 21 bp, Hordeum vulgare
gggggttagartagaagtaat

SEQ ID NO: 20077 - DNA, 21 bp, Hordeum vulgare
gtacaaccgtytccaccgtac

SEQ ID NO: 20078 - DNA, 21 bp, Hordeum vulgare
ggtggtggtgygatgtccttc

SEQ ID NO: 20079 - DNA, 21 bp, Hordeum vulgare
aggagcaggcrcgagaacgtt

SEQ ID NO: 20080 - DNA, 21 bp, Hordeum vulgare
tccttatttgsttctgtcccc

SEQ ID NO: 20081 - DNA, 21 bp, Hordeum vulgare
ctgcgagctcmgaagatgttg

SEQ ID NO: 20082 - DNA, 21 bp, Hordeum vulgare
cttttgtgttkacctcgatct

SEQ ID NO: 20083 - DNA, 21 bp, Hordeum vulgare
tgccaatcatrgggtattgat

SEQ ID NO: 20084 - DNA, 21 bp, Hordeum vulgare
tgcacccattygacaccatgt

SEQ ID NO: 20085 - DNA, 21 bp, Hordeum vulgare
tcgtcatgttrgccctctgca

SEQ ID NO: 20086 - DNA, 21 bp, Hordeum vulgare
tcggcgaccgytgcataggtc

SEQ ID NO: 20087 - DNA, 21 bp, Hordeum vulgare
gcaggccagaraagtgtaaac

SEQ ID NO: 20088 - DNA, 21 bp, Hordeum vulgare
cgttctgcggygcctcggcca

SEQ ID NO: 20089 - DNA, 21 bp, Hordeum vulgare
ctgcgcgaacrcgtgaaggaa

SEQ ID NO: 20090 - DNA, 21 bp, Hordeum vulgare
gtgggaaaggraactagttgc

SEQ ID NO: 20091 - DNA, 21 bp, Hordeum vulgare
tgcctctgaayctctgcttgc

SEQ ID NO: 20092 - DNA, 21 bp, Hordeum vulgare
gctttctgtcrcctgatgaat

SEQ ID NO: 20093 - DNA, 21 bp, Hordeum vulgare
gaggttcccgrcatttttcag

SEQ ID NO: 20094 - DNA, 21 bp, Hordeum vulgare
gctctccatgytgagaactct

SEQ ID NO: 20095 - DNA, 21 bp, Hordeum vulgare
agagagagcckcttcgattac

SEQ ID NO: 20096 - DNA, 21 bp, Hordeum vulgare
acatgtacaasagatttacat

SEQ ID NO: 20097 - DNA, 21 bp, Hordeum vulgare
tgaaggaggcmcaaaatgtac

SEQ ID NO: 20098 - DNA, 21 bp, Hordeum vulgare
tatggacatgrctacagaatt

SEQ ID NO: 20099 - DNA, 21 bp, Hordeum vulgare
ttatctctctmtgctctattg

SEQ ID NO: 20100 - DNA, 21 bp, Hordeum vulgare
aaccaacatakcgaaaacctt

SEQ ID NO: 20101 - DNA, 21 bp, Hordeum vulgare
gtgttaagacygtcagcagct

SEQ ID NO: 20102 - DNA, 21 bp, Hordeum vulgare
gagcatgttakacctctttat

SEQ ID NO: 20103 - DNA, 21 bp, Hordeum vulgare
gctgcagcctsttcttgaagc

SEQ ID NO: 20104 - DNA, 21 bp, Hordeum vulgare
gctctccatgytgagaactct

SEQ ID NO: 20105 - DNA, 21 bp, Hordeum vulgare
gatcaaaccgygaactcaatg

SEQ ID NO: 20106 - DNA, 21 bp, Hordeum vulgare
ctcaatgactkgagcatgtta

SEQ ID NO: 20107 - DNA, 21 bp, Hordeum vulgare
aggaggcccawtgcagaagat

SEQ ID NO: 20108 - DNA, 21 bp, Hordeum vulgare
atttggcagasacgaaatgcg

SEQ ID NO: 20109 - DNA, 21 bp, Hordeum vulgare
tggaccatacktgatatccat

SEQ ID NO: 20110 - DNA, 21 bp, Hordeum vulgare
gcttttggggsggtcatctag

SEQ ID NO: 20111 - DNA, 21 bp, Hordeum vulgare
acaaaaatcakcagataatgt

SEQ ID NO: 20112 - DNA, 21 bp, Hordeum vulgare
aaacactatcrttacgcctat

SEQ ID NO: 20113 - DNA, 21 bp, Hordeum vulgare
tgatgattgawcagggcctga

SEQ ID NO: 20114 - DNA, 21 bp, Hordeum vulgare
tgcagaaactrtgttgctaaa

SEQ ID NO: 20115 - DNA, 21 bp, Hordeum vulgare
ttgtctagtgyttgggcttga

SEQ ID NO: 20116 - DNA, 21 bp, Hordeum vulgare
acaaatctacwttcgcgaagg

SEQ ID NO: 20117 - DNA, 21 bp, Hordeum vulgare
ctccactccckcgccttcttc

SEQ ID NO: 20118 - DNA, 21 bp, Hordeum vulgare
ggaacgtgtcraattcctcat

SEQ ID NO: 20119 - DNA, 21 bp, Hordeum vulgare
ttgcaggaaayactgcagaac

SEQ ID NO: 20120 - DNA, 21 bp, Hordeum vulgare
cctgtatgaayttcgaaatga

SEQ ID NO: 20121 - DNA, 21 bp, Hordeum vulgare
tgaacccaccrggttcgcagc

SEQ ID NO: 20122 - DNA, 21 bp, Hordeum vulgare
gaaatcctcgrtcggtcctgg

SEQ ID NO: 20123 - DNA, 21 bp, Hordeum vulgare
ttattcactascaactttgta

SEQ ID NO: 20124 - DNA, 21 bp, Hordeum vulgare
ggatgcccgtyccatgatcaa

SEQ ID NO: 20125 - DNA, 21 bp, Hordeum vulgare
agaatatccawggacaaaggt

SEQ ID NO: 20126 - DNA, 21 bp, Hordeum vulgare
ttggcacaagrgcagcagtaa

SEQ ID NO: 20127 - DNA, 21 bp, Hordeum vulgare
agggcattcartttcgttcca

SEQ ID NO: 20128 - DNA, 21 bp, Hordeum vulgare
ctgccagcccyccgacggtga

SEQ ID NO: 20129 - DNA, 21 bp, Hordeum vulgare
gccagctctcmacgccggacc

SEQ ID NO: 20130 - DNA, 21 bp, Hordeum vulgare
cctcccacaawtaagcagtgc

SEQ ID NO: 20131 - DNA, 21 bp, Hordeum vulgare
gccagagaaawttttcctcga

SEQ ID NO: 20132 - DNA, 21 bp, Hordeum vulgare
acatgcatggwcaattttacg

SEQ ID NO: 20133 - DNA, 21 bp, Hordeum vulgare
gtggacttctycttggcggcg

SEQ ID NO: 20134 - DNA, 21 bp, Hordeum vulgare
tggcctcgccrcccatctttt

SEQ ID NO: 20135 - DNA, 21 bp, Hordeum vulgare
tcggtggccgkcttcttcacg

SEQ ID NO: 20136 - DNA, 21 bp, Hordeum vulgare
ttcacggcctmcgtcttctcg

SEQ ID NO: 20137 - DNA, 21 bp, Hordeum vulgare
tctgcagcggygtcctggaca

SEQ ID NO: 20138 - DNA, 21 bp, Hordeum vulgare
actcgtcgccrgcgaggtact

SEQ ID NO: 20139 - DNA, 21 bp, Hordeum vulgare
ctaaaccaggrcgcctgaaca

SEQ ID NO: 20140 - DNA, 21 bp, Hordeum vulgare
cgatgtagacrtggacgttga

SEQ ID NO: 20141 - DNA, 21 bp, Hordeum vulgare
atgtctccgcyggcggtgcgt

SEQ ID NO: 20142 - DNA, 21 bp, Hordeum vulgare
cttgccatccmcgtcgccgtc

SEQ ID NO: 20143 - DNA, 21 bp, Hordeum vulgare
atgcggtccamactccaacca

SEQ ID NO: 20144 - DNA, 21 bp, Hordeum vulgare
tgttccttcckcttgtttgtt

SEQ ID NO: 20145 - DNA, 21 bp, Hordeum vulgare
gaggagccagmagcagcatct

SEQ ID NO: 20146 - DNA, 21 bp, Hordeum vulgare
aaacatgatcytgatccatgc

SEQ ID NO: 20147 - DNA, 21 bp, Hordeum vulgare
gtgtctcgctsggttcgttct

SEQ ID NO: 20148 - DNA, 21 bp, Hordeum vulgare
tcccttcttcsttttttttgt

SEQ ID NO: 20149 - DNA, 21 bp, Hordeum vulgare
gtcctgggatytgaaggaatc

SEQ ID NO: 20150 - DNA, 21 bp, Hordeum vulgare
cttccgtcgarcaacccaaac

SEQ ID NO: 20151 - DNA, 21 bp, Hordeum vulgare
cagcttcatcraaagaatcga

SEQ ID NO: 20152 - DNA, 21 bp, Hordeum vulgare
ctgatgaacayctaagatttc

SEQ ID NO: 20153 - DNA, 21 bp, Hordeum vulgare
acggattctargcatgatcaa

SEQ ID NO: 20154 - DNA, 21 bp, Hordeum vulgare
atagcttaccrcaatggtctc

SEQ ID NO: 20155 - DNA, 21 bp, Hordeum vulgare
tggacgactargaattattgg

SEQ ID NO: 20156 - DNA, 21 bp, Hordeum vulgare
ccgattaacastggcccacac

SEQ ID NO: 20157 - DNA, 21 bp, Hordeum vulgare
ctttacccacractcgagcgt

SEQ ID NO: 20158 - DNA, 21 bp, Hordeum vulgare
tttcatctacktactacctgc

SEQ ID NO: 20159 - DNA, 21 bp, Hordeum vulgare
atcctcacgcragcttgcaag

SEQ ID NO: 20160 - DNA, 21 bp, Hordeum vulgare
atttgagtgckcagcctatat

SEQ ID NO: 20161 - DNA, 21 bp, Hordeum vulgare
atatatgaaaytgagacgacc

SEQ ID NO: 20162 - DNA, 21 bp, Hordeum vulgare
ctttggcgttsccttttccgc

SEQ ID NO: 20163 - DNA, 21 bp, Hordeum vulgare
gaacttgcctmctgtccttta

SEQ ID NO: 20164 - DNA, 21 bp, Hordeum vulgare
tatggcacccmtcacaccaca

SEQ ID NO: 20165 - DNA, 21 bp, Hordeum vulgare
tcgggccccamtccctcatgt

SEQ ID NO: 20166 - DNA, 21 bp, Hordeum vulgare
ctaagtaccgygtccacctct

SEQ ID NO: 20167 - DNA, 21 bp, Hordeum vulgare
gaagtgtagcrtcagggttgt

SEQ ID NO: 20168 - DNA, 21 bp, Hordeum vulgare
gcaaagaatamgggccgcctt

SEQ ID NO: 20169 - DNA, 21 bp, Hordeum vulgare
gattttaattmagatgatgat

SEQ ID NO: 20170 - DNA, 21 bp, Hordeum vulgare
ccttatcatcwtcctgtacca

SEQ ID NO: 20171 - DNA, 21 bp, Hordeum vulgare
tgatgaaccasttgttgattt

SEQ ID NO: 20172 - DNA, 21 bp, Hordeum vulgare
agaggttgcastcttaaccga

SEQ ID NO: 20173 - DNA, 21 bp, Hordeum vulgare
ctatccaagargttgaacatc

SEQ ID NO: 20174 - DNA, 21 bp, Hordeum vulgare
cgcggaggccratggtgtagt

SEQ ID NO: 20175 - DNA, 21 bp, Hordeum vulgare
ccacctcgtakgggatctccg

SEQ ID NO: 20176 - DNA, 21 bp, Hordeum vulgare
aatcaacccarggtgaaattg

SEQ ID NO: 20177 - DNA, 21 bp, Hordeum vulgare
atctgaaattrtgagcatgaa

SEQ ID NO: 20178 - DNA, 21 bp, Hordeum vulgare
gtgtccaaaamcgtgatgttc

SEQ ID NO: 20179 - DNA, 21 bp, Hordeum vulgare
cggacgatatsagctagctag

SEQ ID NO: 20180 - DNA, 21 bp, Hordeum vulgare
cggacgatatsagctagctag

SEQ ID NO: 20181 - DNA, 21 bp, Hordeum vulgare
ttaatccttcrtaggctcatt

SEQ ID NO: 20182 - DNA, 21 bp, Hordeum vulgare
tttttcctccmatccagatgc

SEQ ID NO: 20183 - DNA, 21 bp, Hordeum vulgare
cctcaccggcscttgcaacgg

SEQ ID NO: 20184 - DNA, 21 bp, Hordeum vulgare
gaaaacatgcmggtgaactca

SEQ ID NO: 20185 - DNA, 21 bp, Hordeum vulgare
tggcggccgcrtcgcctttca

SEQ ID NO: 20186 - DNA, 21 bp, Hordeum vulgare
agaggacaccrccgatagcaa

SEQ ID NO: 20187 - DNA, 21 bp, Hordeum vulgare
tcacaaaacawtaaaccccca

SEQ ID NO: 20188 - DNA, 21 bp, Hordeum vulgare
caccatcttgmagtaaataca

SEQ ID NO: 20189 - DNA, 21 bp, Hordeum vulgare
tgtagaaggtkctcctgtcgt

SEQ ID NO: 20190 - DNA, 21 bp, Hordeum vulgare
gtcacccaaaycatggtcatt

SEQ ID NO: 20191 - DNA, 21 bp, Hordeum vulgare
ttccctgatgyagttcttcaa

SEQ ID NO: 20192 - DNA, 21 bp, Hordeum vulgare
actggtagacraggtccatgc

SEQ ID NO: 20193 - DNA, 21 bp, Hordeum vulgare
acccgtccacsagcagggagt

SEQ ID NO: 20194 - DNA, 21 bp, Hordeum vulgare
ctccggatccrccgcgacgaa

SEQ ID NO: 20195 - DNA, 21 bp, Hordeum vulgare
aactcaagctygcctctaaca

SEQ ID NO: 20196 - DNA, 21 bp, Hordeum vulgare
gcgggcgccgygggtcgagcg

SEQ ID NO: 20197 - DNA, 21 bp, Hordeum vulgare
caggataactrtctgaaccct

SEQ ID NO: 20198 - DNA, 21 bp, Hordeum vulgare
ccgagattcgrtgcccaggta

SEQ ID NO: 20199 - DNA, 21 bp, Hordeum vulgare
gcaccttgggrgccttacctt

SEQ ID NO: 20200 - DNA, 21 bp, Hordeum vulgare
ttgagatcgtrtactcgagaa

SEQ ID NO: 20201 - DNA, 21 bp, Hordeum vulgare
tcatacaaaasaagaaaaaac

SEQ ID NO: 20202 - DNA, 21 bp, Hordeum vulgare
acactttttcrtccttgactg

SEQ ID NO: 20203 - DNA, 21 bp, Hordeum vulgare
aggtattaagmttaactgctg

SEQ ID NO: 20204 - DNA, 21 bp, Hordeum vulgare
aactcaatcargccttgtgct

SEQ ID NO: 20205 - DNA, 21 bp, Hordeum vulgare
aaattggattyatgtactaac

SEQ ID NO: 20206 - DNA, 21 bp, Hordeum vulgare
aatgcaccctktgtcctgcaa

SEQ ID NO: 20207 - DNA, 21 bp, Hordeum vulgare
gcgtgcgggcrcccttctggc

SEQ ID NO: 20208 - DNA, 21 bp, Hordeum vulgare
tctaacgagakcacaacaaga

SEQ ID NO: 20209 - DNA, 21 bp, Hordeum vulgare
tgtcgttgccrgccacttctc

SEQ ID NO: 20210 - DNA, 21 bp, Hordeum vulgare
aaacacagctrctaaaataag

SEQ ID NO: 20211 - DNA, 21 bp, Hordeum vulgare
tctaataattrattcgcttca

SEQ ID NO: 20212 - DNA, 21 bp, Hordeum vulgare
aaaatatgctyaagagttcaa

SEQ ID NO: 20213 - DNA, 21 bp, Hordeum vulgare
caaaagagcarcaaaaattca

SEQ ID NO: 20214 - DNA, 20 bp, Hordeum vulgare
gaacatgatagaggtatgtt

SEQ ID NO: 20215 - DNA, 21 bp, Hordeum vulgare
gaacatgataagaggtatgtt

SEQ ID NO: 20216 - DNA, 21 bp, Hordeum vulgare
attcagttggygcagttctta

SEQ ID NO: 20217 - DNA, 21 bp, Hordeum vulgare
accggcaccayggctaagatc

SEQ ID NO: 20218 - DNA, 21 bp, Hordeum vulgare
cagtctccccrgcaattgcag

SEQ ID NO: 20219 - DNA, 21 bp, Hordeum vulgare
acctaactaawtcacaccagc

SEQ ID NO: 20220 - DNA, 21 bp, Hordeum vulgare
gtaatcaactrattcctttgg

SEQ ID NO: 20221 - DNA, 21 bp, Hordeum vulgare
gctcccgccgscagcaggttc

SEQ ID NO: 20222 - DNA, 21 bp, Hordeum vulgare
acaatgagttygaaaacacgt

SEQ ID NO: 20223 - DNA, 21 bp, Hordeum vulgare
atgatgcctwwattgagctca

SEQ ID NO: 20224 - DNA, 21 bp, Hordeum vulgare
tggtttctgaygctttcagaa

SEQ ID NO: 20225 - DNA, 21 bp, Hordeum vulgare
cgatcataacrtggacggcgg

SEQ ID NO: 20226 - DNA, 21 bp, Hordeum vulgare
ttcaagtcctytctcttatac

SEQ ID NO: 20227 - DNA, 21 bp, Hordeum vulgare
tcgaccgtggraatcccaaca

SEQ ID NO: 20228 - DNA, 21 bp, Hordeum vulgare
ctaggagtaastccccacgtc

SEQ ID NO: 20229 - DNA, 21 bp, Hordeum vulgare
aaagaacacamtggttgtttt

SEQ ID NO: 20230 - DNA, 21 bp, Hordeum vulgare
aggcaaactcrgtcagggaaa

SEQ ID NO: 20231 - DNA, 21 bp, Hordeum vulgare
caacccaactygatgataatg

SEQ ID NO: 20232 - DNA, 21 bp, Hordeum vulgare
gtgtcgacgcrgaactcgccg

SEQ ID NO: 20233 - DNA, 21 bp, Hordeum vulgare
cctacaagtastacaactcac

SEQ ID NO: 20234 - DNA, 21 bp, Hordeum vulgare
tcacatgcttycggtacgatt

SEQ ID NO: 20235 - DNA, 21 bp, Hordeum vulgare
atacacagtcmcctgtaatat

SEQ ID NO: 20236 - DNA, 21 bp, Hordeum vulgare
ccttgaatcaytgaatttcct

SEQ ID NO: 20237 - DNA, 21 bp, Hordeum vulgare
tactcctacartgctgccaag

SEQ ID NO: 20238 - DNA, 21 bp, Hordeum vulgare
cattgtccgcygggcgttgct

SEQ ID NO: 20239 - DNA, 21 bp, Hordeum vulgare
ggaagtgtgcytgggcattcg

SEQ ID NO: 20240 - DNA, 21 bp, Hordeum vulgare
aaatcatgcasaagaggcgat

SEQ ID NO: 20241 - DNA, 21 bp, Hordeum vulgare
ccccatgctcwtgcaggcatg

SEQ ID NO: 20242 - DNA, 21 bp, Hordeum vulgare
cggaagatgcratgccgacgc

SEQ ID NO: 20243 - DNA, 21 bp, Hordeum vulgare
tcaccaagttrccgtcttcag

SEQ ID NO: 20244 - DNA, 21 bp, Hordeum vulgare
aatgcggtatygtccgacctc

SEQ ID NO: 20245 - DNA, 21 bp, Hordeum vulgare
gtagtgcagakgacagtgatg

SEQ ID NO: 20246 - DNA, 21 bp, Hordeum vulgare
agaaggttttkgccaccgaag

SEQ ID NO: 20247 - DNA, 21 bp, Hordeum vulgare
gagggaagtcraaaaatagga

SEQ ID NO: 20248 - DNA, 21 bp, Hordeum vulgare
ttctgtttgtsctcctgctgc

SEQ ID NO: 20249 - DNA, 21 bp, Hordeum vulgare
attctgtttgwcaggatctca

SEQ ID NO: 20250 - DNA, 21 bp, Hordeum vulgare
tctcggcctcrtcaaagaaga

SEQ ID NO: 20251 - DNA, 21 bp, Hordeum vulgare
tcaagtctggwaccactctat

SEQ ID NO: 20252 - DNA, 21 bp, Hordeum vulgare
atgcagcacaracaacacgtt

SEQ ID NO: 20253 - DNA, 21 bp, Hordeum vulgare
gtacaactcamgagctcttgt

SEQ ID NO: 20254 - DNA, 21 bp, Hordeum vulgare
gagctcttgtmgacggttttc

SEQ ID NO: 20255 - DNA, 21 bp, Hordeum vulgare
cgttccaaatrcgtggtccca

SEQ ID NO: 20256 - DNA, 21 bp, Hordeum vulgare
atatctggcaytgcaaggtgg

SEQ ID NO: 20257 - DNA, 21 bp, Hordeum vulgare
tttgcgcgctygaggagtctc

SEQ ID NO: 20258 - DNA, 21 bp, Hordeum vulgare
tttgcgcgctygaggagtctc

SEQ ID NO: 20259 - DNA, 21 bp, Hordeum vulgare
ccggcacaagytcacatatcc

SEQ ID NO: 20260 - DNA, 21 bp, Hordeum vulgare
ccggattttcrcgtccgattc

SEQ ID NO: 20261 - DNA, 21 bp, Hordeum vulgare
acacgagtccyttacagaata

SEQ ID NO: 20262 - DNA, 21 bp, Hordeum vulgare
tcataccagtsatgcttttat

SEQ ID NO: 20263 - DNA, 21 bp, Hordeum vulgare
aaaaagagacracgtgcactt

SEQ ID NO: 20264 - DNA, 21 bp, Hordeum vulgare
ttttgccttgrctatctggct

SEQ ID NO: 20265 - DNA, 21 bp, Hordeum vulgare
acatttcagarttgtgtcact

SEQ ID NO: 20266 - DNA, 21 bp, Hordeum vulgare
tgacttcctaycttgtgaaat

SEQ ID NO: 20267 - DNA, 21 bp, Hordeum vulgare
ccaagttctcytactcttctc

SEQ ID NO: 20268 - DNA, 21 bp, Hordeum vulgare
aggtgcagttytacctaacat

SEQ ID NO: 20269 - DNA, 21 bp, Hordeum vulgare
tattcgctgcmctcgttggtc

SEQ ID NO: 20270 - DNA, 21 bp, Hordeum vulgare
tggcggcctcraccatgttgg

SEQ ID NO: 20271 - DNA, 21 bp, Hordeum vulgare
gaccgcagtcrgggttcaccc

SEQ ID NO: 20272 - DNA, 21 bp, Hordeum vulgare
tggcggcctcraccatgttgg

SEQ ID NO: 20273 - DNA, 21 bp, Hordeum vulgare
tctaatgaatsgccgcgacga

SEQ ID NO: 20274 - DNA, 21 bp, Hordeum vulgare
tgcaggggtgsttcacagtgc

SEQ ID NO: 20275 - DNA, 21 bp, Hordeum vulgare
tgacgcttgayagctcatcat

SEQ ID NO: 20276 - DNA, 21 bp, Hordeum vulgare
aggacccatgkgtgatgcatt

SEQ ID NO: 20277 - DNA, 21 bp, Hordeum vulgare
tgaagactagrctgacagcag

SEQ ID NO: 20278 - DNA, 21 bp, Hordeum vulgare
gtggtctgtcragtctcaaat

SEQ ID NO: 20279 - DNA, 21 bp, Hordeum vulgare
ctagcactcargttccgagga

SEQ ID NO: 20280 - DNA, 21 bp, Hordeum vulgare
cctgctaccgygaaagggccg

SEQ ID NO: 20281 - DNA, 21 bp, Hordeum vulgare
cgcccagccgwtatgcaatct

SEQ ID NO: 20282 - DNA, 21 bp, Hordeum vulgare
atatgatccayttttcatgat

SEQ ID NO: 20283 - DNA, 21 bp, Hordeum vulgare
tcatgtatacmgggaaggaag

SEQ ID NO: 20284 - DNA, 21 bp, Hordeum vulgare
acatgcatacwtgttataaat

SEQ ID NO: 20285 - DNA, 21 bp, Hordeum vulgare
gtatgtcgcawttgatctaaa

SEQ ID NO: 20286 - DNA, 21 bp, Hordeum vulgare
ctcgttatatytgtacaggtc

SEQ ID NO: 20287 - DNA, 21 bp, Hordeum vulgare
tattccagtamagtgatatta

SEQ ID NO: 20288 - DNA, 21 bp, Hordeum vulgare
agattgcagaygatttcaaat

SEQ ID NO: 20289 - DNA, 21 bp, Hordeum vulgare
aatgtgactamcatgtcagac

SEQ ID NO: 20290 - DNA, 21 bp, Hordeum vulgare
tgctcagccarcgccaagatc

SEQ ID NO: 20291 - DNA, 21 bp, Hordeum vulgare
ggctgctcctrgtcttaagaa

SEQ ID NO: 20292 - DNA, 21 bp, Hordeum vulgare
aaatgaaatarttggctgctc

SEQ ID NO: 20293 - DNA, 21 bp, Hordeum vulgare
gatgatggacmcccgggcggt

SEQ ID NO: 20294 - DNA, 21 bp, Hordeum vulgare
tcgtaagtggycgcagaacgt

SEQ ID NO: 20295 - DNA, 21 bp, Hordeum vulgare
acaagtgttcrtgttctggct

SEQ ID NO: 20296 - DNA, 21 bp, Hordeum vulgare
tacagtgtgargcctgcagtc

SEQ ID NO: 20297 - DNA, 21 bp, Hordeum vulgare
acaaattcaasgtctccagaa

SEQ ID NO: 20298 - DNA, 21 bp, Hordeum vulgare
tcttggggcawtaaaatatat

SEQ ID NO: 20299 - DNA, 21 bp, Hordeum vulgare
tgagatgaaakaacacacttt

SEQ ID NO: 20300 - DNA, 21 bp, Hordeum vulgare
ctttgaaggargttagttaaa

SEQ ID NO: 20301 - DNA, 21 bp, Hordeum vulgare
gcgatctgcargagcaccctg

SEQ ID NO: 20302 - DNA, 21 bp, Hordeum vulgare
actgacctgcsacggctccaa

SEQ ID NO: 20303 - DNA, 21 bp, Hordeum vulgare
tcctagcctcraggagtgaat

SEQ ID NO: 20304 - DNA, 21 bp, Hordeum vulgare
gaataagaaarcatttcttcc

SEQ ID NO: 20305 - DNA, 21 bp, Hordeum vulgare
gtgggtatgcrcttcccagct

SEQ ID NO: 20306 - DNA, 21 bp, Hordeum vulgare
gcccttcatckgaccacactt

SEQ ID NO: 20307 - DNA, 21 bp, Hordeum vulgare
aagtgctccakcctggtcttt

SEQ ID NO: 20308 - DNA, 21 bp, Hordeum vulgare
cacagcagggktccggccaag

SEQ ID NO: 20309 - DNA, 21 bp, Hordeum vulgare
agacgtcgccrtcgatgaagg

SEQ ID NO: 20310 - DNA, 21 bp, Hordeum vulgare
agaaaggtgcrtacataattg

SEQ ID NO: 20311 - DNA, 21 bp, Hordeum vulgare
ccttgtgaccktcatacatcg

SEQ ID NO: 20312 - DNA, 21 bp, Hordeum vulgare
aggtcacaatrggttgatcaa

SEQ ID NO: 20313 - DNA, 21 bp, Hordeum vulgare
gataagatacrtgacgactgt

SEQ ID NO: 20314 - DNA, 21 bp, Hordeum vulgare
aaaacaaacgktcggatgaat

SEQ ID NO: 20315 - DNA, 21 bp, Hordeum vulgare
acacgtagtartgcacgtcaa

SEQ ID NO: 20316 - DNA, 21 bp, Hordeum vulgare
gagatgtcatygaccgtgcat

SEQ ID NO: 20317 - DNA, 21 bp, Hordeum vulgare
aacacccccgygccttttcga

SEQ ID NO: 20318 - DNA, 21 bp, Hordeum vulgare
attgcgatgcrtaacgggata

SEQ ID NO: 20319 - DNA, 21 bp, Hordeum vulgare
cagtccgagcygcccccgccg

SEQ ID NO: 20320 - DNA, 21 bp, Hordeum vulgare
tgctagaatcmtgtatatggc

SEQ ID NO: 20321 - DNA, 21 bp, Hordeum vulgare
cactgtaaatkttcagcctat

SEQ ID NO: 20322 - DNA, 21 bp, Hordeum vulgare
atctgaaaaarggtgatgatt

SEQ ID NO: 20323 - DNA, 21 bp, Hordeum vulgare
tgttcttgtamtcggcaatgg

SEQ ID NO: 20324 - DNA, 21 bp, Hordeum vulgare
cgtcgtggtcsttctaccgcg

SEQ ID NO: 20325 - DNA, 21 bp, Hordeum vulgare
ctataagcatygtcaagtgaa

SEQ ID NO: 20326 - DNA, 21 bp, Hordeum vulgare
gcagacactgkggcaccagac

SEQ ID NO: 20327 - DNA, 21 bp, Hordeum vulgare
gaacgtgtcgkgaaacctcga

SEQ ID NO: 20328 - DNA, 21 bp, Hordeum vulgare
ctataatgtgraggtacatcc

SEQ ID NO: 20329 - DNA, 21 bp, Hordeum vulgare
gcatggtatcrcccgtatgcc

SEQ ID NO: 20330 - DNA, 21 bp, Hordeum vulgare
acttgcggagractgccgatc

SEQ ID NO: 20331 - DNA, 21 bp, Hordeum vulgare
tcgatttttasattgctataa

SEQ ID NO: 20332 - DNA, 21 bp, Hordeum vulgare
gataggtgaarcactgcatgg

SEQ ID NO: 20333 - DNA, 21 bp, Hordeum vulgare
tcactgctctscagatgaaac

SEQ ID NO: 20334 - DNA, 21 bp, Hordeum vulgare
gaaactgccarcacaaaagat

SEQ ID NO: 20335 - DNA, 21 bp, Hordeum vulgare
caaaagattgwttgcttattt

SEQ ID NO: 20336 - DNA, 21 bp, Hordeum vulgare
aagtcctaacmaaccagcaat

SEQ ID NO: 20337 - DNA, 21 bp, Hordeum vulgare
cataccaaatyaaatgttaca

SEQ ID NO: 20338 - DNA, 21 bp, Hordeum vulgare
ttcatatccaygaccccatta

SEQ ID NO: 20339 - DNA, 21 bp, Hordeum vulgare
attaccagtarataaatttct

SEQ ID NO: 20340 - DNA, 21 bp, Hordeum vulgare
gaaagcacttyccatctaact

SEQ ID NO: 20341 - DNA, 21 bp, Hordeum vulgare
tcaccatgggrtttgattcca

SEQ ID NO: 20342 - DNA, 21 bp, Hordeum vulgare
gaaatatatawagaacagagg

SEQ ID NO: 20343 - DNA, 21 bp, Hordeum vulgare
tccaaacagtycgatgccaaa

SEQ ID NO: 20344 - DNA, 21 bp, Hordeum vulgare
cttcagagcakcaatgcctct

SEQ ID NO: 20345 - DNA, 21 bp, Hordeum vulgare
gctcccaacarttctaaattc

SEQ ID NO: 20346 - DNA, 21 bp, Hordeum vulgare
tataagtcttytaagagattc

SEQ ID NO: 20347 - DNA, 21 bp, Hordeum vulgare
tctcttagtaraatctctaga

SEQ ID NO: 20348 - DNA, 21 bp, Hordeum vulgare
cattcaacgaragcgaagcca

SEQ ID NO: 20349 - DNA, 21 bp, Hordeum vulgare
ccttgggcacmgacgccgtca

SEQ ID NO: 20350 - DNA, 21 bp, Hordeum vulgare
caacagttgtracaaaagaga

SEQ ID NO: 20351 - DNA, 21 bp, Hordeum vulgare
tgtgtccttcmcaaaggagat

SEQ ID NO: 20352 - DNA, 21 bp, Hordeum vulgare
tcctgtggttycatacaggca

SEQ ID NO: 20353 - DNA, 21 bp, Hordeum vulgare
tatgctagttytctcgattgc

SEQ ID NO: 20354 - DNA, 21 bp, Hordeum vulgare
acagagccggsggacagaaac

SEQ ID NO: 20355 - DNA, 21 bp, Hordeum vulgare
gatgttcttgytactccgacg

SEQ ID NO: 20356 - DNA, 21 bp, Hordeum vulgare
ttcttaagttwatatacatct

SEQ ID NO: 20357 - DNA, 21 bp, Hordeum vulgare
aagaggtgtcygttggcaatg

SEQ ID NO: 20358 - DNA, 21 bp, Hordeum vulgare
cgagattgaaygaaagtaatg

SEQ ID NO: 20359 - DNA, 21 bp, Hordeum vulgare
gatcagtcttyatttctattg

SEQ ID NO: 20360 - DNA, 21 bp, Hordeum vulgare
gttcatccttrcttacattac

SEQ ID NO: 20361 - DNA, 21 bp, Hordeum vulgare
ggcaagttatsataaataata

SEQ ID NO: 20362 - DNA, 21 bp, Hordeum vulgare
cgatggaaacmagctcgccat

SEQ ID NO: 20363 - DNA, 21 bp, Hordeum vulgare
agaacaaggargctgagcgct

SEQ ID NO: 20364 - DNA, 21 bp, Hordeum vulgare
aaggtttacgktatgctatgc

SEQ ID NO: 20365 - DNA, 21 bp, Hordeum vulgare
attgaccttgktcttcttcag

SEQ ID NO: 20366 - DNA, 21 bp, Hordeum vulgare
ctgtgcagatwatgacttggc

SEQ ID NO: 20367 - DNA, 21 bp, Hordeum vulgare
aactatgcacmcaacatataa

SEQ ID NO: 20368 - DNA, 21 bp, Hordeum vulgare
tttattctatmaggctagatg

SEQ ID NO: 20369 - DNA, 21 bp, Hordeum vulgare
aacagcagcamaactaatcac

SEQ ID NO: 20370 - DNA, 21 bp, Hordeum vulgare
tcttcttcttygcctctcctc

SEQ ID NO: 20371 - DNA, 21 bp, Hordeum vulgare
acaggtcgctygcggccccgw

SEQ ID NO: 20372 - DNA, 21 bp, Hordeum vulgare
tgaacttggcrtagatgtcag

SEQ ID NO: 20373 - DNA, 21 bp, Hordeum vulgare
gtcgccggagwgggaaatgca

SEQ ID NO: 20374 - DNA, 21 bp, Hordeum vulgare
cgctggagccraaaacgggct

SEQ ID NO: 20375 - DNA, 21 bp, Hordeum vulgare
cacatagtgarctgaactctc

SEQ ID NO: 20376 - DNA, 21 bp, Hordeum vulgare
aggtggtggtrtcctaaattc

SEQ ID NO: 20377 - DNA, 21 bp, Hordeum vulgare
gaaatagagcwtacatgcaga

SEQ ID NO: 20378 - DNA, 21 bp, Hordeum vulgare
aattatttatytacgagagat

SEQ ID NO: 20379 - DNA, 21 bp, Hordeum vulgare
tctccatttcycatcacaacc

SEQ ID NO: 20380 - DNA, 21 bp, Hordeum vulgare
aagcaatcatkaccatgataa

SEQ ID NO: 20381 - DNA, 21 bp, Hordeum vulgare
tctgtcacgcrgccaaggcac

SEQ ID NO: 20382 - DNA, 21 bp, Hordeum vulgare
gatgaccattscaaacttctc

SEQ ID NO: 20383 - DNA, 21 bp, Hordeum vulgare
tctgaagctcratcttccccg

SEQ ID NO: 20384 - DNA, 21 bp, Hordeum vulgare
atctctctcarttttcctcca

SEQ ID NO: 20385 - DNA, 21 bp, Hordeum vulgare
tgtttgccggktcagctttgt

SEQ ID NO: 20386 - DNA, 21 bp, Hordeum vulgare
cagccaaagcrcagctcacca

SEQ ID NO: 20387 - DNA, 21 bp, Hordeum vulgare
gtatacaactwtaagcacgca

SEQ ID NO: 20388 - DNA, 21 bp, Hordeum vulgare
gttttctgacrgtagttgatg

SEQ ID NO: 20389 - DNA, 21 bp, Hordeum vulgare
catggttatcyctgtagtcgc

SEQ ID NO: 20390 - DNA, 21 bp, Hordeum vulgare
gtattgagcasagagaggtgg

SEQ ID NO: 20391 - DNA, 21 bp, Hordeum vulgare
gcatcatggcraccatagaaa

SEQ ID NO: 20392 - DNA, 21 bp, Hordeum vulgare
cacgtaccagytcattagcac

SEQ ID NO: 20393 - DNA, 21 bp, Hordeum vulgare
acttacaatcygcgacataaa

SEQ ID NO: 20394 - DNA, 21 bp, Hordeum vulgare
atatagatgtrtatgcatgta

SEQ ID NO: 20395 - DNA, 21 bp, Hordeum vulgare
tcatatggcarctctgtgagg

SEQ ID NO: 20396 - DNA, 21 bp, Hordeum vulgare
tttcctcatcrcacacgacgt

SEQ ID NO: 20397 - DNA, 21 bp, Hordeum vulgare
tgcataccgamggtggaagct

SEQ ID NO: 20398 - DNA, 20 bp, Hordeum vulgare
aaaagggtacgtttgatgta

SEQ ID NO: 20399 - DNA, 21 bp, Hordeum vulgare
aaaagggtaccgtttgatgta

SEQ ID NO: 20400 - DNA, 21 bp, Hordeum vulgare
  MISC_FEATURE (11): n is SNP, in which the one is t and the other is a or g or c
aggatcttggntataacctct

SEQ ID NO: 20401 - DNA, 20 bp, Hordeum vulgare
gtgcaatgcatttctacaaa

SEQ ID NO: 20402 - DNA, 21 bp, Hordeum vulgare
gtgcaatgcaatttctacaaa

SEQ ID NO: 20403 - DNA, 21 bp, Hordeum vulgare
aatatatataygttattagtc

SEQ ID NO: 20404 - DNA, 21 bp, Hordeum vulgare
agcatatattygaaagatgac

SEQ ID NO: 20405 - DNA, 21 bp, Hordeum vulgare
  MISC_FEATURE (11): n is SNP, in which the one is t and the other is a or g or c
cttgcttaggnggcatctatg

SEQ ID NO: 20406 - DNA, 21 bp, Hordeum vulgare
  MISC_FEATURE (11): n is SNP, in which the one is a and the other is t or g or c
gatagtctaanagatgcatga

SEQ ID NO: 20407 - DNA, 21 bp, Hordeum vulgare
actggaaatcsacaatgatat

SEQ ID NO: 20408 - DNA, 21 bp, Hordeum vulgare
tgtttacatcrtagattcagt

SEQ ID NO: 20409 - DNA, 21 bp, Hordeum vulgare
aggctagcgcrgctggaggca

SEQ ID NO: 20410 - DNA, 21 bp, Hordeum vulgare
acccagaaccraaccaaaact

SEQ ID NO: 20411 - DNA, 21 bp, Hordeum vulgare
gtccagtaccrtactcttcaa

SEQ ID NO: 20412 - DNA, 21 bp, Hordeum vulgare
agtgatgcctmctgagacgca

SEQ ID NO: 20413 - DNA, 21 bp, Hordeum vulgare
cgcctacgtcrggcaggccta

SEQ ID NO: 20414 - DNA, 21 bp, Hordeum vulgare
cggtggccgcrctccctgtac

SEQ ID NO: 20415 - DNA, 21 bp, Hordeum vulgare
tcaccaccttktgaaaatgct

SEQ ID NO: 20416 - DNA, 21 bp, Hordeum vulgare
acgaaatgagmcgccacagaa

SEQ ID NO: 20417 - DNA, 21 bp, Hordeum vulgare
atattttccamtatgtgttat

SEQ ID NO: 20418 - DNA, 21 bp, Hordeum vulgare
tatgaactgcrccatctagtg

SEQ ID NO: 20419 - DNA, 21 bp, Hordeum vulgare
ctgctgatttsacccaatccc

SEQ ID NO: 20420 - DNA, 21 bp, Hordeum vulgare
taaccaccgtrcctgtgggcc

SEQ ID NO: 20421 - DNA, 21 bp, Hordeum vulgare
agcatatattygaaagatgac

SEQ ID NO: 20422 - DNA, 21 bp, Hordeum vulgare
tgcaccggcgscaccgacaac

SEQ ID NO: 20423 - DNA, 21 bp, Hordeum vulgare
cgggaattttmaattttataa

SEQ ID NO: 20424 - DNA, 21 bp, Hordeum vulgare
gaggcgggatkttgatgtcaa

SEQ ID NO: 20425 - DNA, 21 bp, Hordeum vulgare
tatttccaagygtccttagtt

SEQ ID NO: 20426 - DNA, 21 bp, Hordeum vulgare
taactwgtgastcgagccatt

SEQ ID NO: 20427 - DNA, 21 bp, Hordeum vulgare
tggctttatcractttctcgc

SEQ ID NO: 20428 - DNA, 21 bp, Hordeum vulgare
  MISC_FEATURE (11): n is SNP, in which the one is g and the other is a or t or c
tgctcttgcanaagtgtgggg

SEQ ID NO: 20429 - DNA, 21 bp, Hordeum vulgare
aaacagaattraaggacacac

SEQ ID NO: 20430 - DNA, 21 bp, Hordeum vulgare
ccttgtcatgrtcctgaattc

SEQ ID NO: 20431 - DNA, 21 bp, Hordeum vulgare
acaaagtccgycgcagagctt

SEQ ID NO: 20432 - DNA, 21 bp, Hordeum vulgare
caaagacatcyggacgaacca

SEQ ID NO: 20433 - DNA, 21 bp, Hordeum vulgare
ggtgcccgcgrcaaatgcaaa

SEQ ID NO: 20434 - DNA, 21 bp, Hordeum vulgare
cacaagctgargctactaaaa

SEQ ID NO: 20435 - DNA, 21 bp, Hordeum vulgare
cccatgaccgrtacgactggg

SEQ ID NO: 20436 - DNA, 21 bp, Hordeum vulgare
  MISC_FEATURE (11): n is SNP, in which the one is c and the other is a or t or g
tggtgctcgcngggcggtagt

SEQ ID NO: 20437 - DNA, 21 bp, Hordeum vulgare
acagatggggrcgcaatgcaa

SEQ ID NO: 20438 - DNA, 21 bp, Hordeum vulgare
ctctgtagggrtgctgtggag

SEQ ID NO: 20439 - DNA, 21 bp, Hordeum vulgare
ggtgcccgcgrcaaatgcaaa

SEQ ID NO: 20440 - DNA, 21 bp, Hordeum vulgare
caacagggagmagcttttggc

SEQ ID NO: 20441 - DNA, 21 bp, Hordeum vulgare
aagaatactgsacctcgagac

SEQ ID NO: 20442 - DNA, 21 bp, Hordeum vulgare
tcagtgagctktttatgcctt

SEQ ID NO: 20443 - DNA, 21 bp, Hordeum vulgare
gcaacaagatygagaaatttg

SEQ ID NO: 20444 - DNA, 21 bp, Hordeum vulgare
taactgggatycgtttagttt

SEQ ID NO: 20445 - DNA, 21 bp, Hordeum vulgare
gctgatgaaaratagacagta

SEQ ID NO: 20446 - DNA, 21 bp, Hordeum vulgare
gattcgttctsctcaactcgt

SEQ ID NO: 20447 - DNA, 21 bp, Hordeum vulgare
gtctgcacacracttacaaag

SEQ ID NO: 20448 - DNA, 21 bp, Hordeum vulgare
ttcaccttgarttcttcgaac

SEQ ID NO: 20449 - DNA, 21 bp, Hordeum vulgare
catttctacgycgccttgtta

SEQ ID NO: 20450 - DNA, 21 bp, Hordeum vulgare
tgttatgtggygaaatagatg

SEQ ID NO: 20451 - DNA, 21 bp, Hordeum vulgare
agttaaatttytgtgcacagg

SEQ ID NO: 20452 - DNA, 21 bp, Hordeum vulgare
cgctgtgggakcagttaaatt

SEQ ID NO: 20453 - DNA, 21 bp, Hordeum vulgare
gccaagagtgrcactcgacaa

SEQ ID NO: 20454 - DNA, 21 bp, Hordeum vulgare
gctatattggkgctgactatc

SEQ ID NO: 20455 - DNA, 21 bp, Hordeum vulgare
gagcgcgctcratatgcttag

SEQ ID NO: 20456 - DNA, 21 bp, Hordeum vulgare
caaagtaagcsgctgaatatt

SEQ ID NO: 20457 - DNA, 21 bp, Hordeum vulgare
atgcaactctwaacacaaaat

SEQ ID NO: 20458 - DNA, 21 bp, Hordeum vulgare
ataatcagtcraccaaaattg

SEQ ID NO: 20459 - DNA, 21 bp, Hordeum vulgare
gaagcaggcgyttcgacaaaa

SEQ ID NO: 20460 - DNA, 21 bp, Hordeum vulgare
cccatgaccgrtacgactggg

SEQ ID NO: 20461 - DNA, 21 bp, Hordeum vulgare
ccacctatgartcgaatcttc

SEQ ID NO: 20462 - DNA, 21 bp, Hordeum vulgare
gccataacctytattatggac

SEQ ID NO: 20463 - DNA, 21 bp, Hordeum vulgare
cagaagaagcrgtggtttctc

SEQ ID NO: 20464 - DNA, 21 bp, Hordeum vulgare
ctatagcataktagccagacc

SEQ ID NO: 20465 - DNA, 21 bp, Hordeum vulgare
tatacctgtgstagatgtgtg

SEQ ID NO: 20466 - DNA, 21 bp, Hordeum vulgare
caactaccttyctgtcaagcc

SEQ ID NO: 20467 - DNA, 21 bp, Hordeum vulgare
ggcgcctcccrctgcacctcg

SEQ ID NO: 20468 - DNA, 21 bp, Hordeum vulgare
cacatgaagcygtgggcacgt

SEQ ID NO: 20469 - DNA, 21 bp, Hordeum vulgare
tattctttcarccttacatct

SEQ ID NO: 20470 - DNA, 21 bp, Hordeum vulgare
agcaccgcacrccaatgttac

SEQ ID NO: 20471 - DNA, 21 bp, Hordeum vulgare
caaggtagctytcagtgctgg

SEQ ID NO: 20472 - DNA, 21 bp, Hordeum vulgare
attaagctgawaggtctgact

SEQ ID NO: 20473 - DNA, 21 bp, Hordeum vulgare
tggtagagacraatcacatcg

SEQ ID NO: 20474 - DNA, 21 bp, Hordeum vulgare
tggtaaattcrtcaagattca

SEQ ID NO: 20475 - DNA, 21 bp, Hordeum vulgare
tctgagaaagyccgtcatctt

SEQ ID NO: 20476 - DNA, 21 bp, Hordeum vulgare
aagtgtcgaakctgtcttccc

SEQ ID NO: 20477 - DNA, 21 bp, Hordeum vulgare
ccgtttgtacytgtggtgcaa

SEQ ID NO: 20478 - DNA, 21 bp, Hordeum vulgare
tcttgtataarcaatgggcta

SEQ ID NO: 20479 - DNA, 21 bp, Hordeum vulgare
gtctcgccatkatgtgcagtt

SEQ ID NO: 20480 - DNA, 21 bp, Hordeum vulgare
atcctcatgawttcttcatag

SEQ ID NO: 20481 - DNA, 21 bp, Hordeum vulgare
actgcatgcawgtacatcatg

SEQ ID NO: 20482 - DNA, 21 bp, Hordeum vulgare
cgacgttacgktgtagaactg

SEQ ID NO: 20483 - DNA, 21 bp, Hordeum vulgare
caacctctgamatgggtcctg

SEQ ID NO: 20484 - DNA, 21 bp, Hordeum vulgare
ttcaaaccggraaccttgaaa

SEQ ID NO: 20485 - DNA, 21 bp, Hordeum vulgare
ctgccccatcraccaagcact

SEQ ID NO: 20486 - DNA, 21 bp, Hordeum vulgare
gcgttcccagycacgagtttc

SEQ ID NO: 20487 - DNA, 21 bp, Hordeum vulgare
ccaaatgcttsatatgagctt

SEQ ID NO: 20488 - DNA, 21 bp, Hordeum vulgare
atgccgatccraaagggacac

SEQ ID NO: 20489 - DNA, 21 bp, Hordeum vulgare
aaagggacacsaagcaggcaa

SEQ ID NO: 20490 - DNA, 21 bp, Hordeum vulgare
gtggaggaacytacaacctgg

SEQ ID NO: 20491 - DNA, 21 bp, Hordeum vulgare
agaaatacccrtttctggcaa

SEQ ID NO: 20492 - DNA, 21 bp, Hordeum vulgare
ctgcacgctargtggaggaac

SEQ ID NO: 20493 - DNA, 21 bp, Hordeum vulgare
tttaggggatyggttagagtt

SEQ ID NO: 20494 - DNA, 21 bp, Hordeum vulgare
caccgtatatsctggtatttc

SEQ ID NO: 20495 - DNA, 21 bp, Hordeum vulgare
cttggcaccartgtgacctgt

SEQ ID NO: 20496 - DNA, 21 bp, Hordeum vulgare
tgaatcaactscaaatctgag

SEQ ID NO: 20497 - DNA, 21 bp, Hordeum vulgare
tgttgcaggcraagtaaacct

SEQ ID NO: 20498 - DNA, 21 bp, Hordeum vulgare
catggtgccayaaacaagtat

SEQ ID NO: 20499 - DNA, 21 bp, Hordeum vulgare
ttacacgaagwatagcttcat

SEQ ID NO: 20500 - DNA, 21 bp, Hordeum vulgare
tgaagcaagtwtgagattgtc

SEQ ID NO: 20501 - DNA, 21 bp, Hordeum vulgare
cacaatgatgygatctgctaa

SEQ ID NO: 20502 - DNA, 21 bp, Hordeum vulgare
gtctagagtgragaaatacca

SEQ ID NO: 20503 - DNA, 21 bp, Hordeum vulgare
ccgtaagccawacttgcaaat

SEQ ID NO: 20504 - DNA, 21 bp, Hordeum vulgare
gcttgaatttraggagagcag

SEQ ID NO: 20505 - DNA, 21 bp, Hordeum vulgare
aagcaagccgktgaacacaat

SEQ ID NO: 20506 - DNA, 21 bp, Hordeum vulgare
tcgtgagatcsctggatctct

SEQ ID NO: 20507 - DNA, 21 bp, Hordeum vulgare
catcttgcaaygtgcgtgccc

SEQ ID NO: 20508 - DNA, 21 bp, Hordeum vulgare
tcatcaactarctaagctacg

SEQ ID NO: 20509 - DNA, 21 bp, Hordeum vulgare
agagccttgcrcagtgcctcc

SEQ ID NO: 20510 - DNA, 21 bp, Hordeum vulgare
ttgtaatgatktacaattttg

SEQ ID NO: 20511 - DNA, 21 bp, Hordeum vulgare
ttttgcacatytgattgcatc

SEQ ID NO: 20512 - DNA, 21 bp, Hordeum vulgare
tgcactatacrgtaaaagcca

SEQ ID NO: 20513 - DNA, 21 bp, Hordeum vulgare
gtgtacaactrctcccatcat

SEQ ID NO: 20514 - DNA, 21 bp, Hordeum vulgare
aacacacattkttttattcga

SEQ ID NO: 20515 - DNA, 21 bp, Hordeum vulgare
acttcttagarggaatgtctt

SEQ ID NO: 20516 - DNA, 21 bp, Hordeum vulgare
ctggtcgcaarcggcgctata

SEQ ID NO: 20517 - DNA, 21 bp, Hordeum vulgare
gtgttggcacmggcagcggca

SEQ ID NO: 20518 - DNA, 21 bp, Hordeum vulgare
gaaatgttttycgtcactatt

SEQ ID NO: 20519 - DNA, 21 bp, Hordeum vulgare
gtaggccagcrgctgcttctg

SEQ ID NO: 20520 - DNA, 21 bp, Hordeum vulgare
cctgtttgtargataactagg

SEQ ID NO: 20521 - DNA, 21 bp, Hordeum vulgare
tacctggcttmatgatctcag

SEQ ID NO: 20522 - DNA, 21 bp, Hordeum vulgare
tgccctcgtcrgcgttaatca

SEQ ID NO: 20523 - DNA, 21 bp, Hordeum vulgare
tgctgtccagycacccccaaa

SEQ ID NO: 20524 - DNA, 21 bp, Hordeum vulgare
gaaaaaaagartatggcagcc

SEQ ID NO: 20525 - DNA, 21 bp, Hordeum vulgare
gcaatcttacwaacaaaatca

SEQ ID NO: 20526 - DNA, 21 bp, Hordeum vulgare
agaaataggtmcttcgattat

SEQ ID NO: 20527 - DNA, 21 bp, Hordeum vulgare
gatgtatgaaraaccttggta

SEQ ID NO: 20528 - DNA, 21 bp, Hordeum vulgare
gtacggactawaacgttgcgc

SEQ ID NO: 20529 - DNA, 21 bp, Hordeum vulgare
gcttctagttytgttggtgag

SEQ ID NO: 20530 - DNA, 21 bp, Hordeum vulgare
gtcaatatgakagaaataggt

SEQ ID NO: 20531 - DNA, 21 bp, Hordeum vulgare
aggcatgccamactggagtat

SEQ ID NO: 20532 - DNA, 21 bp, Hordeum vulgare
atcaaccgtgmtctccaggtg

SEQ ID NO: 20533 - DNA, 21 bp, Hordeum vulgare
aacattctccrggacaatcct

SEQ ID NO: 20534 - DNA, 21 bp, Hordeum vulgare
agggagggctyggtagctgtg

SEQ ID NO: 20535 - DNA, 21 bp, Hordeum vulgare
accgcatgcgygtctacgtct

SEQ ID NO: 20536 - DNA, 21 bp, Hordeum vulgare
ggtgcataacwtccatctcga

SEQ ID NO: 20537 - DNA, 21 bp, Hordeum vulgare
agagagcatgracaggcatcg

SEQ ID NO: 20538 - DNA, 21 bp, Hordeum vulgare
atgtccgcggkgtcgtccagg

SEQ ID NO: 20539 - DNA, 21 bp, Hordeum vulgare
cgaagaccttygcctcagggt

SEQ ID NO: 20540 - DNA, 21 bp, Hordeum vulgare
ggatggactayctcaacccgg

SEQ ID NO: 20541 - DNA, 21 bp, Hordeum vulgare
ggggatctttyaccacaaact

SEQ ID NO: 20542 - DNA, 21 bp, Hordeum vulgare
catgagtgcgytgtgtcctga

SEQ ID NO: 20543 - DNA, 21 bp, Hordeum vulgare
tcatcgccacraatcacatga

SEQ ID NO: 20544 - DNA, 21 bp, Hordeum vulgare
catgagtgcgytgtgtcctga

SEQ ID NO: 20545 - DNA, 21 bp, Hordeum vulgare
  MISC_FEATURE (1),(4),(16),(17),(18),(19): n stands for any base
ncangacacarcgcannnnrg

SEQ ID NO: 20546 - DNA, 21 bp, Hordeum vulgare
catagacgatwcaatattaga

SEQ ID NO: 20547 - DNA, 21 bp, Hordeum vulgare
acacaacaccygagtgcacac

SEQ ID NO: 20548 - DNA, 21 bp, Hordeum vulgare
gacagttgttycattagaatt

SEQ ID NO: 20549 - DNA, 21 bp, Hordeum vulgare
ttagggcagamagtatggttg

SEQ ID NO: 20550 - DNA, 21 bp, Hordeum vulgare
ggcatgccacratccacatat

SEQ ID NO: 20551 - DNA, 21 bp, Hordeum vulgare
cttaataatamggcatgcatc

SEQ ID NO: 20552 - DNA, 21 bp, Hordeum vulgare
caaaaatgttkgagctccgtc

SEQ ID NO: 20553 - DNA, 21 bp, Hordeum vulgare
cgtcagcgatwaggatttcat

SEQ ID NO: 20554 - DNA, 21 bp, Hordeum vulgare
gtactgtataytgtcaccgta

SEQ ID NO: 20555 - DNA, 21 bp, Hordeum vulgare
ggggggatttstggcctgatg

SEQ ID NO: 20556 - DNA, 21 bp, Hordeum vulgare
agtacatcagyagctaaagca

SEQ ID NO: 20557 - DNA, 21 bp, Hordeum vulgare
gacagaaatgrtcgaacctgt

SEQ ID NO: 20558 - DNA, 21 bp, Hordeum vulgare
tgacaaagcawacagcactcc

SEQ ID NO: 20559 - DNA, 21 bp, Hordeum vulgare
tatcacagccraaatgagccc

SEQ ID NO: 20560 - DNA, 21 bp, Hordeum vulgare
tatcagacttytaatttctac

SEQ ID NO: 20561 - DNA, 21 bp, Hordeum vulgare
cccgggcgtcsgggactatct

SEQ ID NO: 20562 - DNA, 21 bp, Hordeum vulgare
tccagttgcgsttgagggtgg

SEQ ID NO: 20563 - DNA, 21 bp, Hordeum vulgare
agaaaagagtygacagattat

SEQ ID NO: 20564 - DNA, 21 bp, Hordeum vulgare
tggcattagaygagaaaaaga

SEQ ID NO: 20565 - DNA, 21 bp, Hordeum vulgare
agatggaggcyagcagcacgg

SEQ ID NO: 20566 - DNA, 21 bp, Hordeum vulgare
aatgaagccgrctcaagcact

SEQ ID NO: 20567 - DNA, 21 bp, Hordeum vulgare
atcagcgcccyttcttctacc

SEQ ID NO: 20568 - DNA, 21 bp, Hordeum vulgare
ggtcaactagsttcgtgttcc

SEQ ID NO: 20569 - DNA, 21 bp, Hordeum vulgare
ctctgtgaacygggctcctaa

SEQ ID NO: 20570 - DNA, 21 bp, Hordeum vulgare
cgcctttggckcccttgagag

SEQ ID NO: 20571 - DNA, 21 bp, Hordeum vulgare
acattgcttcyttacccatga

SEQ ID NO: 20572 - DNA, 21 bp, Hordeum vulgare
acctctctcargcccaagctc

SEQ ID NO: 20573 - DNA, 21 bp, Hordeum vulgare
taagtactccmtccatcccaa

SEQ ID NO: 20574 - DNA, 21 bp, Hordeum vulgare
taaagggttawttccattgac

SEQ ID NO: 20575 - DNA, 21 bp, Hordeum vulgare
atgaaggccarcaacgggcaa

SEQ ID NO: 20576 - DNA, 21 bp, Hordeum vulgare
ttaagtgactsaactttgtac

SEQ ID NO: 20577 - DNA, 21 bp, Hordeum vulgare
acttcttcacratgcagttcc

SEQ ID NO: 20578 - DNA, 21 bp, Hordeum vulgare
aggctcaaacrcgaattttaa

SEQ ID NO: 20579 - DNA, 21 bp, Hordeum vulgare
ggccgcacggygccgagaacc

SEQ ID NO: 20580 - DNA, 21 bp, Hordeum vulgare
ccctttcgttwtgacttccct

SEQ ID NO: 20581 - DNA, 21 bp, Hordeum vulgare
gagcaaggtaygtgtttccac

SEQ ID NO: 20582 - DNA, 21 bp, Hordeum vulgare
tgtaattgtasacaagattgg

SEQ ID NO: 20583 - DNA, 21 bp, Hordeum vulgare
acactatactytgcaatctga

SEQ ID NO: 20584 - DNA, 21 bp, Hordeum vulgare
gagcaattcaragaccacaga

SEQ ID NO: 20585 - DNA, 21 bp, Hordeum vulgare
gctgggtgcakggagtgatga

SEQ ID NO: 20586 - DNA, 21 bp, Hordeum vulgare
tgtagatagcmtggacatgag

SEQ ID NO: 20587 - DNA, 21 bp, Hordeum vulgare
ttgtggttatrgagatggtgg

SEQ ID NO: 20588 - DNA, 21 bp, Hordeum vulgare
atgacatgaakaggagcaatt

SEQ ID NO: 20589 - DNA, 21 bp, Hordeum vulgare
ctaggaaaatraatggggaac

SEQ ID NO: 20590 - DNA, 21 bp, Hordeum vulgare
cttcaccgggyctcagtgcac

SEQ ID NO: 20591 - DNA, 21 bp, Hordeum vulgare
cttcatgcctrtgacatcttt

SEQ ID NO: 20592 - DNA, 21 bp, Hordeum vulgare
ttgccatccakcctgcagggt

SEQ ID NO: 20593 - DNA, 21 bp, Hordeum vulgare
ctgcagctgtyttgtcctgtt

SEQ ID NO: 20594 - DNA, 21 bp, Hordeum vulgare
atttgggtgtygaaagctcag

SEQ ID NO: 20595 - DNA, 21 bp, Hordeum vulgare
cgtgggggtcrgccggcatga

SEQ ID NO: 20596 - DNA, 21 bp, Hordeum vulgare
agactttactytggtagtaat

SEQ ID NO: 20597 - DNA, 21 bp, Hordeum vulgare
tggcactattwatctctcagg

SEQ ID NO: 20598 - DNA, 21 bp, Hordeum vulgare
gtctctccatyaacctcaatg

SEQ ID NO: 20599 - DNA, 21 bp, Hordeum vulgare
gatcccaggcwtggaagttgt

SEQ ID NO: 20600 - DNA, 21 bp, Hordeum vulgare
gaactgcctcwgagctcttta

SEQ ID NO: 20601 - DNA, 21 bp, Hordeum vulgare
ggtcgccgtcrtcaggtgttg

SEQ ID NO: 20602 - DNA, 21 bp, Hordeum vulgare
ccaagcaacakttatctccac

SEQ ID NO: 20603 - DNA, 21 bp, Hordeum vulgare
tcaaaaccttyctgacttatg

SEQ ID NO: 20604 - DNA, 21 bp, Hordeum vulgare
tgctgaatttrcttggaaaga

SEQ ID NO: 20605 - DNA, 21 bp, Hordeum vulgare
tttacagatasaacttgcctc

SEQ ID NO: 20606 - DNA, 21 bp, Hordeum vulgare
ctagccttccwcctgatttta

SEQ ID NO: 20607 - DNA, 21 bp, Hordeum vulgare
attgtaccaarttgggtaagt

SEQ ID NO: 20608 - DNA, 21 bp, Hordeum vulgare
cacagatgaakaatcgttctt

SEQ ID NO: 20609 - DNA, 21 bp, Hordeum vulgare
attctcggtgygccgaagctt

SEQ ID NO: 20610 - DNA, 21 bp, Hordeum vulgare
ccagcagttayatatgacatg

SEQ ID NO: 20611 - DNA, 21 bp, Hordeum vulgare
atcatgctagycattttgggc

SEQ ID NO: 20612 - DNA, 21 bp, Hordeum vulgare
accacaaaatkgatttatgtt

SEQ ID NO: 20613 - DNA, 21 bp, Hordeum vulgare
agtttgatagwtcactggcta

SEQ ID NO: 20614 - DNA, 21 bp, Hordeum vulgare
tacgacgacgsgcagccttgg

SEQ ID NO: 20615 - DNA, 21 bp, Hordeum vulgare
cgatagtggayggccggaaga

SEQ ID NO: 20616 - DNA, 21 bp, Hordeum vulgare
acattgtcaayctccaggcct

SEQ ID NO: 20617 - DNA, 21 bp, Hordeum vulgare
ttcaagttgcraagcaagccg

SEQ ID NO: 20618 - DNA, 21 bp, Hordeum vulgare
tccagccaggraaacaccgtt

SEQ ID NO: 20619 - DNA, 21 bp, Hordeum vulgare
acttattcatygtggatacgt

SEQ ID NO: 20620 - DNA, 21 bp, Hordeum vulgare
ggtctgaattgtgggcaggca

SEQ ID NO: 20621 - DNA, 20 bp, Hordeum vulgare
ggtctgaatttgggcaggca

SEQ ID NO: 20622 - DNA, 21 bp, Hordeum vulgare
tacgacgacgsgcagccttgg

SEQ ID NO: 20623 - DNA, 21 bp, Hordeum vulgare
ataggcttttstcctgcccaa

SEQ ID NO: 20624 - DNA, 21 bp, Hordeum vulgare
aagacgggcaraacaagaggt

SEQ ID NO: 20625 - DNA, 21 bp, Hordeum vulgare
agtcttgataygatgaaactt

SEQ ID NO: 20626 - DNA, 21 bp, Hordeum vulgare
ttggtattagrgtttcaaaaa

SEQ ID NO: 20627 - DNA, 21 bp, Hordeum vulgare
aaattccccartgggaaaaca

SEQ ID NO: 20628 - DNA, 21 bp, Hordeum vulgare
cctactcggcyatgcaggggt

SEQ ID NO: 20629 - DNA, 21 bp, Hordeum vulgare
ccatacgtgtraattcgaatg

SEQ ID NO: 20630 - DNA, 21 bp, Hordeum vulgare
cctggctatastactcatctt

SEQ ID NO: 20631 - DNA, 21 bp, Hordeum vulgare
agcaactccarcatagcgttt

SEQ ID NO: 20632 - DNA, 21 bp, Hordeum vulgare
ctaatataatytggtgcgcag

SEQ ID NO: 20633 - DNA, 21 bp, Hordeum vulgare
aatgccctcgscttccagccc

SEQ ID NO: 20634 - DNA, 21 bp, Hordeum vulgare
tgctgtccagkagcgtctcct

SEQ ID NO: 20635 - DNA, 21 bp, Hordeum vulgare
ccatcctgcaraattcctgtc

SEQ ID NO: 20636 - DNA, 21 bp, Hordeum vulgare
cggtaataatygatgctgtcc

SEQ ID NO: 20637 - DNA, 21 bp, Hordeum vulgare
gcgtggtaggmgagttctgat

SEQ ID NO: 20638 - DNA, 21 bp, Hordeum vulgare
ctacatgggcyagccaagaag

SEQ ID NO: 20639 - DNA, 21 bp, Hordeum vulgare
agcacatacakacccctcgga

SEQ ID NO: 20640 - DNA, 21 bp, Hordeum vulgare
ggcatcttcgygggggagttc

SEQ ID NO: 20641 - DNA, 21 bp, Hordeum vulgare
ccgcagaactscggacgtaga

SEQ ID NO: 20642 - DNA, 21 bp, Hordeum vulgare
ctgagtgcaakaaacataaca

SEQ ID NO: 20643 - DNA, 21 bp, Hordeum vulgare
tggaagaaaawacaacaaaat

SEQ ID NO: 20644 - DNA, 21 bp, Hordeum vulgare
tggacgaacgyaactgcggcg

SEQ ID NO: 20645 - DNA, 21 bp, Hordeum vulgare
caggtgagtamagaagcacca

SEQ ID NO: 20646 - DNA, 21 bp, Hordeum vulgare
cactttggacmctaaatgccc

SEQ ID NO: 20647 - DNA, 21 bp, Hordeum vulgare
acattaatackatgatcagct

SEQ ID NO: 20648 - DNA, 21 bp, Hordeum vulgare
cgaaatcacakgatagatgaa

SEQ ID NO: 20649 - DNA, 21 bp, Hordeum vulgare
ggacgggtacwtcttcctcag

SEQ ID NO: 20650 - DNA, 21 bp, Hordeum vulgare
cggcggctccraacacggagc

SEQ ID NO: 20651 - DNA, 21 bp, Hordeum vulgare
cgacgcggccrcgtcgatggt

SEQ ID NO: 20652 - DNA, 21 bp, Hordeum vulgare
ccttgatgtcsactccggtcg

SEQ ID NO: 20653 - DNA, 21 bp, Hordeum vulgare
tgcttatgtcraagtacttgg

SEQ ID NO: 20654 - DNA, 21 bp, Hordeum vulgare
aggtctttgcatcacgcctgg

SEQ ID NO: 20655 - DNA, 20 bp, Hordeum vulgare
aggtctttgctcacgcctgg

SEQ ID NO: 20656 - DNA, 21 bp, Hordeum vulgare
cgtctttgtagaaggcacagc

SEQ ID NO: 20657 - DNA, 20 bp, Hordeum vulgare
cgtctttgtaaaggcacagc

SEQ ID NO: 20658 - DNA, 21 bp, Hordeum vulgare
tactaacttcytacatggcaa

SEQ ID NO: 20659 - DNA, 21 bp, Hordeum vulgare
atggcaatctycaagcagtgt

SEQ ID NO: 20660 - DNA, 21 bp, Hordeum vulgare
aaagggggcgrcgggttgaca

SEQ ID NO: 20661 - DNA, 21 bp, Hordeum vulgare
tgattgattcrgctgaaagta

SEQ ID NO: 20662 - DNA, 21 bp, Hordeum vulgare
cttctctccgragggcgtcaa

SEQ ID NO: 20663 - DNA, 21 bp, Hordeum vulgare
ctgatgatgtyttggcaagga

SEQ ID NO: 20664 - DNA, 21 bp, Hordeum vulgare
ggagtgcctcyggtacctcgt

SEQ ID NO: 20665 - DNA, 21 bp, Hordeum vulgare
ccatcctcctmttcgtgggct

SEQ ID NO: 20666 - DNA, 21 bp, Hordeum vulgare
tctaccgagasgaatggatcg

SEQ ID NO: 20667 - DNA, 21 bp, Hordeum vulgare
ttaggatcgaygagcaccggg

SEQ ID NO: 20668 - DNA, 21 bp, Hordeum vulgare
  MISC_FEATURE (17): n stands for any base
ctgcagccccctgcctncaga

SEQ ID NO: 20669 - DNA, 20 bp, Hordeum vulgare
  MISC_FEATURE (16): n stands for any base
ctgcagcccctgcctncaga

SEQ ID NO: 20670 - DNA, 21 bp, Hordeum vulgare
  MISC_FEATURE (11): n is SNP, in which the one is g and the other is a or t or c
tgctccagcgncttgaccacc

SEQ ID NO: 20671 - DNA, 21 bp, Hordeum vulgare
ttgagcttggscacctcgatg

SEQ ID NO: 20672 - DNA, 21 bp, Hordeum vulgare
tgcgggaggcrcgcgtgagga

SEQ ID NO: 20673 - DNA, 21 bp, Hordeum vulgare
cattattcttwtcatcaaatc

SEQ ID NO: 20674 - DNA, 21 bp, Hordeum vulgare
gatgcttctcwcctggctgta

SEQ ID NO: 20675 - DNA, 21 bp, Hordeum vulgare
atgggttggcragcaatcttt

SEQ ID NO: 20676 - DNA, 21 bp, Hordeum vulgare
gcatttggtgrcattgagctg

SEQ ID NO: 20677 - DNA, 21 bp, Hordeum vulgare
gcactcctatsacagcacaca

SEQ ID NO: 20678 - DNA, 21 bp, Hordeum vulgare
ggagaagaacracaaaaagca

SEQ ID NO: 20679 - DNA, 21 bp, Hordeum vulgare
tgttgctgttrgtttcagagc

SEQ ID NO: 20680 - DNA, 21 bp, Hordeum vulgare
tttaggtcaayaatcatctaa

SEQ ID NO: 20681 - DNA, 21 bp, Hordeum vulgare
tctgcttttcraagagatggt

SEQ ID NO: 20682 - DNA, 21 bp, Hordeum vulgare
ggcatgcgacrtcactcccgt

SEQ ID NO: 20683 - DNA, 21 bp, Hordeum vulgare
ccaccagctgytttccgacgt

SEQ ID NO: 20684 - DNA, 21 bp, Hordeum vulgare
  MISC_FEATURE (11),(15),(17): n is SNP, in which the one is a and the other is t or g or c
cggaaaatgcnggancnagga

SEQ ID NO: 20685 - DNA, 21 bp, Hordeum vulgare
atggaaattckcccacatctt

SEQ ID NO: 20686 - DNA, 21 bp, Hordeum vulgare
caatggcgaaractctgccat

SEQ ID NO: 20687 - DNA, 21 bp, Hordeum vulgare
aaaaagctgayaaagcgccag

SEQ ID NO: 20688 - DNA, 21 bp, Hordeum vulgare
tgttggcttgytgcagcatag

SEQ ID NO: 20689 - DNA, 21 bp, Hordeum vulgare
ataccatgtckatttggaagc

SEQ ID NO: 20690 - DNA, 21 bp, Hordeum vulgare
tttcccaaaasaaacgccaaa

SEQ ID NO: 20691 - DNA, 21 bp, Hordeum vulgare
tgtcacattcrtagcttgtac

SEQ ID NO: 20692 - DNA, 21 bp, Hordeum vulgare
atgaaatgacstgaccagcta

SEQ ID NO: 20693 - DNA, 21 bp, Hordeum vulgare
actgcaatcgrtagtactaca

SEQ ID NO: 20694 - DNA, 21 bp, Hordeum vulgare
tcggaggctcrtcagatcaga

SEQ ID NO: 20695 - DNA, 21 bp, Hordeum vulgare
cgcatcttccrcacggcggaa

SEQ ID NO: 20696 - DNA, 21 bp, Hordeum vulgare
agtagagtgcmaagtcctcgc

SEQ ID NO: 20697 - DNA, 21 bp, Hordeum vulgare
tttcttactcmtatgtcggtg

SEQ ID NO: 20698 - DNA, 21 bp, Hordeum vulgare
tccccataagmatcatcctcc

SEQ ID NO: 20699 - DNA, 20 bp, Hordeum vulgare
gatagttacttctgttatag

SEQ ID NO: 20700 - DNA, 21 bp, Hordeum vulgare
gatagttactgtctgttatag

SEQ ID NO: 20701 - DNA, 21 bp, Hordeum vulgare
  MISC_FEATURE (6),(11): n is SNP, in which the one is a and the other is t or g or c
tcttangagcnaatatcttca

SEQ ID NO: 20702 - DNA, 21 bp, Hordeum vulgare
tttggctatgrtccactccat

SEQ ID NO: 20703 - DNA, 21 bp, Hordeum vulgare
tcaagtggatraataactggg

SEQ ID NO: 20704 - DNA, 21 bp, Hordeum vulgare
tgttatacacrcgacaaagaa

SEQ ID NO: 20705 - DNA, 21 bp, Hordeum vulgare
aactgtaagcrgagagatgca

SEQ ID NO: 20706 - DNA, 21 bp, Hordeum vulgare
  MISC_FEATURE (11): n is SNP, in which the one is g and the other is a or t or c
gaaagtcagangagaccatca

SEQ ID NO: 20707 - DNA, 21 bp, Hordeum vulgare
ggttcttggcagactccggac

SEQ ID NO: 20708 - DNA, 20 bp, Hordeum vulgare
ggttcttggcgactccggac

SEQ ID NO: 20709 - DNA, 21 bp, Hordeum vulgare
atgcttgttaytgaagctaga

SEQ ID NO: 20710 - DNA, 21 bp, Hordeum vulgare
cctccctgtckaccggcatgt

SEQ ID NO: 20711 - DNA, 21 bp, Hordeum vulgare
caccaaatcgrcgcagcaagg

SEQ ID NO: 20712 - DNA, 21 bp, Hordeum vulgare
aaaggaactgytacggcgtca

SEQ ID NO: 20713 - DNA, 21 bp, Hordeum vulgare
tccagtatggkcggtacttgg

SEQ ID NO: 20714 - DNA, 21 bp, Hordeum vulgare
tgagaacctcracgatctcgc

SEQ ID NO: 20715 - DNA, 21 bp, Hordeum vulgare
ccacagaggcyacctcggtct

SEQ ID NO: 20716 - DNA, 21 bp, Hordeum vulgare
tacactctaargatgtctact

SEQ ID NO: 20717 - DNA, 21 bp, Hordeum vulgare
ccgcaattgaratagggctcc

SEQ ID NO: 20718 - DNA, 21 bp, Hordeum vulgare
ataaatgtgcrctaggaaatt

SEQ ID NO: 20719 - DNA, 21 bp, Hordeum vulgare
tgcgactcggytcctatggtg

SEQ ID NO: 20720 - DNA, 21 bp, Hordeum vulgare
agttatgtgasaagaaaagga

SEQ ID NO: 20721 - DNA, 21 bp, Hordeum vulgare
agtgctcacawcaactctccg

SEQ ID NO: 20722 - DNA, 21 bp, Hordeum vulgare
cataaccattmgaaatgtttc

SEQ ID NO: 20723 - DNA, 21 bp, Hordeum vulgare
gctcactctcrcgccgaagct

SEQ ID NO: 20724 - DNA, 21 bp, Hordeum vulgare
tcaagaagcaragcggaagta

SEQ ID NO: 20725 - DNA, 21 bp, Hordeum vulgare
tcttcttcccrgggacgtgga

SEQ ID NO: 20726 - DNA, 21 bp, Hordeum vulgare
atgaacagcawactcatcaca

SEQ ID NO: 20727 - DNA, 21 bp, Hordeum vulgare
agctcctgccrcattattgcc

SEQ ID NO: 20728 - DNA, 21 bp, Hordeum vulgare
acttgccgggracgaagttgg

SEQ ID NO: 20729 - DNA, 21 bp, Hordeum vulgare
tggtggcgaargcccaggcgt

SEQ ID NO: 20730 - DNA, 21 bp, Hordeum vulgare
tcacatgcaamatctatcagt

SEQ ID NO: 20731 - DNA, 21 bp, Hordeum vulgare
acttgccgggracgaagttgg

SEQ ID NO: 20732 - DNA, 21 bp, Hordeum vulgare
tggtggcgaargcccaggcgt

SEQ ID NO: 20733 - DNA, 21 bp, Hordeum vulgare
cgaagaagccraacatggaga

SEQ ID NO: 20734 - DNA, 21 bp, Hordeum vulgare
agcctccgaakccgtagaggg

SEQ ID NO: 20735 - DNA, 21 bp, Hordeum vulgare
tgagcacgccscgggtctcct

SEQ ID NO: 20736 - DNA, 21 bp, Hordeum vulgare
cgtccatggckgtgacggtct

SEQ ID NO: 20737 - DNA, 21 bp, Hordeum vulgare
ggcgcttggcrccgcccttgc

SEQ ID NO: 20738 - DNA, 21 bp, Hordeum vulgare
ctacgcctacyaatgttccat

SEQ ID NO: 20739 - DNA, 21 bp, Hordeum vulgare
tgttccatccrttcattcttg

SEQ ID NO: 20740 - DNA, 21 bp, Hordeum vulgare
gtacaattgtktggatcagtg

SEQ ID NO: 20741 - DNA, 21 bp, Hordeum vulgare
tgcagcccaakgtttggcatc

SEQ ID NO: 20742 - DNA, 21 bp, Hordeum vulgare
acactcatcamcctaccgaca

SEQ ID NO: 20743 - DNA, 21 bp, Hordeum vulgare
tcccaaagaaraagagcgcct

SEQ ID NO: 20744 - DNA, 21 bp, Hordeum vulgare
atatgatacaytaggcatcac

SEQ ID NO: 20745 - DNA, 21 bp, Hordeum vulgare
ccagagggagytcctataccc

SEQ ID NO: 20746 - DNA, 21 bp, Hordeum vulgare
tgagcacgccscgggtctcct

SEQ ID NO: 20747 - DNA, 21 bp, Hordeum vulgare
ttctgaatggycctttgacta

SEQ ID NO: 20748 - DNA, 21 bp, Hordeum vulgare
ttctgaatggycctttgacta

SEQ ID NO: 20749 - DNA, 21 bp, Hordeum vulgare
caatgctcacyttatctatgt

SEQ ID NO: 20750 - DNA, 21 bp, Hordeum vulgare
gcagctgcagcaagccatctt

SEQ ID NO: 20751 - DNA, 20 bp, Hordeum vulgare
gcagctgcagaagccatctt

SEQ ID NO: 20752 - DNA, 21 bp, Hordeum vulgare
  MISC_FEATURE (11): n is SNP, in which the one is c and the other is a or t or g
gtacccttttncatatgttgg

SEQ ID NO: 20753 - DNA, 21 bp, Hordeum vulgare
acgacaatggsaaccaacttt

SEQ ID NO: 20754 - DNA, 21 bp, Hordeum vulgare
gaatcaatcgktcataaagca

SEQ ID NO: 20755 - DNA, 21 bp, Hordeum vulgare
catcaccatcrtcactccctg

SEQ ID NO: 20756 - DNA, 21 bp, Hordeum vulgare
cctcagggtcrtcgtcctcat

SEQ ID NO: 20757 - DNA, 21 bp, Hordeum vulgare
gacggttaacycagcaaagga

SEQ ID NO: 20758 - DNA, 21 bp, Hordeum vulgare
caacaggggcmtgatccccac

SEQ ID NO: 20759 - DNA, 21 bp, Hordeum vulgare
atcatcggttygtcataaact

SEQ ID NO: 20760 - DNA, 21 bp, Hordeum vulgare
gcacgccacasagtccatatg

SEQ ID NO: 20761 - DNA, 21 bp, Hordeum vulgare
ggctcatcacrcacaggatac

SEQ ID NO: 20762 - DNA, 21 bp, Hordeum vulgare
ggtgctcctcygaccaccacg

SEQ ID NO: 20763 - DNA, 21 bp, Hordeum vulgare
ggctcatcacrcacaggatac

SEQ ID NO: 20764 - DNA, 21 bp, Hordeum vulgare
tatttgaatcrcaaacaaaca

SEQ ID NO: 20765 - DNA, 21 bp, Hordeum vulgare
gccggcatgaraagcttcccc

SEQ ID NO: 20766 - DNA, 21 bp, Hordeum vulgare
tattgaaattytaaaaatgtg

SEQ ID NO: 20767 - DNA, 21 bp, Hordeum vulgare
ccgcttatttwttttttctcc

SEQ ID NO: 20768 - DNA, 21 bp, Hordeum vulgare
acacacaaacragtgccggtt

SEQ ID NO: 20769 - DNA, 21 bp, Hordeum vulgare
tggccatgacratgttatcgg

SEQ ID NO: 20770 - DNA, 21 bp, Hordeum vulgare
tcagtcttcaragcgcggctt

SEQ ID NO: 20771 - DNA, 21 bp, Hordeum vulgare
tctcctccacraacttgtcca

SEQ ID NO: 20772 - DNA, 21 bp, Hordeum vulgare
tcaaatgattyctaaactaac

SEQ ID NO: 20773 - DNA, 21 bp, Hordeum vulgare
tgccatgctcrctgaacagct

SEQ ID NO: 20774 - DNA, 21 bp, Hordeum vulgare
tttatcccagytggtgcgcat

SEQ ID NO: 20775 - DNA, 21 bp, Hordeum vulgare
gtgtggcagcrgcactggagg

SEQ ID NO: 20776 - DNA, 21 bp, Hordeum vulgare
acattatggtrtgccggcaac

SEQ ID NO: 20777 - DNA, 21 bp, Hordeum vulgare
gtgtggcagcrgcactggagg

SEQ ID NO: 20778 - DNA, 21 bp, Hordeum vulgare
caccgtgcctsattgtacact

SEQ ID NO: 20779 - DNA, 21 bp, Hordeum vulgare
agggcctctaytatggcatct

SEQ ID NO: 20780 - DNA, 21 bp, Hordeum vulgare
acagaaaagayaatcagcctt

SEQ ID NO: 20781 - DNA, 21 bp, Hordeum vulgare
tcttctctcaragaactgcca

SEQ ID NO: 20782 - DNA, 21 bp, Hordeum vulgare
tctgatagctkaaaaaatgta

SEQ ID NO: 20783 - DNA, 21 bp, Hordeum vulgare
tcaaagacatmgagccttgtt

SEQ ID NO: 20784 - DNA, 21 bp, Hordeum vulgare
gagattcttgygatcccctct

SEQ ID NO: 20785 - DNA, 21 bp, Hordeum vulgare
tgattaaacaraatatcagta

SEQ ID NO: 20786 - DNA, 21 bp, Hordeum vulgare
aaagtttccayaataacaaca

SEQ ID NO: 20787 - DNA, 21 bp, Hordeum vulgare
tctacaaagtycactatccat

SEQ ID NO: 20788 - DNA, 21 bp, Hordeum vulgare
gtggctaatcmctaatcctgc

SEQ ID NO: 20789 - DNA, 21 bp, Hordeum vulgare
aatccacatcwaggatgcctc

SEQ ID NO: 20790 - DNA, 21 bp, Hordeum vulgare
ttcttttaagytaaaagtggg

SEQ ID NO: 20791 - DNA, 21 bp, Hordeum vulgare
agctctggggygcagatttcc

SEQ ID NO: 20792 - DNA, 21 bp, Hordeum vulgare
gtcattcatcytctcttttga

SEQ ID NO: 20793 - DNA, 21 bp, Hordeum vulgare
gaacggcctcragagccttgc

SEQ ID NO: 20794 - DNA, 21 bp, Hordeum vulgare
gtttgccgacmatacctcttg

SEQ ID NO: 20795 - DNA, 21 bp, Hordeum vulgare
cgtcatcctcrtcatcgtcgg

SEQ ID NO: 20796 - DNA, 21 bp, Hordeum vulgare
accttcttgtraactgcttcc

SEQ ID NO: 20797 - DNA, 21 bp, Hordeum vulgare
gctaacaacarggttgaaaca

SEQ ID NO: 20798 - DNA, 21 bp, Hordeum vulgare
aatgcctagcmatcagaatca

SEQ ID NO: 20799 - DNA, 21 bp, Hordeum vulgare
tctgcaagaaytgtatttcta

SEQ ID NO: 20800 - DNA, 21 bp, Hordeum vulgare
ttaagttccgyaaaaatgtac

SEQ ID NO: 20801 - DNA, 21 bp, Hordeum vulgare
tggctggcgtytgacatatcc

SEQ ID NO: 20802 - DNA, 21 bp, Hordeum vulgare
cccatgaaagmagctccagtc

SEQ ID NO: 20803 - DNA, 21 bp, Hordeum vulgare
agtaaatgcaracttctgata

SEQ ID NO: 20804 - DNA, 21 bp, Hordeum vulgare
gcattaagcamacctctcccg

SEQ ID NO: 20805 - DNA, 21 bp, Hordeum vulgare
ggattagcaascgaacacgat

SEQ ID NO: 20806 - DNA, 21 bp, Hordeum vulgare
ccagatcatcracttcagcgg

SEQ ID NO: 20807 - DNA, 21 bp, Hordeum vulgare
tactagttttktatataaaac

SEQ ID NO: 20808 - DNA, 21 bp, Hordeum vulgare
atataaaacgktcacgtagca

SEQ ID NO: 20809 - DNA, 21 bp, Hordeum vulgare
aggtcattgcrcggcccttcg

SEQ ID NO: 20810 - DNA, 21 bp, Hordeum vulgare
cgaatggcttyaacgacctta

SEQ ID NO: 20811 - DNA, 21 bp, Hordeum vulgare
ttgagacggakgaagtattac

SEQ ID NO: 20812 - DNA, 21 bp, Hordeum vulgare
acttatatagyactccctccg

SEQ ID NO: 20813 - DNA, 21 bp, Hordeum vulgare
aactgaaaacyccagccttcc

SEQ ID NO: 20814 - DNA, 21 bp, Hordeum vulgare
actgtgatggytcagcagcct

SEQ ID NO: 20815 - DNA, 21 bp, Hordeum vulgare
cctagtagtaygcaaaaacac

SEQ ID NO: 20816 - DNA, 21 bp, Hordeum vulgare
tcatacgaccygacacctaaa

SEQ ID NO: 20817 - DNA, 21 bp, Hordeum vulgare
ttgctcttacwatcgtattta

SEQ ID NO: 20818 - DNA, 21 bp, Hordeum vulgare
cgagctgcttmgtccagtcga

SEQ ID NO: 20819 - DNA, 21 bp, Hordeum vulgare
aacggggcgcragagtgaagt

SEQ ID NO: 20820 - DNA, 21 bp, Hordeum vulgare
cggggatgatrtagtctttat

SEQ ID NO: 20821 - DNA, 21 bp, Hordeum vulgare
ggcaatgctgytctttgtagt

SEQ ID NO: 20822 - DNA, 21 bp, Hordeum vulgare
gcccagacgtyccccaacacg

SEQ ID NO: 20823 - DNA, 21 bp, Hordeum vulgare
ttttatctggrgaaggataaa

SEQ ID NO: 20824 - DNA, 21 bp, Hordeum vulgare
ctgagctgaargtgcagcagc

SEQ ID NO: 20825 - DNA, 21 bp, Hordeum vulgare
gttccttggtmgtcaatcgtc

SEQ ID NO: 20826 - DNA, 21 bp, Hordeum vulgare
tagcaccaacrcggccattcg

SEQ ID NO: 20827 - DNA, 21 bp, Hordeum vulgare
tcaggttgtcrccgaacgtct

SEQ ID NO: 20828 - DNA, 21 bp, Hordeum vulgare
aaagatctggrggcgaggctc

SEQ ID NO: 20829 - DNA, 21 bp, Hordeum vulgare
tagtatagccmcactactgac

SEQ ID NO: 20830 - DNA, 21 bp, Hordeum vulgare
tgtcccttgcraagcaggctg

SEQ ID NO: 20831 - DNA, 21 bp, Hordeum vulgare
ggacaccacasagagttagat

SEQ ID NO: 20832 - DNA, 21 bp, Hordeum vulgare
ctctcgcctgycgccgctggg

SEQ ID NO: 20833 - DNA, 21 bp, Hordeum vulgare
acaccaattcraaagatggtt

SEQ ID NO: 20834 - DNA, 21 bp, Hordeum vulgare
ccatccacagkggaagcgccg

SEQ ID NO: 20835 - DNA, 21 bp, Hordeum vulgare
actactttagyaatctaaacg

SEQ ID NO: 20836 - DNA, 21 bp, Hordeum vulgare
ctgcgacaggsggagcatccc

SEQ ID NO: 20837 - DNA, 21 bp, Hordeum vulgare
ccgtgtagatrccgtcgcgct

SEQ ID NO: 20838 - DNA, 21 bp, Hordeum vulgare
ccacgatctgsccctcggaga

SEQ ID NO: 20839 - DNA, 21 bp, Hordeum vulgare
gtagatcacayaaattttgtt

SEQ ID NO: 20840 - DNA, 21 bp, Hordeum vulgare
aatcctggagkcgactgatgt

SEQ ID NO: 20841 - DNA, 21 bp, Hordeum vulgare
catcatgatayatgtcttggt

SEQ ID NO: 20842 - DNA, 21 bp, Hordeum vulgare
gacagatttawaagaagtttt

SEQ ID NO: 20843 - DNA, 21 bp, Hordeum vulgare
gccggcccgayggagctcgtc

SEQ ID NO: 20844 - DNA, 21 bp, Hordeum vulgare
gtaacacagawcgagtacccc

SEQ ID NO: 20845 - DNA, 21 bp, Hordeum vulgare
catcggtgttygacttaccat

SEQ ID NO: 20846 - DNA, 21 bp, Hordeum vulgare
gaattgtttcrgccttctttt

SEQ ID NO: 20847 - DNA, 21 bp, Hordeum vulgare
ccaggttcggsgccgacccgg

SEQ ID NO: 20848 - DNA, 21 bp, Hordeum vulgare
agagaacatcrgtgatgctct

SEQ ID NO: 20849 - DNA, 21 bp, Hordeum vulgare
cgcagaaacgrctctaacaac

SEQ ID NO: 20850 - DNA, 21 bp, Hordeum vulgare
ggttcagaacsgtggaggatt

SEQ ID NO: 20851 - DNA, 21 bp, Hordeum vulgare
catcaggcatstgcagatagt

SEQ ID NO: 20852 - DNA, 21 bp, Hordeum vulgare
tcggacggtartacttgttgg

SEQ ID NO: 20853 - DNA, 21 bp, Hordeum vulgare
cttcttttgcrctgcatctca

SEQ ID NO: 20854 - DNA, 21 bp, Hordeum vulgare
acttcaagtgsaatcgtgcta

SEQ ID NO: 20855 - DNA, 21 bp, Hordeum vulgare
cgcccttgatsacaccaacag

SEQ ID NO: 20856 - DNA, 21 bp, Hordeum vulgare
catggtcaaamctttgtgccc

SEQ ID NO: 20857 - DNA, 21 bp, Hordeum vulgare
tgtggaagttygagaccacca

SEQ ID NO: 20858 - DNA, 21 bp, Hordeum vulgare
tcgctcaccckgcggaacatc

SEQ ID NO: 20859 - DNA, 21 bp, Hordeum vulgare
tccatctcgtmcatgccctcg

SEQ ID NO: 20860 - DNA, 21 bp, Hordeum vulgare
actcggcgacraggtcgttca

SEQ ID NO: 20861 - DNA, 21 bp, Hordeum vulgare
gagcggagcgmatccgttgcc

SEQ ID NO: 20862 - DNA, 21 bp, Hordeum vulgare
catatagctgmacggagcgga

SEQ ID NO: 20863 - DNA, 21 bp, Hordeum vulgare
tttatgatcaygaatttacaa

SEQ ID NO: 20864 - DNA, 21 bp, Hordeum vulgare
tatcttgaagkgtcccaaatt

SEQ ID NO: 20865 - DNA, 21 bp, Hordeum vulgare
gaagccatgakttcattcatt

SEQ ID NO: 20866 - DNA, 21 bp, Hordeum vulgare
aataccttgtytacagagtac

SEQ ID NO: 20867 - DNA, 21 bp, Hordeum vulgare
tacacaaacaracacaaggct

SEQ ID NO: 20868 - DNA, 21 bp, Hordeum vulgare
tccatcggtcragcattcctg

SEQ ID NO: 20869 - DNA, 21 bp, Hordeum vulgare
cagttggactygcgcagaaat

SEQ ID NO: 20870 - DNA, 21 bp, Hordeum vulgare
gcaatgaacamtgccagtgcc

SEQ ID NO: 20871 - DNA, 21 bp, Hordeum vulgare
agaggatcttytcaggcacac

SEQ ID NO: 20872 - DNA, 21 bp, Hordeum vulgare
ggccatcacasgatgaatgcc

SEQ ID NO: 20873 - DNA, 21 bp, Hordeum vulgare
gaataaaaagkctcagtccaa

SEQ ID NO: 20874 - DNA, 21 bp, Hordeum vulgare
tgctctctcastcggggtgat

SEQ ID NO: 20875 - DNA, 21 bp, Hordeum vulgare
aagatttcgtygratagcctg

SEQ ID NO: 20876 - DNA, 21 bp, Hordeum vulgare
gatttcgtygratagcctgaa

SEQ ID NO: 20877 - DNA, 21 bp, Hordeum vulgare
caaatatatgkgattgatgca

SEQ ID NO: 20878 - DNA, 21 bp, Hordeum vulgare
tgaagatgcamatattactaa

SEQ ID NO: 20879 - DNA, 21 bp, Hordeum vulgare
gggaaagagcrgccaaaagtt

SEQ ID NO: 20880 - DNA, 21 bp, Hordeum vulgare
ctggagatcarcagtaagtat

SEQ ID NO: 20881 - DNA, 21 bp, Hordeum vulgare
agatatctgtrttcttgacat

SEQ ID NO: 20882 - DNA, 21 bp, Hordeum vulgare
agttttttcargagctgcgac

SEQ ID NO: 20883 - DNA, 21 bp, Hordeum vulgare
tggaagttcamatcaaggaca

SEQ ID NO: 20884 - DNA, 21 bp, Hordeum vulgare
cggggaaaacmaccgtgaagt

SEQ ID NO: 20885 - DNA, 21 bp, Hordeum vulgare
cactggtccargctcagcgag

SEQ ID NO: 20886 - DNA, 21 bp, Hordeum vulgare
gctccatgtcygtgtactgcg

SEQ ID NO: 20887 - DNA, 21 bp, Hordeum vulgare
caatgtctatrtcgtaggcca

SEQ ID NO: 20888 - DNA, 21 bp, Hordeum vulgare
gctgctgctgytgcctccgca

SEQ ID NO: 20889 - DNA, 21 bp, Hordeum vulgare
tatagatagcygaacaattgc

SEQ ID NO: 20890 - DNA, 21 bp, Hordeum vulgare
cggggaaaacmaccgtgaagt

SEQ ID NO: 20891 - DNA, 21 bp, Hordeum vulgare
agaggtcgtcrgccttccgct

SEQ ID NO: 20892 - DNA, 21 bp, Hordeum vulgare
cactggtccargctcagcgag

SEQ ID NO: 20893 - DNA, 21 bp, Hordeum vulgare
tcagtttgaayatataccaaa

SEQ ID NO: 20894 - DNA, 21 bp, Hordeum vulgare
tgytgttgctyttgttggtgt

SEQ ID NO: 20895 - DNA, 21 bp, Hordeum vulgare
gctgttgttgytgttgctytt

SEQ ID NO: 20896 - DNA, 21 bp, Hordeum vulgare
cagactagctsaaatggtgaa

SEQ ID NO: 20897 - DNA, 21 bp, Hordeum vulgare
cattgtcttcygcagcagatt

SEQ ID NO: 20898 - DNA, 21 bp, Hordeum vulgare
atcctgttgcrcccgccttct

SEQ ID NO: 20899 - DNA, 21 bp, Hordeum vulgare
ggtaaactaarcggggcatat

SEQ ID NO: 20900 - DNA, 21 bp, Hordeum vulgare
ttgccttgccktgctgttaga

SEQ ID NO: 20901 - DNA, 21 bp, Hordeum vulgare
  MISC_FEATURE (12),(13): n stands for any base
gctctcatgcknngacctcaa

SEQ ID NO: 20902 - DNA, 21 bp, Hordeum vulgare
taaatcaagcrgacgaggctc

SEQ ID NO: 20903 - DNA, 21 bp, Hordeum vulgare
cggcagcccasatgtactcat

SEQ ID NO: 20904 - DNA, 21 bp, Hordeum vulgare
atcagattcakgaacaggttg

SEQ ID NO: 20905 - DNA, 21 bp, Hordeum vulgare
aggcataagawatcgctcaca

SEQ ID NO: 20906 - DNA, 21 bp, Hordeum vulgare
atttgctcggygctctttttg

SEQ ID NO: 20907 - DNA, 21 bp, Hordeum vulgare
tacattcgttyaaaaattctt

SEQ ID NO: 20908 - DNA, 21 bp, Hordeum vulgare
atacaagaccygagataaacc

SEQ ID NO: 20909 - DNA, 21 bp, Hordeum vulgare
ggcgacggtgrcggcggtgat

SEQ ID NO: 20910 - DNA, 21 bp, Hordeum vulgare
ttgttcattayacatactaac

SEQ ID NO: 20911 - DNA, 21 bp, Hordeum vulgare
tcaagaacccracctggagaa

SEQ ID NO: 20912 - DNA, 21 bp, Hordeum vulgare
atcatgctgcracggtcagct

SEQ ID NO: 20913 - DNA, 21 bp, Hordeum vulgare
tgtttccggtrtctctgctgc

SEQ ID NO: 20914 - DNA, 21 bp, Hordeum vulgare
attatcacttwagtggatagt

SEQ ID NO: 20915 - DNA, 21 bp, Hordeum vulgare
atagtgaatgwatgcgcaaag

SEQ ID NO: 20916 - DNA, 21 bp, Hordeum vulgare
tgagtgagttrctgagataaa

SEQ ID NO: 20917 - DNA, 21 bp, Hordeum vulgare
attttgaattrtttaaaatat

SEQ ID NO: 20918 - DNA, 21 bp, Hordeum vulgare
agccatatccrtctgcagtca

SEQ ID NO: 20919 - DNA, 21 bp, Hordeum vulgare
gcgtaccatayaggcgaggcg

SEQ ID NO: 20920 - DNA, 21 bp, Hordeum vulgare
gataatagccrccaacaggag

SEQ ID NO: 20921 - DNA, 21 bp, Hordeum vulgare
ggaggtacacrtgcaaaacct

SEQ ID NO: 20922 - DNA, 21 bp, Hordeum vulgare
ctacacgcttycgtgtcagcg

SEQ ID NO: 20923 - DNA, 21 bp, Hordeum vulgare
agcgtttagaycgggttgccg

SEQ ID NO: 20924 - DNA, 21 bp, Hordeum vulgare
aacaagaatasattcaacctg

SEQ ID NO: 20925 - DNA, 21 bp, Hordeum vulgare
cgagcccggcrtactgcacga

SEQ ID NO: 20926 - DNA, 21 bp, Hordeum vulgare
gtacacctatrctacaaggac

SEQ ID NO: 20927 - DNA, 21 bp, Hordeum vulgare
  MISC_FEATURE (5): n stands for any base
cctcnacggcrcccatgagca

SEQ ID NO: 20928 - DNA, 21 bp, Hordeum vulgare
  MISC_FEATURE (2),(11),(17): n is SNP, in which the one is g and the other is a or t or c
cngggtcgtcngcaagnccga

SEQ ID NO: 20929 - DNA, 21 bp, Hordeum vulgare
  MISC_FEATURE (11): n is SNP, in which the one is c and the other is a or t or g
ctgggtatagngggtcaacaa

SEQ ID NO: 20930 - DNA, 21 bp, Hordeum vulgare
  MISC_FEATURE (20): n stands for any base
gagctcagcagaatgcctcng

SEQ ID NO: 20931 - DNA, 20 bp, Hordeum vulgare
  MISC_FEATURE (19): n stands for any base
gagctcagcaaatgcctcng

SEQ ID NO: 20932 - DNA, 21 bp, Hordeum vulgare
gtggtcctccrgcaatgcggt

SEQ ID NO: 20933 - DNA, 21 bp, Hordeum vulgare
aactaatcagmttaacaattg

SEQ ID NO: 20934 - DNA, 21 bp, Hordeum vulgare
aagttcccatytgagtgtctg

SEQ ID NO: 20935 - DNA, 21 bp, Hordeum vulgare
acggcatgcgktcagtgtctc

SEQ ID NO: 20936 - DNA, 21 bp, Hordeum vulgare
cctttgagttkgccatacact

SEQ ID NO: 20937 - DNA, 21 bp, Hordeum vulgare
ctacgtatctwtcctcgtacc

SEQ ID NO: 20938 - DNA, 21 bp, Hordeum vulgare
tcagcagacartgcgtgtacg

SEQ ID NO: 20939 - DNA, 21 bp, Hordeum vulgare
tgcctcctctkgcgagagatc

SEQ ID NO: 20940 - DNA, 21 bp, Hordeum vulgare
gtgcattgtcwccccgccttg

SEQ ID NO: 20941 - DNA, 21 bp, Hordeum vulgare
gctacactttkttgttacaaa

SEQ ID NO: 20942 - DNA, 21 bp, Hordeum vulgare
tccttacttaracataatgaa

SEQ ID NO: 20943 - DNA, 21 bp, Hordeum vulgare
gatcatggacrcaacataaac

SEQ ID NO: 20944 - DNA, 21 bp, Hordeum vulgare
tacaacatggyatcgtatcct

SEQ ID NO: 20945 - DNA, 21 bp, Hordeum vulgare
tttagcagacmaagtgaagag

SEQ ID NO: 20946 - DNA, 21 bp, Hordeum vulgare
aaacatcggcrgtcatgaact

SEQ ID NO: 20947 - DNA, 21 bp, Hordeum vulgare
tgtacgatgcrtgttagaacg

SEQ ID NO: 20948 - DNA, 21 bp, Hordeum vulgare
actcagcaagrtatcaaataa

SEQ ID NO: 20949 - DNA, 21 bp, Hordeum vulgare
ccttggtcttmttcgaatata

SEQ ID NO: 20950 - DNA, 21 bp, Hordeum vulgare
tacagcaaccraagctgggcc

SEQ ID NO: 20951 - DNA, 21 bp, Hordeum vulgare
ggggctctcayggatgtcggt

SEQ ID NO: 20952 - DNA, 21 bp, Hordeum vulgare
tcaagtttccmctagaggccc

SEQ ID NO: 20953 - DNA, 21 bp, Hordeum vulgare
agctaggaagyaaatatgtgt

SEQ ID NO: 20954 - DNA, 21 bp, Hordeum vulgare
gccggaccggmtgtggaagcc

SEQ ID NO: 20955 - DNA, 21 bp, Hordeum vulgare
tgaaacttaaytgaggtagac

SEQ ID NO: 20956 - DNA, 21 bp, Hordeum vulgare
agtaaataaawcagaatgcct

SEQ ID NO: 20957 - DNA, 21 bp, Hordeum vulgare
catactgcagrgcctatttta

SEQ ID NO: 20958 - DNA, 21 bp, Hordeum vulgare
ccagtcatcaactatgtctat

SEQ ID NO: 20959 - DNA, 20 bp, Hordeum vulgare
ccagtcatcactatgtctat

SEQ ID NO: 20960 - DNA, 21 bp, Hordeum vulgare
atctatccaccacccagtcat

SEQ ID NO: 20961 - DNA, 20 bp, Hordeum vulgare
atctatccacacccagtcat

SEQ ID NO: 20962 - DNA, 21 bp, Hordeum vulgare
ggtcccgagaatagtgcggat

SEQ ID NO: 20963 - DNA, 20 bp, Hordeum vulgare
ggtcccgagatagtgcggat

SEQ ID NO: 20964 - DNA, 21 bp, Hordeum vulgare
cagggtggctrtgtccagctt

SEQ ID NO: 20965 - DNA, 21 bp, Hordeum vulgare
aatgaagatcrctcacaagaa

SEQ ID NO: 20966 - DNA, 21 bp, Hordeum vulgare
aactgagaagyatgttggttt

SEQ ID NO: 20967 - DNA, 21 bp, Hordeum vulgare
accggagaagmagcagctgcg

SEQ ID NO: 20968 - DNA, 21 bp, Hordeum vulgare
ccacttcaccmttctaattaa

SEQ ID NO: 20969 - DNA, 21 bp, Hordeum vulgare
cctcgtaatcrcggctttctg

SEQ ID NO: 20970 - DNA, 21 bp, Hordeum vulgare
tccttgctcakcctgcccttg

SEQ ID NO: 20971 - DNA, 21 bp, Hordeum vulgare
ttctggccggwggtcttgtcc

SEQ ID NO: 20972 - DNA, 21 bp, Hordeum vulgare
ttgtcgttggwgatggtgatc

SEQ ID NO: 20973 - DNA, 21 bp, Hordeum vulgare
acttctctgcrtcctggacca

SEQ ID NO: 20974 - DNA, 21 bp, Hordeum vulgare
tcatgttgtargcgtagttct

SEQ ID NO: 20975 - DNA, 21 bp, Hordeum vulgare
gagacgttcargataccgttg

SEQ ID NO: 20976 - DNA, 21 bp, Hordeum vulgare
cgttggtgctygcgtacgtca

SEQ ID NO: 20977 - DNA, 21 bp, Hordeum vulgare
tccgtagctcrggcaggccaa

SEQ ID NO: 20978 - DNA, 21 bp, Hordeum vulgare
tcttatggcaraataaaaata

SEQ ID NO: 20979 - DNA, 21 bp, Hordeum vulgare
ggccaaccaayctttgaagat

SEQ ID NO: 20980 - DNA, 21 bp, Hordeum vulgare
tgaatatcagytggcatttcc

SEQ ID NO: 20981 - DNA, 21 bp, Hordeum vulgare
gatcctcttcygagttctgcc

SEQ ID NO: 20982 - DNA, 21 bp, Hordeum vulgare
aggcgacaaaratccacacca

SEQ ID NO: 20983 - DNA, 21 bp, Hordeum vulgare
agactggtgayctggagccgg

SEQ ID NO: 20984 - DNA, 21 bp, Hordeum vulgare
agatctggccraagccaccac

SEQ ID NO: 20985 - DNA, 21 bp, Hordeum vulgare
caactcgtgaytctgtcagaa

SEQ ID NO: 20986 - DNA, 21 bp, Hordeum vulgare
cagaataaccrcgcatgtacc

SEQ ID NO: 20987 - DNA, 21 bp, Hordeum vulgare
ggcccacgaarcttagaggat

SEQ ID NO: 20988 - DNA, 21 bp, Hordeum vulgare
ggttttgagtrcttgtgtttg

SEQ ID NO: 20989 - DNA, 21 bp, Hordeum vulgare
catcagagatygcaggaacct

SEQ ID NO: 20990 - DNA, 21 bp, Hordeum vulgare
ttgagtgattygatgatgctt

SEQ ID NO: 20991 - DNA, 21 bp, Hordeum vulgare
ttatgccacaycacacgaata

SEQ ID NO: 20992 - DNA, 21 bp, Hordeum vulgare
  MISC_FEATURE (3): n is SNP, in which the one is a and the other is t or g or c
agnaccctaasctgatcttga

SEQ ID NO: 20993 - DNA, 20 bp, Hordeum vulgare
tgtcctcaaatcagatagag

SEQ ID NO: 20994 - DNA, 21 bp, Hordeum vulgare
tgtcctcaaaatcagatagag

SEQ ID NO: 20995 - DNA, 21 bp, Hordeum vulgare
gtcctatccarccagataaaa

SEQ ID NO: 20996 - DNA, 21 bp, Hordeum vulgare
agatagattgsggggttacag

SEQ ID NO: 20997 - DNA, 21 bp, Hordeum vulgare
tgtacaaagtrggggagatga

SEQ ID NO: 20998 - DNA, 21 bp, Hordeum vulgare
tgaccgccacratgtacttgg

SEQ ID NO: 20999 - DNA, 21 bp, Hordeum vulgare
aacagaatcaraagttcagag

SEQ ID NO: 21000 - DNA, 21 bp, Hordeum vulgare
gtttgcagccrtagtccattc

SEQ ID NO: 21001 - DNA, 21 bp, Hordeum vulgare
ttgtgcaaagsaaggacaact

SEQ ID NO: 21002 - DNA, 21 bp, Hordeum vulgare
actagcgggtygctacaccgg

SEQ ID NO: 21003 - DNA, 21 bp, Hordeum vulgare
gctaactatakcatacaagag

SEQ ID NO: 21004 - DNA, 21 bp, Hordeum vulgare
ccgacgtcgtyggcgggagga

SEQ ID NO: 21005 - DNA, 21 bp, Hordeum vulgare
tgctcgagctstagggtattt

SEQ ID NO: 21006 - DNA, 21 bp, Hordeum vulgare
ttgttcattasttaattgtta

SEQ ID NO: 21007 - DNA, 21 bp, Hordeum vulgare
ccacggccggmagtggccgat

SEQ ID NO: 21008 - DNA, 21 bp, Hordeum vulgare
actgtgggacratgccctcct

SEQ ID NO: 21009 - DNA, 21 bp, Hordeum vulgare
attgagggggraaacgatccg

SEQ ID NO: 21010 - DNA, 21 bp, Hordeum vulgare
gtatggccgcsccactcgacg

SEQ ID NO: 21011 - DNA, 21 bp, Hordeum vulgare
cacactggggraaggcctggc

SEQ ID NO: 21012 - DNA, 21 bp, Hordeum vulgare
ccgtcacaagmgtcgcagact

SEQ ID NO: 21013 - DNA, 21 bp, Hordeum vulgare
cgcacccagaygcgagatgcc

SEQ ID NO: 21014 - DNA, 21 bp, Hordeum vulgare
gtgctgccacycaaggctagc

SEQ ID NO: 21015 - DNA, 21 bp, Hordeum vulgare
gccagcaaagrttagatacat

SEQ ID NO: 21016 - DNA, 21 bp, Hordeum vulgare
aaacagaggctgattttttgt

SEQ ID NO: 21017 - DNA, 20 bp, Hordeum vulgare
aaacagaggcgattttttgt

SEQ ID NO: 21018 - DNA, 21 bp, Hordeum vulgare
ttggtaagacrtgctgcttat

SEQ ID NO: 21019 - DNA, 21 bp, Hordeum vulgare
cgtcggagagyccaaggcccc

SEQ ID NO: 21020 - DNA, 21 bp, Hordeum vulgare
tgttgctccckgtcacaacat

SEQ ID NO: 21021 - DNA, 21 bp, Hordeum vulgare
tgatggtattrttgctccccg

SEQ ID NO: 21022 - DNA, 21 bp, Hordeum vulgare
tgtggaagctyccggatacat

SEQ ID NO: 21023 - DNA, 21 bp, Hordeum vulgare
ctgatatccgrctcagctcgt

SEQ ID NO: 21024 - DNA, 21 bp, Hordeum vulgare
tgaacatcggkgatgcctgct

SEQ ID NO: 21025 - DNA, 21 bp, Hordeum vulgare
cgcgccgctasacgcgaagca

SEQ ID NO: 21026 - DNA, 21 bp, Hordeum vulgare
ccttggagcayctttgaagcc

SEQ ID NO: 21027 - DNA, 21 bp, Hordeum vulgare
gcccaccaagyaattgtgagc

SEQ ID NO: 21028 - DNA, 21 bp, Hordeum vulgare
ttcagctggtrctaagggtat

SEQ ID NO: 21029 - DNA, 21 bp, Hordeum vulgare
actccagaggkgctcgccctt

SEQ ID NO: 21030 - DNA, 21 bp, Hordeum vulgare
gcgagaaagamaaggtgtttc

SEQ ID NO: 21031 - DNA, 21 bp, Hordeum vulgare
gcgggctcagkgaacgcgtcc

SEQ ID NO: 21032 - DNA, 21 bp, Hordeum vulgare
atgagctacgkgcgggctggc

SEQ ID NO: 21033 - DNA, 21 bp, Hordeum vulgare
actccggggaracatggaata

SEQ ID NO: 21034 - DNA, 21 bp, Hordeum vulgare
aggaaacagcragctcaggct

SEQ ID NO: 21035 - DNA, 21 bp, Hordeum vulgare
aatactaaaaygacacaaaga

SEQ ID NO: 21036 - DNA, 21 bp, Hordeum vulgare
ggaatatgcartaacatatac

SEQ ID NO: 21037 - DNA, 21 bp, Hordeum vulgare
acagcagttgsatcagtggat

SEQ ID NO: 21038 - DNA, 21 bp, Hordeum vulgare
tgtccttctcygccagcacag

SEQ ID NO: 21039 - DNA, 21 bp, Hordeum vulgare
ccagcacgccraagaagatgg

SEQ ID NO: 21040 - DNA, 21 bp, Hordeum vulgare
cgccgggaccwtcctctctca

SEQ ID NO: 21041 - DNA, 21 bp, Hordeum vulgare
agccactcgaraagcaggact

SEQ ID NO: 21042 - DNA, 21 bp, Hordeum vulgare
aggtcatgaaygtaatcacag

SEQ ID NO: 21043 - DNA, 21 bp, Hordeum vulgare
tagtctctgcrggcctgatgt

SEQ ID NO: 21044 - DNA, 21 bp, Hordeum vulgare
aaatagacggstgaaattaat

SEQ ID NO: 21045 - DNA, 21 bp, Hordeum vulgare
tttttcatgcwccatgccctt

SEQ ID NO: 21046 - DNA, 21 bp, Hordeum vulgare
ctttcaatcayacgactgact

SEQ ID NO: 21047 - DNA, 21 bp, Hordeum vulgare
ctggatagcgygagggagcta

SEQ ID NO: 21048 - DNA, 21 bp, Hordeum vulgare
ccacagggctrgagctcaaca

SEQ ID NO: 21049 - DNA, 21 bp, Hordeum vulgare
aagcagattcyttcattagcc

SEQ ID NO: 21050 - DNA, 21 bp, Hordeum vulgare
caaactggttyccgaagagcc

SEQ ID NO: 21051 - DNA, 21 bp, Hordeum vulgare
agacccttgcsacgccgccgg

SEQ ID NO: 21052 - DNA, 21 bp, Hordeum vulgare
acagtacaacktattatccac

SEQ ID NO: 21053 - DNA, 21 bp, Hordeum vulgare
acacaaatacmtactagtaca

SEQ ID NO: 21054 - DNA, 21 bp, Hordeum vulgare
gtcagatgtgrtccaccacgt

SEQ ID NO: 21055 - DNA, 21 bp, Hordeum vulgare
gcatccgttgytggagtcgca

SEQ ID NO: 21056 - DNA, 21 bp, Hordeum vulgare
ggcggccgccyccgtaccagc

SEQ ID NO: 21057 - DNA, 21 bp, Hordeum vulgare
atcatcttccmgcaccggcgg

SEQ ID NO: 21058 - DNA, 21 bp, Hordeum vulgare
ctgctcgctgstgatgcggat

SEQ ID NO: 21059 - DNA, 21 bp, Hordeum vulgare
gtgttgagccygagagccttc

SEQ ID NO: 21060 - DNA, 21 bp, Hordeum vulgare
cggggacctcsccgatgtcgg

SEQ ID NO: 21061 - DNA, 21 bp, Hordeum vulgare
gtccacgatgytgtccttgca

SEQ ID NO: 21062 - DNA, 21 bp, Hordeum vulgare
aggggtaggaraaaatgatgc

SEQ ID NO: 21063 - DNA, 21 bp, Hordeum vulgare
ccatgccacargagatagaca

SEQ ID NO: 21064 - DNA, 21 bp, Hordeum vulgare
ggtggtccgcrgtggctggct

SEQ ID NO: 21065 - DNA, 21 bp, Hordeum vulgare
ggtggtccgcrgtggctggct

SEQ ID NO: 21066 - DNA, 21 bp, Hordeum vulgare
tcttcttcccraatttcagca

SEQ ID NO: 21067 - DNA, 21 bp, Hordeum vulgare
agataatcaayaaacaaagtg

SEQ ID NO: 21068 - DNA, 21 bp, Hordeum vulgare
agacccttgcsacgccgccgg

SEQ ID NO: 21069 - DNA, 21 bp, Hordeum vulgare
acagtacaacktattatccac

SEQ ID NO: 21070 - DNA, 21 bp, Hordeum vulgare
caaactggttyccgaagagcc

SEQ ID NO: 21071 - DNA, 21 bp, Hordeum vulgare
acacaaatacstactagtaca

SEQ ID NO: 21072 - DNA, 21 bp, Hordeum vulgare
cttaaacataygcatcatatg

SEQ ID NO: 21073 - DNA, 21 bp, Hordeum vulgare
taagcattccrgtgcaaatcc

SEQ ID NO: 21074 - DNA, 21 bp, Hordeum vulgare
  MISC_FEATURE (5): n is SNP, in which the one is g and the other is a or t or c
accanactctsctgagcagac

SEQ ID NO: 21075 - DNA, 21 bp, Hordeum vulgare
gaccgagaccrtgtccgtgtc

SEQ ID NO: 21076 - DNA, 21 bp, Hordeum vulgare
tatacacatasgagtaggatt

SEQ ID NO: 21077 - DNA, 21 bp, Hordeum vulgare
ttgtggttgtsgttgtaggta

SEQ ID NO: 21078 - DNA, 21 bp, Hordeum vulgare
actttctttcyttctttcttt

SEQ ID NO: 21079 - DNA, 21 bp, Hordeum vulgare
attgccagagrcagaaatgca

SEQ ID NO: 21080 - DNA, 21 bp, Hordeum vulgare
caagccctgcrtcaacgacaa

SEQ ID NO: 21081 - DNA, 21 bp, Hordeum vulgare
aaccaccctgraagaaaactc

SEQ ID NO: 21082 - DNA, 21 bp, Hordeum vulgare
atatgttcatrgatgtcaatc

SEQ ID NO: 21083 - DNA, 21 bp, Hordeum vulgare
atcattcaggrtgtaaaatgt

SEQ ID NO: 21084 - DNA, 21 bp, Hordeum vulgare
ttcttggcctyggattcggac

SEQ ID NO: 21085 - DNA, 21 bp, Hordeum vulgare
ggaataatccmcctcataaca

SEQ ID NO: 21086 - DNA, 21 bp, Hordeum vulgare
attacagtttyttcgtctacg

SEQ ID NO: 21087 - DNA, 21 bp, Hordeum vulgare
aaaacatgggmactacatata

SEQ ID NO: 21088 - DNA, 21 bp, Hordeum vulgare
agttgcggcakcggcaatatg

SEQ ID NO: 21089 - DNA, 21 bp, Hordeum vulgare
aacaggcgttktctggttagt

SEQ ID NO: 21090 - DNA, 21 bp, Hordeum vulgare
attccagacamacatttttat

SEQ ID NO: 21091 - DNA, 21 bp, Hordeum vulgare
gccggggaatrcaaccatcag

SEQ ID NO: 21092 - DNA, 21 bp, Hordeum vulgare
atccatcatgscagctcatac

SEQ ID NO: 21093 - DNA, 21 bp, Hordeum vulgare
cctcctcctcrggtgtaaagt

SEQ ID NO: 21094 - DNA, 21 bp, Hordeum vulgare
agtaatttgawccacaagtat

SEQ ID NO: 21095 - DNA, 21 bp, Hordeum vulgare
taggacctgayctttcaagct

SEQ ID NO: 21096 - DNA, 21 bp, Hordeum vulgare
cccggcacctstcagacacgc

SEQ ID NO: 21097 - DNA, 21 bp, Hordeum vulgare
gccagttgatscctgccaaca

SEQ ID NO: 21098 - DNA, 21 bp, Hordeum vulgare
ccacactgaawttcatacctc

SEQ ID NO: 21099 - DNA, 21 bp, Hordeum vulgare
ttcctactcaratctgccagg

SEQ ID NO: 21100 - DNA, 21 bp, Hordeum vulgare
cgcggccgcgygcctgccaca

SEQ ID NO: 21101 - DNA, 21 bp, Hordeum vulgare
ttcacacttaraaggcacaca

SEQ ID NO: 21102 - DNA, 21 bp, Hordeum vulgare
ttgcgccttcraacaatgaat

SEQ ID NO: 21103 - DNA, 21 bp, Hordeum vulgare
gatggtcctcratttcacttg

SEQ ID NO: 21104 - DNA, 21 bp, Hordeum vulgare
cgaggcctctygcgacgtaga

SEQ ID NO: 21105 - DNA, 21 bp, Hordeum vulgare
actgactcgcratttatttta

SEQ ID NO: 21106 - DNA, 21 bp, Hordeum vulgare
tcaccgtggayctcccgccca

SEQ ID NO: 21107 - DNA, 21 bp, Hordeum vulgare
acggtctctcrtcgatgcgct

SEQ ID NO: 21108 - DNA, 21 bp, Hordeum vulgare
ttcagggccaragtctccacc

SEQ ID NO: 21109 - DNA, 21 bp, Hordeum vulgare
gcgcagcaccrccggacccga

SEQ ID NO: 21110 - DNA, 21 bp, Hordeum vulgare
cttctctctcytcccttcctt

SEQ ID NO: 21111 - DNA, 21 bp, Hordeum vulgare
acctaccaccmatcgcaaagc

SEQ ID NO: 21112 - DNA, 21 bp, Hordeum vulgare
cagctcttcgscatcaagcac

SEQ ID NO: 21113 - DNA, 21 bp, Hordeum vulgare
ttacagtgacmcgggcgccgg

SEQ ID NO: 21114 - DNA, 21 bp, Hordeum vulgare
ccatgtaggcrcccggtctcc

SEQ ID NO: 21115 - DNA, 21 bp, Hordeum vulgare
ggttgaccggygctggtggaa

SEQ ID NO: 21116 - DNA, 21 bp, Hordeum vulgare
ctgccagcgcmgacgccacgg

SEQ ID NO: 21117 - DNA, 21 bp, Hordeum vulgare
caacaccaatmtagaaatcag

SEQ ID NO: 21118 - DNA, 21 bp, Hordeum vulgare
aagtgaagatytcagtaatga

SEQ ID NO: 21119 - DNA, 21 bp, Hordeum vulgare
taactaaccamaagactgctc

SEQ ID NO: 21120 - DNA, 21 bp, Hordeum vulgare
ggcgacttggyctccttctcg

SEQ ID NO: 21121 - DNA, 21 bp, Hordeum vulgare
tgttggggatsacgccgccgt

SEQ ID NO: 21122 - DNA, 21 bp, Hordeum vulgare
tctcccgggasgtgatggtgg

SEQ ID NO: 21123 - DNA, 21 bp, Hordeum vulgare
cgtgcttggcsagctcgccgg

SEQ ID NO: 21124 - DNA, 21 bp, Hordeum vulgare
tggccttcccrtccgagcggt

SEQ ID NO: 21125 - DNA, 21 bp, Hordeum vulgare
gtaagtccgcracacatggcg

SEQ ID NO: 21126 - DNA, 21 bp, Hordeum vulgare
aggtattgagwtcaagtgaga

SEQ ID NO: 21127 - DNA, 21 bp, Hordeum vulgare
ctaaagaacaraattattcac

SEQ ID NO: 21128 - DNA, 21 bp, Hordeum vulgare
catggaaagaratatgcatat

SEQ ID NO: 21129 - DNA, 21 bp, Hordeum vulgare
aaatggggttsttaatgacgg

SEQ ID NO: 21130 - DNA, 21 bp, Hordeum vulgare
aaaactatcakgggcactgac

SEQ ID NO: 21131 - DNA, 21 bp, Hordeum vulgare
gcactgaccakcttgcttgac

SEQ ID NO: 21132 - DNA, 21 bp, Hordeum vulgare
tctgtggaagytggtcttcac

SEQ ID NO: 21133 - DNA, 21 bp, Hordeum vulgare
ggaagacggcrgggtggaatg

SEQ ID NO: 21134 - DNA, 21 bp, Hordeum vulgare
tggcggttggrggcaaccagt

SEQ ID NO: 21135 - DNA, 21 bp, Hordeum vulgare
atatattttcmaagcaagagg

SEQ ID NO: 21136 - DNA, 21 bp, Hordeum vulgare
tggcggttggrggcaaccagt

SEQ ID NO: 21137 - DNA, 21 bp, Hordeum vulgare
ctagccgcctygcagccccac

SEQ ID NO: 21138 - DNA, 21 bp, Hordeum vulgare
gtaaatccatygattcatgca

SEQ ID NO: 21139 - DNA, 21 bp, Hordeum vulgare
gtyacggccgscctcttccgc

SEQ ID NO: 21140 - DNA, 21 bp, Hordeum vulgare
agtttaaggcyccgaaggttc

SEQ ID NO: 21141 - DNA, 19 bp, Hordeum vulgare
tgctaaggtccttggatga

SEQ ID NO: 21142 - DNA, 21 bp, Hordeum vulgare
tgctataagggccttggatga

SEQ ID NO: 21143 - DNA, 21 bp, Hordeum vulgare
aacaaatttcygtacacaaca

SEQ ID NO: 21144 - DNA, 21 bp, Hordeum vulgare
aagagaggagrcaacaaattt

SEQ ID NO: 21145 - DNA, 21 bp, Hordeum vulgare
acagccttacrtcggggaact

SEQ ID NO: 21146 - DNA, 21 bp, Hordeum vulgare
tgaagccgacsgttctgtcca

SEQ ID NO: 21147 - DNA, 21 bp, Hordeum vulgare
ccactcccatrgttaaatgta

SEQ ID NO: 21148 - DNA, 21 bp, Hordeum vulgare
ttctgtgttamagcttcttac

SEQ ID NO: 21149 - DNA, 21 bp, Hordeum vulgare
aaatgtaataygaaataatga

SEQ ID NO: 21150 - DNA, 21 bp, Hordeum vulgare
ccacataccckatccagaaca

SEQ ID NO: 21151 - DNA, 21 bp, Hordeum vulgare
cttataaaagraaaactcata

SEQ ID NO: 21152 - DNA, 21 bp, Hordeum vulgare
tcaccttgatytcaagaatgt

SEQ ID NO: 21153 - DNA, 21 bp, Hordeum vulgare
atatcattcgygggcacaaaa

SEQ ID NO: 21154 - DNA, 21 bp, Hordeum vulgare
catcgtgaggsgcggtggagt

SEQ ID NO: 21155 - DNA, 21 bp, Hordeum vulgare
agacgcaggayctgtcgaagt

SEQ ID NO: 21156 - DNA, 21 bp, Hordeum vulgare
ctcaagcatgygcttctttgc

SEQ ID NO: 21157 - DNA, 21 bp, Hordeum vulgare
tgggcgtcttraagtacaaat

SEQ ID NO: 21158 - DNA, 21 bp, Hordeum vulgare
ccttcttctcwccggcggcgc

SEQ ID NO: 21159 - DNA, 21 bp, Hordeum vulgare
gcgagcaccgycggataaact

SEQ ID NO: 21160 - DNA, 21 bp, Hordeum vulgare
taaaagacagyttgctaactc

SEQ ID NO: 21161 - DNA, 21 bp, Hordeum vulgare
attcataacargagcatcctt

SEQ ID NO: 21162 - DNA, 20 bp, Hordeum vulgare
catgctgggcgggaaggccc

SEQ ID NO: 21163 - DNA, 21 bp, Hordeum vulgare
catgctgggcagggaaggccc

SEQ ID NO: 21164 - DNA, 21 bp, Hordeum vulgare
ccctccgcgtygccaccgggg

SEQ ID NO: 21165 - DNA, 21 bp, Hordeum vulgare
tctgcccttckccgtagccaa

SEQ ID NO: 21166 - DNA, 21 bp, Hordeum vulgare
gtgcttcaacrcgatttagca

SEQ ID NO: 21167 - DNA, 21 bp, Hordeum vulgare
gtaccttggakatggtgaggg

SEQ ID NO: 21168 - DNA, 21 bp, Hordeum vulgare
ggagtagtagrtagacaagat

SEQ ID NO: 21169 - DNA, 21 bp, Hordeum vulgare
ctccatcgctygcttcgagcc

SEQ ID NO: 21170 - DNA, 21 bp, Hordeum vulgare
gtcttccggaygttgaggaaa

SEQ ID NO: 21171 - DNA, 21 bp, Hordeum vulgare
atatatctccragcacccctt

SEQ ID NO: 21172 - DNA, 21 bp, Hordeum vulgare
gaactgtacaktactcctggt

SEQ ID NO: 21173 - DNA, 21 bp, Hordeum vulgare
gttgcccgtcycaggagaagc

SEQ ID NO: 21174 - DNA, 21 bp, Hordeum vulgare
tcaatatggayttgccctgtg

SEQ ID NO: 21175 - DNA, 21 bp, Hordeum vulgare
agaaactgggraattctgggt

SEQ ID NO: 21176 - DNA, 21 bp, Hordeum vulgare
cgacgacgackacgacgggcg

SEQ ID NO: 21177 - DNA, 21 bp, Hordeum vulgare
gaccgacgacrcgacagggga

SEQ ID NO: 21178 - DNA, 21 bp, Hordeum vulgare
cttggagcagrtgccgctgcg

SEQ ID NO: 21179 - DNA, 21 bp, Hordeum vulgare
actgtgtactrcattgtttct

SEQ ID NO: 21180 - DNA, 21 bp, Hordeum vulgare
cttgcacactrcaaagaactg

SEQ ID NO: 21181 - DNA, 21 bp, Hordeum vulgare
agccattactktaaactcacc

SEQ ID NO: 21182 - DNA, 21 bp, Hordeum vulgare
gtcgaacaagrctgggccgtc

SEQ ID NO: 21183 - DNA, 21 bp, Hordeum vulgare
acttccctccsgtaagataaa

SEQ ID NO: 21184 - DNA, 21 bp, Hordeum vulgare
catggatgagracttgcacac

SEQ ID NO: 21185 - DNA, 21 bp, Hordeum vulgare
ggcaaatgtgyctgacagcca

SEQ ID NO: 21186 - DNA, 21 bp, Hordeum vulgare
cactgacaccstccgatccag

SEQ ID NO: 21187 - DNA, 21 bp, Hordeum vulgare
gcccttccttrtggcccatcc

SEQ ID NO: 21188 - DNA, 21 bp, Hordeum vulgare
agttcctgttygtcgttgata

SEQ ID NO: 21189 - DNA, 21 bp, Hordeum vulgare
tccccaatcakaaggatgtgg

SEQ ID NO: 21190 - DNA, 21 bp, Hordeum vulgare
tcgctcctctraactagcaac

SEQ ID NO: 21191 - DNA, 21 bp, Hordeum vulgare
ctgctaagcakcaacaaataa

SEQ ID NO: 21192 - DNA, 21 bp, Hordeum vulgare
tagtccaaggrcacatcacac

SEQ ID NO: 21193 - DNA, 21 bp, Hordeum vulgare
ggcgagcactmgtcctcttca

SEQ ID NO: 21194 - DNA, 21 bp, Hordeum vulgare
tggaggagacsgtgtcagcaa

SEQ ID NO: 21195 - DNA, 21 bp, Hordeum vulgare
tgtagatctcrtcaataagag

SEQ ID NO: 21196 - DNA, 21 bp, Hordeum vulgare
  MISC_FEATURE (11): n is SNP, in which the one is g and the other is a or t or c
gctggtccggngggatgcctt

SEQ ID NO: 21197 - DNA, 21 bp, Hordeum vulgare
tggtcttgcckgtgagggtct

SEQ ID NO: 21198 - DNA, 21 bp, Hordeum vulgare
atcatctcctkgagcaccagc

SEQ ID NO: 21199 - DNA, 21 bp, Hordeum vulgare
ggagtccccgmcgcaatcttt

SEQ ID NO: 21200 - DNA, 21 bp, Hordeum vulgare
gtcacctgtcrgtcactctgt

SEQ ID NO: 21201 - DNA, 21 bp, Hordeum vulgare
tcggaactccrgacgggctcg

SEQ ID NO: 21202 - DNA, 21 bp, Hordeum vulgare
  MISC_FEATURE (11): n is SNP, in which the one is a and the other is t or g or c
atatataacangaagagagct

SEQ ID NO: 21203 - DNA, 21 bp, Hordeum vulgare
ctgcattgcarctctgtgtta

SEQ ID NO: 21204 - DNA, 21 bp, Hordeum vulgare
cgaagaatgawggggggaaaa

SEQ ID NO: 21205 - DNA, 21 bp, Hordeum vulgare
gtgttcatctwaaaacaacac

SEQ ID NO: 21206 - DNA, 21 bp, Hordeum vulgare
ccttcctatgrcttctcggat

SEQ ID NO: 21207 - DNA, 21 bp, Hordeum vulgare
tagaccgataratcctactta

SEQ ID NO: 21208 - DNA, 21 bp, Hordeum vulgare
tcaggacggcyttgtcaacct

SEQ ID NO: 21209 - DNA, 21 bp, Hordeum vulgare
tcgcgccgtargcctcggtgc

SEQ ID NO: 21210 - DNA, 21 bp, Hordeum vulgare
tagaaaccaaytggcgagttt

SEQ ID NO: 21211 - DNA, 21 bp, Hordeum vulgare
cgcagcagtckgctatcgcgc

SEQ ID NO: 21212 - DNA, 21 bp, Hordeum vulgare
tcgcgccgtargcctcggtgc

SEQ ID NO: 21213 - DNA, 21 bp, Hordeum vulgare
gatcagtaagyaggaagaagc

SEQ ID NO: 21214 - DNA, 21 bp, Hordeum vulgare
tatagggaacrcattttccgt

SEQ ID NO: 21215 - DNA, 21 bp, Hordeum vulgare
gtgggtccacratctcaccga

SEQ ID NO: 21216 - DNA, 21 bp, Hordeum vulgare
ttgctcagagyctgggccgcg

SEQ ID NO: 21217 - DNA, 21 bp, Hordeum vulgare
tgcctcaccakgtgaccagcc

SEQ ID NO: 21218 - DNA, 21 bp, Hordeum vulgare
tgtcatccttytcatcctcct

SEQ ID NO: 21219 - DNA, 21 bp, Hordeum vulgare
tgagcacaacytggcatgccc

SEQ ID NO: 21220 - DNA, 21 bp, Hordeum vulgare
gaagtgttgtmaacttcaaag

SEQ ID NO: 21221 - DNA, 21 bp, Hordeum vulgare
ttacacctttyaccgtctgag

SEQ ID NO: 21222 - DNA, 21 bp, Hordeum vulgare
cagcatctccwgatggacaga

SEQ ID NO: 21223 - DNA, 21 bp, Hordeum vulgare
aagaatcagtmtattaggtgg

SEQ ID NO: 21224 - DNA, 21 bp, Hordeum vulgare
ataaagacctrggaaacaaag

SEQ ID NO: 21225 - DNA, 21 bp, Hordeum vulgare
tgacagcagcygatgtcgtgc

SEQ ID NO: 21226 - DNA, 21 bp, Hordeum vulgare
cgtcccattcragggtatcgg

SEQ ID NO: 21227 - DNA, 21 bp, Hordeum vulgare
agcctcgggcrttgcacatgc

SEQ ID NO: 21228 - DNA, 21 bp, Hordeum vulgare
ggagggcctaycccggccgtg

SEQ ID NO: 21229 - DNA, 21 bp, Hordeum vulgare
aaccacgctgrcgctggaggg

SEQ ID NO: 21230 - DNA, 21 bp, Hordeum vulgare
gacgccacackatactgtgtg

SEQ ID NO: 21231 - DNA, 21 bp, Hordeum vulgare
gcgggggcggrtagctggacc

SEQ ID NO: 21232 - DNA, 21 bp, Hordeum vulgare
atatgtccgcraaaggcgttc

SEQ ID NO: 21233 - DNA, 21 bp, Hordeum vulgare
acatctggggsagccaaacag

SEQ ID NO: 21234 - DNA, 21 bp, Hordeum vulgare
tcggcgtttcrttcgcgctag

SEQ ID NO: 21235 - DNA, 21 bp, Hordeum vulgare
cagcttgacgrcatcaggcag

SEQ ID NO: 21236 - DNA, 21 bp, Hordeum vulgare
aaaaatacacmagcagatctg

SEQ ID NO: 21237 - DNA, 21 bp, Hordeum vulgare
acatctgacgrgaacaacaca

SEQ ID NO: 21238 - DNA, 21 bp, Hordeum vulgare
tagtactctayaggatttgag

SEQ ID NO: 21239 - DNA, 21 bp, Hordeum vulgare
attagcagggytatcaaattg

SEQ ID NO: 21240 - DNA, 21 bp, Hordeum vulgare
ataaagagaawttcctccaga

SEQ ID NO: 21241 - DNA, 21 bp, Hordeum vulgare
caagagacgcrgaggatgaca

SEQ ID NO: 21242 - DNA, 21 bp, Hordeum vulgare
agcaaggtacmtccaatactt

SEQ ID NO: 21243 - DNA, 21 bp, Hordeum vulgare
tcggcaggtcrtagttgatga

SEQ ID NO: 21244 - DNA, 21 bp, Hordeum vulgare
ggcagggcagmtttcccacaa

SEQ ID NO: 21245 - DNA, 21 bp, Hordeum vulgare
ccgcaagggtscgaccatcct

SEQ ID NO: 21246 - DNA, 21 bp, Hordeum vulgare
actcactactrctgctctgcg

SEQ ID NO: 21247 - DNA, 21 bp, Hordeum vulgare
actcactactrctgctctgcg

SEQ ID NO: 21248 - DNA, 21 bp, Hordeum vulgare
ttacaagtcaragagaaaatg

SEQ ID NO: 21249 - DNA, 21 bp, Hordeum vulgare
atagtgttaarcattaacaca

SEQ ID NO: 21250 - DNA, 21 bp, Hordeum vulgare
cacacaaaagrggaacctagg

SEQ ID NO: 21251 - DNA, 21 bp, Hordeum vulgare
atgcaactaaratattgtcag

SEQ ID NO: 21252 - DNA, 21 bp, Hordeum vulgare
gcggttgcaaygctccacgtg

SEQ ID NO: 21253 - DNA, 21 bp, Hordeum vulgare
aaccaagcacrgtaccaggac

SEQ ID NO: 21254 - DNA, 21 bp, Hordeum vulgare
agcacctacaytgatcagtgt

SEQ ID NO: 21255 - DNA, 21 bp, Hordeum vulgare
ccgcaagggtscgaccatcct

SEQ ID NO: 21256 - DNA, 21 bp, Hordeum vulgare
catgtatccasttccatgctg

SEQ ID NO: 21257 - DNA, 21 bp, Hordeum vulgare
caaactattascaaacctgca

SEQ ID NO: 21258 - DNA, 21 bp, Hordeum vulgare
catcgttcgasgcaatgacac

SEQ ID NO: 21259 - DNA, 21 bp, Hordeum vulgare
cgaacccgagygggttgaaga

SEQ ID NO: 21260 - DNA, 21 bp, Hordeum vulgare
tatgatagcawattgcttgta

SEQ ID NO: 21261 - DNA, 21 bp, Hordeum vulgare
gcaactagtcytctttatgat

SEQ ID NO: 21262 - DNA, 21 bp, Hordeum vulgare
aatgctcagawtttccgtaag

SEQ ID NO: 21263 - DNA, 21 bp, Hordeum vulgare
ggctaggcctygaagcgcttg

SEQ ID NO: 21264 - DNA, 21 bp, Hordeum vulgare
aatgccacggwtactcattga

SEQ ID NO: 21265 - DNA, 21 bp, Hordeum vulgare
gcctggaaaasgcagttttcc

SEQ ID NO: 21266 - DNA, 21 bp, Hordeum vulgare
ggagccagcgrccgggagagc

SEQ ID NO: 21267 - DNA, 21 bp, Hordeum vulgare
ttggaggaacytgcgggtcga

SEQ ID NO: 21268 - DNA, 21 bp, Hordeum vulgare
aaagatcgcaygccacaccat

SEQ ID NO: 21269 - DNA, 21 bp, Hordeum vulgare
tctcatacccygaaccgtctt

SEQ ID NO: 21270 - DNA, 21 bp, Hordeum vulgare
atcactagtartgtacatgtt

SEQ ID NO: 21271 - DNA, 21 bp, Hordeum vulgare
aagactgaaaragcaccccct

SEQ ID NO: 21272 - DNA, 21 bp, Hordeum vulgare
cagccatcaaygcaacaagtg

SEQ ID NO: 21273 - DNA, 21 bp, Hordeum vulgare
tcatacagtartgttttcaag

SEQ ID NO: 21274 - DNA, 21 bp, Hordeum vulgare
aacttcatatratcgcaaggt

SEQ ID NO: 21275 - DNA, 21 bp, Hordeum vulgare
aaagcaaagcrttctttgaag

SEQ ID NO: 21276 - DNA, 21 bp, Hordeum vulgare
ggtcatcctcrgggtctgtcc

SEQ ID NO: 21277 - DNA, 21 bp, Hordeum vulgare
ttcctcacaawcagcgctatg

SEQ ID NO: 21278 - DNA, 21 bp, Hordeum vulgare
ctttccgctgmaaggcggaca

SEQ ID NO: 21279 - DNA, 21 bp, Hordeum vulgare
attgaacagaycgagtagagt

SEQ ID NO: 21280 - DNA, 21 bp, Hordeum vulgare
agcaaccttamaaactgaaag

SEQ ID NO: 21281 - DNA, 21 bp, Hordeum vulgare
gtttcgactcrgatgccgctc

SEQ ID NO: 21282 - DNA, 21 bp, Hordeum vulgare
tggtgactccsgtgatgctga

SEQ ID NO: 21283 - DNA, 21 bp, Hordeum vulgare
tacacaccagyggtctgaaga

SEQ ID NO: 21284 - DNA, 21 bp, Hordeum vulgare
gttgccagaaratcacaataa

SEQ ID NO: 21285 - DNA, 21 bp, Hordeum vulgare
tacctaggggyagcttgttga

SEQ ID NO: 21286 - DNA, 21 bp, Hordeum vulgare
actaaccatgkaaaaggctta

SEQ ID NO: 21287 - DNA, 21 bp, Hordeum vulgare
ctatctgccakatcctgtcac

SEQ ID NO: 21288 - DNA, 21 bp, Hordeum vulgare
attttgtcatycagataattt

SEQ ID NO: 21289 - DNA, 21 bp, Hordeum vulgare
agaagtctgcrgcaaacctca

SEQ ID NO: 21290 - DNA, 21 bp, Hordeum vulgare
gatattcttgyggttatcttc

SEQ ID NO: 21291 - DNA, 21 bp, Hordeum vulgare
tcacgctgttyagggtaggct

SEQ ID NO: 21292 - DNA, 21 bp, Hordeum vulgare
  MISC_FEATURE (11): n is SNP, in which the one is t and the other is a or g or c
tatatagtacnccctctgttc

SEQ ID NO: 21293 - DNA, 21 bp, Hordeum vulgare
tccgaagtggytggcctttca

SEQ ID NO: 21294 - DNA, 21 bp, Hordeum vulgare
cttatgcccasattaaaatac

SEQ ID NO: 21295 - DNA, 21 bp, Hordeum vulgare
cacgtaccccrtcctcttgct

SEQ ID NO: 21296 - DNA, 21 bp, Hordeum vulgare
gaatttttcargttatatatg

SEQ ID NO: 21297 - DNA, 21 bp, Hordeum vulgare
gcgtgcagatmattgaatgtg

SEQ ID NO: 21298 - DNA, 21 bp, Hordeum vulgare
atttagcacaygatgaagggt

SEQ ID NO: 21299 - DNA, 21 bp, Hordeum vulgare
ctctcccgctrgatagcgcgc

SEQ ID NO: 21300 - DNA, 21 bp, Hordeum vulgare
aagagagctgyggtcatcacg

SEQ ID NO: 21301 - DNA, 21 bp, Hordeum vulgare
ggggacaagtsgggtgagttt

SEQ ID NO: 21302 - DNA, 21 bp, Hordeum vulgare
ggacccctggstggggctttg

SEQ ID NO: 21303 - DNA, 21 bp, Hordeum vulgare
gctttgggggstcccctttcc

SEQ ID NO: 21304 - DNA, 21 bp, Hordeum vulgare
ttttttttgtmcaaaggattt

SEQ ID NO: 21305 - DNA, 21 bp, Hordeum vulgare
aaacatgacayaccatatatg

SEQ ID NO: 21306 - DNA, 21 bp, Hordeum vulgare
aaaaatatacwatcacaaatc

SEQ ID NO: 21307 - DNA, 21 bp, Hordeum vulgare
aatccacaggktttatcttcg

SEQ ID NO: 21308 - DNA, 21 bp, Hordeum vulgare
ctttgtgcacragggcattaa

SEQ ID NO: 21309 - DNA, 21 bp, Hordeum vulgare
caagacgcccrgtccggccag

SEQ ID NO: 21310 - DNA, 21 bp, Hordeum vulgare
aactgtcatcrtcagtctcat

SEQ ID NO: 21311 - DNA, 21 bp, Hordeum vulgare
agcagcagcarcaacaacaac

SEQ ID NO: 21312 - DNA, 21 bp, Hordeum vulgare
atctgcgcgcscggccttttg

SEQ ID NO: 21313 - DNA, 21 bp, Hordeum vulgare
aagaactgacrgaggacacga

SEQ ID NO: 21314 - DNA, 21 bp, Hordeum vulgare
tacccagttgsttcgatgttt

SEQ ID NO: 21315 - DNA, 21 bp, Hordeum vulgare
ctgcaggttgwcggtgctggt

SEQ ID NO: 21316 - DNA, 21 bp, Hordeum vulgare
tcatctgaagsttcagttccg

SEQ ID NO: 21317 - DNA, 21 bp, Hordeum vulgare
attgtgtggcraaaccatccg

SEQ ID NO: 21318 - DNA, 21 bp, Hordeum vulgare
ttatctacatmcctagatttg

SEQ ID NO: 21319 - DNA, 21 bp, Hordeum vulgare
cacctttgcaktggctcacca

SEQ ID NO: 21320 - DNA, 21 bp, Hordeum vulgare
atgctgaaagractcttctag

SEQ ID NO: 21321 - DNA, 21 bp, Hordeum vulgare
atctccaaacraacagcctct

SEQ ID NO: 21322 - DNA, 21 bp, Hordeum vulgare
acttgtttgayagattaacta

SEQ ID NO: 21323 - DNA, 21 bp, Hordeum vulgare
ttaaaactagrtaactgaaat

SEQ ID NO: 21324 - DNA, 20 bp, Hordeum vulgare
agcactcctgactaaaaagt

SEQ ID NO: 21325 - DNA, 21 bp, Hordeum vulgare
agcactcctgcactaaaaagt

SEQ ID NO: 21326 - DNA, 21 bp, Hordeum vulgare
tatatccgtcratatgtggta

SEQ ID NO: 21327 - DNA, 21 bp, Hordeum vulgare
cgccattaggwgctatggagg

SEQ ID NO: 21328 - DNA, 21 bp, Hordeum vulgare
tctgaactgtsgatatgccta

SEQ ID NO: 21329 - DNA, 21 bp, Hordeum vulgare
tttctttctgrcgcaagcaaa

SEQ ID NO: 21330 - DNA, 21 bp, Hordeum vulgare
cagcagctggytgtacacctc

SEQ ID NO: 21331 - DNA, 21 bp, Hordeum vulgare
agaggtgaagracaccggacg

SEQ ID NO: 21332 - DNA, 21 bp, Hordeum vulgare
agctaccacaraagtcctttc

SEQ ID NO: 21333 - DNA, 21 bp, Hordeum vulgare
cccatgtctgsacaacaaaag

SEQ ID NO: 21334 - DNA, 21 bp, Hordeum vulgare
cttgcttagakggaccgatgt

SEQ ID NO: 21335 - DNA, 21 bp, Hordeum vulgare
atcgagctgtrggcgacgagg

SEQ ID NO: 21336 - DNA, 21 bp, Hordeum vulgare
tcttgatgtcrgtcagtgaaa

SEQ ID NO: 21337 - DNA, 21 bp, Hordeum vulgare
tgatgacatcrtgctcctctc

SEQ ID NO: 21338 - DNA, 21 bp, Hordeum vulgare
cgcagttttcsacttgattct

SEQ ID NO: 21339 - DNA, 21 bp, Hordeum vulgare
cagatgtacayatggaatgga

SEQ ID NO: 21340 - DNA, 21 bp, Hordeum vulgare
cccatttacgrgggaagttca

SEQ ID NO: 21341 - DNA, 21 bp, Hordeum vulgare
cacatgacatraaatcgctaa

SEQ ID NO: 21342 - DNA, 21 bp, Hordeum vulgare
tacaacatccrargcagccac

SEQ ID NO: 21343 - DNA, 21 bp, Hordeum vulgare
caacatccrargcagccacat

SEQ ID NO: 21344 - DNA, 21 bp, Hordeum vulgare
aatgtaaaccrcaggctgctt

SEQ ID NO: 21345 - DNA, 21 bp, Hordeum vulgare
tataagtcccrtgacactgca

SEQ ID NO: 21346 - DNA, 21 bp, Hordeum vulgare
taatgcatcarctacacactt

SEQ ID NO: 21347 - DNA, 21 bp, Hordeum vulgare
gcgtccttgarcgccgctctc

SEQ ID NO: 21348 - DNA, 21 bp, Hordeum vulgare
ccacgagcacraaaagtagcg

SEQ ID NO: 21349 - DNA, 21 bp, Hordeum vulgare
tgcggcttctrcgcctcctca

SEQ ID NO: 21350 - DNA, 21 bp, Hordeum vulgare
gcttgctattmcgaagtcact

SEQ ID NO: 21351 - DNA, 21 bp, Hordeum vulgare
aataatgactrcagacaaaat

SEQ ID NO: 21352 - DNA, 21 bp, Hordeum vulgare
atgactctggyccatatttgt

SEQ ID NO: 21353 - DNA, 21 bp, Hordeum vulgare
tcaagaagcakccctgaatat

SEQ ID NO: 21354 - DNA, 21 bp, Hordeum vulgare
cgtatgtagayatctagtgaa

SEQ ID NO: 21355 - DNA, 21 bp, Hordeum vulgare
agtatagattyattcattttg

SEQ ID NO: 21356 - DNA, 21 bp, Hordeum vulgare
atataagtctytctagaggtt

SEQ ID NO: 21357 - DNA, 21 bp, Hordeum vulgare
aggacctgctyttgttgaacg

SEQ ID NO: 21358 - DNA, 21 bp, Hordeum vulgare
ggttgatctcygcttggcttc

SEQ ID NO: 21359 - DNA, 21 bp, Hordeum vulgare
tgacatcctcraaccctgcct

SEQ ID NO: 21360 - DNA, 21 bp, Hordeum vulgare
tttacctgttygaatttgcaa

SEQ ID NO: 21361 - DNA, 21 bp, Hordeum vulgare
aactcctcttyctcggatacg

SEQ ID NO: 21362 - DNA, 21 bp, Hordeum vulgare
tccacctcacyaaggaattca

SEQ ID NO: 21363 - DNA, 21 bp, Hordeum vulgare
tgtatgtaagyagcttgttcc

SEQ ID NO: 21364 - DNA, 21 bp, Hordeum vulgare
cataacatcartgataaacga

SEQ ID NO: 21365 - DNA, 21 bp, Hordeum vulgare
agcttcttgtyccctcctcct

SEQ ID NO: 21366 - DNA, 21 bp, Hordeum vulgare
atcatctaacscatataacca

SEQ ID NO: 21367 - DNA, 21 bp, Hordeum vulgare
cactctcctcragattaaata

SEQ ID NO: 21368 - DNA, 21 bp, Hordeum vulgare
gtgtttttggrtatgatctga

SEQ ID NO: 21369 - DNA, 21 bp, Hordeum vulgare
tgcccatcatsattcatcaga

SEQ ID NO: 21370 - DNA, 21 bp, Hordeum vulgare
tccgcaaaaamacacactata

SEQ ID NO: 21371 - DNA, 21 bp, Hordeum vulgare
aattcttagcmatgaatacaa

SEQ ID NO: 21372 - DNA, 21 bp, Hordeum vulgare
ccttggggtcmatgccgtcga

SEQ ID NO: 21373 - DNA, 21 bp, Hordeum vulgare
ggtgcagccamgctgacgcag

SEQ ID NO: 21374 - DNA, 21 bp, Hordeum vulgare
tcttaagcggrgatctcaacc

SEQ ID NO: 21375 - DNA, 21 bp, Hordeum vulgare
tataagtcacrccatccctaa

SEQ ID NO: 21376 - DNA, 21 bp, Hordeum vulgare
gggctagcatragcatacaat

SEQ ID NO: 21377 - DNA, 21 bp, Hordeum vulgare
attcagagagrgagatgcagt

SEQ ID NO: 21378 - DNA, 21 bp, Hordeum vulgare
agcagaaataycatcaactgg

SEQ ID NO: 21379 - DNA, 21 bp, Hordeum vulgare
ttagcgtcatmgtgttccctt

SEQ ID NO: 21380 - DNA, 21 bp, Hordeum vulgare
atcataaaatmttttgaatca

SEQ ID NO: 21381 - DNA, 21 bp, Hordeum vulgare
ctacagcacastactctgccg

SEQ ID NO: 21382 - DNA, 21 bp, Hordeum vulgare
tatcacaactsgatattccat

SEQ ID NO: 21383 - DNA, 21 bp, Hordeum vulgare
catgtatactytctgcatgca

SEQ ID NO: 21384 - DNA, 21 bp, Hordeum vulgare
aagactgactsacttagaaaa

SEQ ID NO: 21385 - DNA, 21 bp, Hordeum vulgare
taataatgttsaacttcaata

SEQ ID NO: 21386 - DNA, 21 bp, Hordeum vulgare
tggcaaacacrgatttataac

SEQ ID NO: 21387 - DNA, 21 bp, Hordeum vulgare
tgagcagttayactaaagaga

SEQ ID NO: 21388 - DNA, 21 bp, Hordeum vulgare
tctcacgtggrctgagataac

SEQ ID NO: 21389 - DNA, 21 bp, Hordeum vulgare
agacaaccacrtgagagcagc

SEQ ID NO: 21390 - DNA, 21 bp, Hordeum vulgare
tgatcccgttsgcgtcgaggt

SEQ ID NO: 21391 - DNA, 21 bp, Hordeum vulgare
gcaaaattcasgattttaaga

SEQ ID NO: 21392 - DNA, 21 bp, Hordeum vulgare
aagagaaaaasattacaagct

SEQ ID NO: 21393 - DNA, 21 bp, Hordeum vulgare
cgtagtacaamagtatcaaga

SEQ ID NO: 21394 - DNA, 21 bp, Hordeum vulgare
aacaatgacasctttggctgg

SEQ ID NO: 21395 - DNA, 21 bp, Hordeum vulgare
cagaaaatggmtttattgatt

SEQ ID NO: 21396 - DNA, 21 bp, Hordeum vulgare
aaatgagtagsgacatgccag

SEQ ID NO: 21397 - DNA, 21 bp, Hordeum vulgare
taagaaggcarataactggta

SEQ ID NO: 21398 - DNA, 21 bp, Hordeum vulgare
tacccgcggtygcaagctcct

SEQ ID NO: 21399 - DNA, 21 bp, Hordeum vulgare
gacagaaagaygttcatggtt

SEQ ID NO: 21400 - DNA, 21 bp, Hordeum vulgare
acacaaaacaragcaaatgtg

SEQ ID NO: 21401 - DNA, 21 bp, Hordeum vulgare
ttaagttctakctgattgaaa

SEQ ID NO: 21402 - DNA, 21 bp, Hordeum vulgare
cggacatgtarctgtatcaac

SEQ ID NO: 21403 - DNA, 21 bp, Hordeum vulgare
agactctgtcmcggactccag

SEQ ID NO: 21404 - DNA, 21 bp, Hordeum vulgare
tgaagcggatygatctaatgg

SEQ ID NO: 21405 - DNA, 21 bp, Hordeum vulgare
gttgtcctgcytagggtcgcc

SEQ ID NO: 21406 - DNA, 21 bp, Hordeum vulgare
  MISC_FEATURE (11): n is SNP, in which the one is g and the other is a or t or c
aaacagggganagggacaacc

SEQ ID NO: 21407 - DNA, 21 bp, Hordeum vulgare
ctttcaccgtytgagggcatg

SEQ ID NO: 21408 - DNA, 21 bp, Hordeum vulgare
  MISC_FEATURE (11): n is SNP, in which the one is a and the other is t or g or c
gctcagctgcnaggaaaataa

SEQ ID NO: 21409 - DNA, 21 bp, Hordeum vulgare
  MISC_FEATURE (11): n is SNP, in which the one is c and the other is a or t or g
gggcatcagcngatcgagcta

SEQ ID NO: 21410 - DNA, 21 bp, Hordeum vulgare
tcatatcactkattggggaac

SEQ ID NO: 21411 - DNA, 21 bp, Hordeum vulgare
actatgcactrgtatataact

SEQ ID NO: 21412 - DNA, 21 bp, Hordeum vulgare
gcgacccttgytgggggcaac

SEQ ID NO: 21413 - DNA, 21 bp, Hordeum vulgare
tctttgtcacrcgaactgccg

SEQ ID NO: 21414 - DNA, 21 bp, Hordeum vulgare
actatcagagycacactatga

SEQ ID NO: 21415 - DNA, 21 bp, Hordeum vulgare
ggctgccatcsgatgcaaacg

SEQ ID NO: 21416 - DNA, 20 bp, Hordeum vulgare
tctatggaaatacatggaag

SEQ ID NO: 21417 - DNA, 21 bp, Hordeum vulgare
tctatggaaaatacatggaag

SEQ ID NO: 21418 - DNA, 21 bp, Hordeum vulgare
gagctttcgcrctaagtgaca

SEQ ID NO: 21419 - DNA, 21 bp, Hordeum vulgare
cgagatgtacsctctgccgac

SEQ ID NO: 21420 - DNA, 21 bp, Hordeum vulgare
acgagaaaacyaaatgaaatc

SEQ ID NO: 21421 - DNA, 21 bp, Hordeum vulgare
cctcgccgtargccgcgatgt

SEQ ID NO: 21422 - DNA, 21 bp, Hordeum vulgare
tgatgtcggcygtctcgtgct

SEQ ID NO: 21423 - DNA, 21 bp, Hordeum vulgare
cacacggcgaycggagcttca

SEQ ID NO: 21424 - DNA, 21 bp, Hordeum vulgare
gtttcctctastgtaacggat

SEQ ID NO: 21425 - DNA, 21 bp, Hordeum vulgare
aatagattgtktgaatttgtg

SEQ ID NO: 21426 - DNA, 21 bp, Hordeum vulgare
cacacggcgaycggagcttca

SEQ ID NO: 21427 - DNA, 21 bp, Hordeum vulgare
gtgcatcgtamatcatcaggg

SEQ ID NO: 21428 - DNA, 21 bp, Hordeum vulgare
atgatgcaggsgctcagtgga

SEQ ID NO: 21429 - DNA, 21 bp, Hordeum vulgare
cctctttattytcatctcctc

SEQ ID NO: 21430 - DNA, 21 bp, Hordeum vulgare
tggtgttgacrgcgagcttga

SEQ ID NO: 21431 - DNA, 21 bp, Hordeum vulgare
agtagagccgkcggaactcaa

SEQ ID NO: 21432 - DNA, 21 bp, Hordeum vulgare
aaggggaaggytcacgtgcag

SEQ ID NO: 21433 - DNA, 21 bp, Hordeum vulgare
tcaaaacaaasaagctccgtc

SEQ ID NO: 21434 - DNA, 21 bp, Hordeum vulgare
ggacagggtasaagggtagag

SEQ ID NO: 21435 - DNA, 21 bp, Hordeum vulgare
ttgaaggggawctgcttcttg

SEQ ID NO: 21436 - DNA, 21 bp, Hordeum vulgare
cttgaaacggwtccggaacag

SEQ ID NO: 21437 - DNA, 21 bp, Hordeum vulgare
gaaacagattkttaaaagatt

SEQ ID NO: 21438 - DNA, 21 bp, Hordeum vulgare
cgatttagtawttcccctggt

SEQ ID NO: 21439 - DNA, 21 bp, Hordeum vulgare
acacacaaaamagaaaacaac

SEQ ID NO: 21440 - DNA, 21 bp, Hordeum vulgare
cctagtgggcrtcctcctcct

SEQ ID NO: 21441 - DNA, 21 bp, Hordeum vulgare
ggaaattttayctgcctcgat

SEQ ID NO: 21442 - DNA, 21 bp, Hordeum vulgare
cgaggccctgsgcgacgtacc

SEQ ID NO: 21443 - DNA, 21 bp, Hordeum vulgare
gctcaaactgygctgacaggc

SEQ ID NO: 21444 - DNA, 21 bp, Hordeum vulgare
acgggagcgascggcacccac

SEQ ID NO: 21445 - DNA, 21 bp, Hordeum vulgare
atcccctgccscgccttgagg

SEQ ID NO: 21446 - DNA, 21 bp, Hordeum vulgare
acaattctgaycgaacatagc

SEQ ID NO: 21447 - DNA, 21 bp, Hordeum vulgare
cctgttgctgyagctatatct

SEQ ID NO: 21448 - DNA, 21 bp, Hordeum vulgare
aaacgagatgygctgtctagt

SEQ ID NO: 21449 - DNA, 21 bp, Hordeum vulgare
ggaacttgcgsagtttcagga

SEQ ID NO: 21450 - DNA, 21 bp, Hordeum vulgare
ttattgtctgyttgtcacatg

SEQ ID NO: 21451 - DNA, 21 bp, Hordeum vulgare
ggatttctgtsctcatgaaag

SEQ ID NO: 21452 - DNA, 21 bp, Hordeum vulgare
agggaacattrgaatcagcca

SEQ ID NO: 21453 - DNA, 21 bp, Hordeum vulgare
tgaattaaccrtacggctaat

SEQ ID NO: 21454 - DNA, 21 bp, Hordeum vulgare
gcattctcggycaccgccttg

SEQ ID NO: 21455 - DNA, 21 bp, Hordeum vulgare
gcttcgctgcstctgaattaa

SEQ ID NO: 21456 - DNA, 21 bp, Hordeum vulgare
ttctagttacrggtcttcagc

SEQ ID NO: 21457 - DNA, 21 bp, Hordeum vulgare
taaagattggyctgatttgtt

SEQ ID NO: 21458 - DNA, 21 bp, Hordeum vulgare
cacctgcgctstaacatcctt

SEQ ID NO: 21459 - DNA, 21 bp, Hordeum vulgare
aaacaagtaaytgatacagtc

SEQ ID NO: 21460 - DNA, 21 bp, Hordeum vulgare
caaactttccmggggggcaaa

SEQ ID NO: 21461 - DNA, 21 bp, Hordeum vulgare
atctattcctycaaattttga

SEQ ID NO: 21462 - DNA, 21 bp, Hordeum vulgare
tccatcactcsgagcatattc

SEQ ID NO: 21463 - DNA, 21 bp, Hordeum vulgare
gtcgatctccrgctgcgccac

SEQ ID NO: 21464 - DNA, 21 bp, Hordeum vulgare
catctccggcrgtctcaacag

SEQ ID NO: 21465 - DNA, 21 bp, Hordeum vulgare
gatatgaatcrggagttgttg

SEQ ID NO: 21466 - DNA, 21 bp, Hordeum vulgare
tgtttcttttygattaaatca

SEQ ID NO: 21467 - DNA, 21 bp, Hordeum vulgare
gtaccatccgrgcaagaatcg

SEQ ID NO: 21468 - DNA, 21 bp, Hordeum vulgare
tctcagcggcyccatggtgtg

SEQ ID NO: 21469 - DNA, 21 bp, Hordeum vulgare
cgcttcacagmcgcaaaacac

SEQ ID NO: 21470 - DNA, 21 bp, Hordeum vulgare
tgcccgacgcwtccaagatct

SEQ ID NO: 21471 - DNA, 21 bp, Hordeum vulgare
  MISC_FEATURE (11): n is SNP, in which the one is a and the other is t or g or c
ctattttttanaggatgggac

SEQ ID NO: 21472 - DNA, 21 bp, Hordeum vulgare
ctttgtcatcygtatttctta

SEQ ID NO: 21473 - DNA, 21 bp, Hordeum vulgare
gggcagagtckcgccagtagc

SEQ ID NO: 21474 - DNA, 21 bp, Hordeum vulgare
ccgtgccgacrtgtgcttgct

SEQ ID NO: 21475 - DNA, 21 bp, Hordeum vulgare
tccggtgtgtmcgtgctgccc

SEQ ID NO: 21476 - DNA, 21 bp, Hordeum vulgare
ggcgggtacakacaagcaacc

SEQ ID NO: 21477 - DNA, 21 bp, Hordeum vulgare
atctccatctyattattctgc

SEQ ID NO: 21478 - DNA, 21 bp, Hordeum vulgare
aagtttcaagyagctgccgct

SEQ ID NO: 21479 - DNA, 21 bp, Hordeum vulgare
aagaaatgatmcccaaattga

SEQ ID NO: 21480 - DNA, 21 bp, Hordeum vulgare
aatgattaggsggctatcagg

SEQ ID NO: 21481 - DNA, 21 bp, Hordeum vulgare
atgctgttaawgcttgacgat

SEQ ID NO: 21482 - DNA, 21 bp, Hordeum vulgare
ctgcgagctcraccgatgatt

SEQ ID NO: 21483 - DNA, 21 bp, Hordeum vulgare
tgtgagcctcrctgcctttac

SEQ ID NO: 21484 - DNA, 21 bp, Hordeum vulgare
aaaccaaaagmagcggcacac

SEQ ID NO: 21485 - DNA, 21 bp, Hordeum vulgare
ttgatcaatastagaaactca

SEQ ID NO: 21486 - DNA, 21 bp, Hordeum vulgare
aacatgtataygaaaagatca

SEQ ID NO: 21487 - DNA, 21 bp, Hordeum vulgare
atgattacaaraagatcggag

SEQ ID NO: 21488 - DNA, 21 bp, Hordeum vulgare
tcgcatgatcrttaagaatga

SEQ ID NO: 21489 - DNA, 21 bp, Hordeum vulgare
gcaagcccttkcaataccgta

SEQ ID NO: 21490 - DNA, 21 bp, Hordeum vulgare
twcsttatggrcagtgagcag

SEQ ID NO: 21491 - DNA, 21 bp, Hordeum vulgare
attcactggtrcagacgatga

SEQ ID NO: 21492 - DNA, 21 bp, Hordeum vulgare
gcgagtagatyattaagaatt

SEQ ID NO: 21493 - DNA, 21 bp, Hordeum vulgare
ttccgctctcmccaaccgagg

SEQ ID NO: 21494 - DNA, 21 bp, Hordeum vulgare
ttactttgcaycgttgatgac

SEQ ID NO: 21495 - DNA, 21 bp, Hordeum vulgare
gagcgctggtrttgtagacga

SEQ ID NO: 21496 - DNA, 21 bp, Hordeum vulgare
gaacaaatgamagaaattttc

SEQ ID NO: 21497 - DNA, 21 bp, Hordeum vulgare
catgcacattrtagctacgta

SEQ ID NO: 21498 - DNA, 21 bp, Hordeum vulgare
tgacggcccakataagaagcc

SEQ ID NO: 21499 - DNA, 21 bp, Hordeum vulgare
tgagtccactytcagtgaaaa

SEQ ID NO: 21500 - DNA, 21 bp, Hordeum vulgare
acctccttttsaaattcatat

SEQ ID NO: 21501 - DNA, 21 bp, Hordeum vulgare
gagcgctggtrttgtagacga

SEQ ID NO: 21502 - DNA, 21 bp, Hordeum vulgare
catgcacattrtagctacgta

SEQ ID NO: 21503 - DNA, 21 bp, Hordeum vulgare
catggtgtcarctttaatata

SEQ ID NO: 21504 - DNA, 21 bp, Hordeum vulgare
gcaagcttgtyaggttaaact

SEQ ID NO: 21505 - DNA, 21 bp, Hordeum vulgare
acttgtacaarggcaagcttg

SEQ ID NO: 21506 - DNA, 21 bp, Hordeum vulgare
ctttaatataygctcgaagca

SEQ ID NO: 21507 - DNA, 21 bp, Hordeum vulgare
ctatcatctcrgaaatgtttg

SEQ ID NO: 21508 - DNA, 21 bp, Hordeum vulgare
ttgcctgtgawgtctatcttg

SEQ ID NO: 21509 - DNA, 21 bp, Hordeum vulgare
ctaatctgcasctctgctttg

SEQ ID NO: 21510 - DNA, 21 bp, Hordeum vulgare
gaaatgtttgytggcagcatg

SEQ ID NO: 21511 - DNA, 21 bp, Hordeum vulgare
cacacaaaatytcacgatgtc

SEQ ID NO: 21512 - DNA, 21 bp, Hordeum vulgare
gtatggggcawggagggaaga

SEQ ID NO: 21513 - DNA, 21 bp, Hordeum vulgare
tgttaccgtgrtttctcatct

SEQ ID NO: 21514 - DNA, 21 bp, Hordeum vulgare
tgtttgtatcmttacttgtag

SEQ ID NO: 21515 - DNA, 21 bp, Hordeum vulgare
taacgagtcakccaccgacgg

SEQ ID NO: 21516 - DNA, 21 bp, Hordeum vulgare
ttgtaagttcsacaggttact

SEQ ID NO: 21517 - DNA, 21 bp, Hordeum vulgare
ccagtacaaamgggaagttag

SEQ ID NO: 21518 - DNA, 21 bp, Hordeum vulgare
cacctgatgcracaggatgct

SEQ ID NO: 21519 - DNA, 21 bp, Hordeum vulgare
gtgcaggccgwcgaacaatgg

SEQ ID NO: 21520 - DNA, 21 bp, Hordeum vulgare
aagtcatcagwtgcttaccag

SEQ ID NO: 21521 - DNA, 21 bp, Hordeum vulgare
cataacatttkatttgaacaa

SEQ ID NO: 21522 - DNA, 21 bp, Hordeum vulgare
tgtgtgtgtgygcgcgcttgg

SEQ ID NO: 21523 - DNA, 21 bp, Hordeum vulgare
cgtattggatktggtcagagt

SEQ ID NO: 21524 - DNA, 21 bp, Hordeum vulgare
taacatgagaraggatatatt

SEQ ID NO: 21525 - DNA, 21 bp, Hordeum vulgare
caattgcatcytagttagccg

SEQ ID NO: 21526 - DNA, 21 bp, Hordeum vulgare
atacctcagcyaatctctggc

SEQ ID NO: 21527 - DNA, 21 bp, Hordeum vulgare
ggaaggtgggyacctccacga

SEQ ID NO: 21528 - DNA, 21 bp, Hordeum vulgare
gacggtcaccraggggaaact

SEQ ID NO: 21529 - DNA, 21 bp, Hordeum vulgare
gctcctggccygttcgctgca

SEQ ID NO: 21530 - DNA, 21 bp, Hordeum vulgare
gctccatggcmgtgttcacgt

SEQ ID NO: 21531 - DNA, 21 bp, Hordeum vulgare
cggcgttgtcragggtattgc

SEQ ID NO: 21532 - DNA, 21 bp, Hordeum vulgare
tatatataccrtagtttgtaa

SEQ ID NO: 21533 - DNA, 21 bp, Hordeum vulgare
atccctaaaawgggataattt

SEQ ID NO: 21534 - DNA, 21 bp, Hordeum vulgare
caccgccgctsttccccgcag

SEQ ID NO: 21535 - DNA, 21 bp, Hordeum vulgare
gaaatactcaraaataaacca

SEQ ID NO: 21536 - DNA, 21 bp, Hordeum vulgare
gagattgtgtygacagaaata

SEQ ID NO: 21537 - DNA, 21 bp, Hordeum vulgare
aacaggtgacyaatgagattg

SEQ ID NO: 21538 - DNA, 21 bp, Hordeum vulgare
  MISC_FEATURE (12),(20),(21): n stands for any base
ccgaccatgtknataatgann

SEQ ID NO: 21539 - DNA, 21 bp, Hordeum vulgare
tgttaccgtaratgttacctc

SEQ ID NO: 21540 - DNA, 21 bp, Hordeum vulgare
ttcacttgggraagacatctc

SEQ ID NO: 21541 - DNA, 21 bp, Hordeum vulgare
aggagttgatsatctgtcagg

SEQ ID NO: 21542 - DNA, 21 bp, Hordeum vulgare
ctgcgtgccasatcctgctct

SEQ ID NO: 21543 - DNA, 21 bp, Hordeum vulgare
ctgctctagtmataacagggt

SEQ ID NO: 21544 - DNA, 21 bp, Hordeum vulgare
tcgttcagggmcaaggagttg

SEQ ID NO: 21545 - DNA, 21 bp, Hordeum vulgare
gaaacttccasggaaggactg

SEQ ID NO: 21546 - DNA, 21 bp, Hordeum vulgare
acacacgccgygggaaggccc

SEQ ID NO: 21547 - DNA, 21 bp, Hordeum vulgare
atgcttaacayaagtcatatc

SEQ ID NO: 21548 - DNA, 21 bp, Hordeum vulgare
gcttcgttgtktactgggtct

SEQ ID NO: 21549 - DNA, 21 bp, Hordeum vulgare
atctcactgtyatatatcttt

SEQ ID NO: 21550 - DNA, 21 bp, Hordeum vulgare
caacaaagcawattgcctgtg

SEQ ID NO: 21551 - DNA, 21 bp, Hordeum vulgare
ccttcggcctrctaggtatat

SEQ ID NO: 21552 - DNA, 21 bp, Hordeum vulgare
agcttggtgcrccaaaatccc

SEQ ID NO: 21553 - DNA, 21 bp, Hordeum vulgare
accacctcaayagaacgcgca

SEQ ID NO: 21554 - DNA, 21 bp, Hordeum vulgare
atgcttgagamttgtaaccgt

SEQ ID NO: 21555 - DNA, 21 bp, Hordeum vulgare
gcattggtagycaaatgtcat

SEQ ID NO: 21556 - DNA, 21 bp, Hordeum vulgare
agcagagcagmttacggaaga

SEQ ID NO: 21557 - DNA, 21 bp, Hordeum vulgare
caggatggackgtgaaacata

SEQ ID NO: 21558 - DNA, 21 bp, Hordeum vulgare
agaaaaagaaraactttcaga

SEQ ID NO: 21559 - DNA, 21 bp, Hordeum vulgare
attatctgtaygtacataacg

SEQ ID NO: 21560 - DNA, 21 bp, Hordeum vulgare
gaaaccgaagygcggctagtc

SEQ ID NO: 21561 - DNA, 21 bp, Hordeum vulgare
atttgtcctcrgggttcatct

SEQ ID NO: 21562 - DNA, 21 bp, Hordeum vulgare
ttgccttgaakgcaaaccttg

SEQ ID NO: 21563 - DNA, 21 bp, Hordeum vulgare
cattctcttcrtgcgaaacta

SEQ ID NO: 21564 - DNA, 21 bp, Hordeum vulgare
tccacccgtckgtcctttgct

SEQ ID NO: 21565 - DNA, 21 bp, Hordeum vulgare
acacctcgccrtcgtcgccgc

SEQ ID NO: 21566 - DNA, 21 bp, Hordeum vulgare
agccaacatgrtactctctat

SEQ ID NO: 21567 - DNA, 21 bp, Hordeum vulgare
gcacccgggckccgaccacgt

SEQ ID NO: 21568 - DNA, 21 bp, Hordeum vulgare
tcaatgatagytactttcaag

SEQ ID NO: 21569 - DNA, 21 bp, Hordeum vulgare
tgtgacatgakagctcacctc

SEQ ID NO: 21570 - DNA, 21 bp, Hordeum vulgare
cacaatctgcrtcatacagaa

SEQ ID NO: 21571 - DNA, 21 bp, Hordeum vulgare
agccttttgtrtttcatagaa

SEQ ID NO: 21572 - DNA, 21 bp, Hordeum vulgare
gagagtagaaragagagagca

SEQ ID NO: 21573 - DNA, 21 bp, Hordeum vulgare
ccgtggcgtarcggcaccttt

SEQ ID NO: 21574 - DNA, 21 bp, Hordeum vulgare
cagtttggttycgaaaggtaa

SEQ ID NO: 21575 - DNA, 21 bp, Hordeum vulgare
tgaacatacartgagagagct

SEQ ID NO: 21576 - DNA, 21 bp, Hordeum vulgare
cgcggttgccrtgcaacatgt

SEQ ID NO: 21577 - DNA, 21 bp, Hordeum vulgare
accggccaggraaaaaatccc

SEQ ID NO: 21578 - DNA, 21 bp, Hordeum vulgare
atcatcacctygtagcaggat

SEQ ID NO: 21579 - DNA, 21 bp, Hordeum vulgare
  MISC_FEATURE (11),(15): n is SNP, in which the one is c and the other is a or t or g
gagcacaggcnaganaattac

SEQ ID NO: 21580 - DNA, 21 bp, Hordeum vulgare
caatgtcccgraggatacgga

SEQ ID NO: 21581 - DNA, 21 bp, Hordeum vulgare
gcatccgctgrggctggtgca

SEQ ID NO: 21582 - DNA, 21 bp, Hordeum vulgare
gcacccttgtyatcgtccaac

SEQ ID NO: 21583 - DNA, 21 bp, Hordeum vulgare
cagcacaggtycatagatgga

SEQ ID NO: 21584 - DNA, 21 bp, Hordeum vulgare
aagaacagctraaacatatat

SEQ ID NO: 21585 - DNA, 21 bp, Hordeum vulgare
tgggggcggckcccagcactc

SEQ ID NO: 21586 - DNA, 21 bp, Hordeum vulgare
cagcatcttcraatgctgaga

SEQ ID NO: 21587 - DNA, 21 bp, Hordeum vulgare
agacaccgacygcagttgacg

SEQ ID NO: 21588 - DNA, 21 bp, Hordeum vulgare
acccgatcggmagcggcgcca

SEQ ID NO: 21589 - DNA, 21 bp, Hordeum vulgare
cggtaggcacscaagagctcc

SEQ ID NO: 21590 - DNA, 21 bp, Hordeum vulgare
ccactgccaartttcaagaag

SEQ ID NO: 21591 - DNA, 21 bp, Hordeum vulgare
taagaagactycatccacagt

SEQ ID NO: 21592 - DNA, 21 bp, Hordeum vulgare
atttctgaatycctcttcctc

SEQ ID NO: 21593 - DNA, 21 bp, Hordeum vulgare
taatttcaatktcacatccag

SEQ ID NO: 21594 - DNA, 21 bp, Hordeum vulgare
tgggcgtggtsggcaacccgt

SEQ ID NO: 21595 - DNA, 21 bp, Hordeum vulgare
gtgagcgatakgcatgagcat

SEQ ID NO: 21596 - DNA, 21 bp, Hordeum vulgare
aggatcacccsggctttcctc

SEQ ID NO: 21597 - DNA, 21 bp, Hordeum vulgare
acctccatgtstgacctgaca

SEQ ID NO: 21598 - DNA, 21 bp, Hordeum vulgare
atagcagcaggatcacttcac

SEQ ID NO: 21599 - DNA, 20 bp, Hordeum vulgare
atagcagcagatcacttcac

SEQ ID NO: 21600 - DNA, 21 bp, Hordeum vulgare
cttgcttgctsacatggtgag

SEQ ID NO: 21601 - DNA, 21 bp, Hordeum vulgare
ctgagactgcrggcgacacac

SEQ ID NO: 21602 - DNA, 21 bp, Hordeum vulgare
cgacacacgcracaagaacag

SEQ ID NO: 21603 - DNA, 21 bp, Hordeum vulgare
gggtccgccgycgcagccccc

SEQ ID NO: 21604 - DNA, 21 bp, Hordeum vulgare
cacgcccaccrggctctgcag

SEQ ID NO: 21605 - DNA, 21 bp, Hordeum vulgare
cgtccatggayacagaacatg

SEQ ID NO: 21606 - DNA, 21 bp, Hordeum vulgare
  MISC_FEATURE (3),(18)..(21): n stands for any base
aanatgtgattcctatannnn

SEQ ID NO: 21607 - DNA, 20 bp, Hordeum vulgare
  MISC_FEATURE (3),(17),(18),(19),(20): n stands for any base
aanatgtgatcctatannnn

SEQ ID NO: 21608 - DNA, 21 bp, Hordeum vulgare
  MISC_FEATURE (11): n is SNP, in which the one is g and the other is a or t or c
ccactcttgancacatcttca

SEQ ID NO: 21609 - DNA, 21 bp, Hordeum vulgare
tcttgatgacratcatgtgtt

SEQ ID NO: 21610 - DNA, 21 bp, Hordeum vulgare
ccagcatgatrttgatggagg

SEQ ID NO: 21611 - DNA, 21 bp, Hordeum vulgare
tttggtgtaasaaggaagaaa

SEQ ID NO: 21612 - DNA, 21 bp, Hordeum vulgare
tgcaggtgcckcccagcatga

SEQ ID NO: 21613 - DNA, 21 bp, Hordeum vulgare
tgctggttccsgggatcgagc

SEQ ID NO: 21614 - DNA, 21 bp, Hordeum vulgare
ctccgtgcggyggctggtcag

SEQ ID NO: 21615 - DNA, 21 bp, Hordeum vulgare
tcatgctcgtytacgagtatc

SEQ ID NO: 21616 - DNA, 21 bp, Hordeum vulgare
atttcatttayaaaaacatac

SEQ ID NO: 21617 - DNA, 21 bp, Hordeum vulgare
acctctgtacmataatataag

SEQ ID NO: 21618 - DNA, 21 bp, Hordeum vulgare
aaagaacacayacaaaaaacc

SEQ ID NO: 21619 - DNA, 21 bp, Hordeum vulgare
gaagcattgawtcaaagcctg

SEQ ID NO: 21620 - DNA, 21 bp, Hordeum vulgare
aggcgtgtcayagagaagcat

SEQ ID NO: 21621 - DNA, 21 bp, Hordeum vulgare
cccccgccgcygcatagatgg

SEQ ID NO: 21622 - DNA, 21 bp, Hordeum vulgare
ttgttgaacargtagaccccc

SEQ ID NO: 21623 - DNA, 21 bp, Hordeum vulgare
ttgttcatccmatcacatccc

SEQ ID NO: 21624 - DNA, 21 bp, Hordeum vulgare
ccgacatcatrttatttatct

SEQ ID NO: 21625 - DNA, 21 bp, Hordeum vulgare
ttgttgtaagygatcagtcta

SEQ ID NO: 21626 - DNA, 21 bp, Hordeum vulgare
cgcccatcacraagctctgca

SEQ ID NO: 21627 - DNA, 21 bp, Hordeum vulgare
gctcaccgccrtgacgaaaac

SEQ ID NO: 21628 - DNA, 21 bp, Hordeum vulgare
cttgaaatgcrtagatttgtg

SEQ ID NO: 21629 - DNA, 21 bp, Hordeum vulgare
tccttgcatcygtctcaccat

SEQ ID NO: 21630 - DNA, 21 bp, Hordeum vulgare
gttcggcccgyggaaaggcag

SEQ ID NO: 21631 - DNA, 21 bp, Hordeum vulgare
ttaggaagagsgcgagatagg

SEQ ID NO: 21632 - DNA, 21 bp, Hordeum vulgare
ggatcgccccrccctctggaa

SEQ ID NO: 21633 - DNA, 21 bp, Hordeum vulgare
agtgttccggsagaagctccg

SEQ ID NO: 21634 - DNA, 21 bp, Hordeum vulgare
agatccactarcatctccgta

SEQ ID NO: 21635 - DNA, 21 bp, Hordeum vulgare
aatcaaactcmagagaaggaa

SEQ ID NO: 21636 - DNA, 21 bp, Hordeum vulgare
taggcggcgaygctgcaacat

SEQ ID NO: 21637 - DNA, 21 bp, Hordeum vulgare
ctattcagtcmcctcctacaa

SEQ ID NO: 21638 - DNA, 21 bp, Hordeum vulgare
tttggttctcrcctttgttta

SEQ ID NO: 21639 - DNA, 21 bp, Hordeum vulgare
ccagttttagsttctcatgtg

SEQ ID NO: 21640 - DNA, 21 bp, Hordeum vulgare
ctcccctgtcrgtggattata

SEQ ID NO: 21641 - DNA, 21 bp, Hordeum vulgare
ttgtgttgttrtgttaggatt

SEQ ID NO: 21642 - DNA, 21 bp, Hordeum vulgare
ggcatgttttsaatgtgaaaa

SEQ ID NO: 21643 - DNA, 21 bp, Hordeum vulgare
ttataaggccstaaatctaaa

SEQ ID NO: 21644 - DNA, 21 bp, Hordeum vulgare
ccatgcttccsaggacagagc

SEQ ID NO: 21645 - DNA, 21 bp, Hordeum vulgare
tgatgatccgygggggaaggt

SEQ ID NO: 21646 - DNA, 21 bp, Hordeum vulgare
aacagctaagsgtatttgggc

SEQ ID NO: 21647 - DNA, 21 bp, Hordeum vulgare
tttcagaagcrgattgaaact

SEQ ID NO: 21648 - DNA, 21 bp, Hordeum vulgare
ctttagaagarctacctcacc

SEQ ID NO: 21649 - DNA, 21 bp, Hordeum vulgare
ttcaggcacaracatcaggta

SEQ ID NO: 21650 - DNA, 21 bp, Hordeum vulgare
ggttgatggcracccacagca

SEQ ID NO: 21651 - DNA, 21 bp, Hordeum vulgare
ggcccttggcraacgggtaca

SEQ ID NO: 21652 - DNA, 21 bp, Hordeum vulgare
agttctgggayggcgggttga

SEQ ID NO: 21653 - DNA, 21 bp, Hordeum vulgare
cggcgaactcrtcgttttcgt

SEQ ID NO: 21654 - DNA, 21 bp, Hordeum vulgare
cagcagacaayatgggggaag

SEQ ID NO: 21655 - DNA, 21 bp, Hordeum vulgare
tgacgaggggmgcgggctcag

SEQ ID NO: 21656 - DNA, 21 bp, Hordeum vulgare
atcatcatcaycatcaatctc

SEQ ID NO: 21657 - DNA, 21 bp, Hordeum vulgare
agttctgggayggcgggttga

SEQ ID NO: 21658 - DNA, 21 bp, Hordeum vulgare
actgcgaggakcttagcagta

SEQ ID NO: 21659 - DNA, 21 bp, Hordeum vulgare
ctgatagatakggagtttacc

SEQ ID NO: 21660 - DNA, 21 bp, Hordeum vulgare
caagcaaacarccaatggtca

SEQ ID NO: 21661 - DNA, 21 bp, Hordeum vulgare
agcagaaaaayaatgtttaat

SEQ ID NO: 21662 - DNA, 21 bp, Hordeum vulgare
agattttgttsactgaccgac

SEQ ID NO: 21663 - DNA, 21 bp, Hordeum vulgare
ttgttgttgtmcacggaagaa

SEQ ID NO: 21664 - DNA, 21 bp, Hordeum vulgare
atcaagattgytagcaggacg

SEQ ID NO: 21665 - DNA, 21 bp, Hordeum vulgare
accacttgaartatcttactt

SEQ ID NO: 21666 - DNA, 21 bp, Hordeum vulgare
atactactgaracacgatatc

SEQ ID NO: 21667 - DNA, 21 bp, Hordeum vulgare
ttattgtggtyggggtggtgg

SEQ ID NO: 21668 - DNA, 21 bp, Hordeum vulgare
gatggatggcrgaagggcggg

SEQ ID NO: 21669 - DNA, 21 bp, Hordeum vulgare
cacaacacaarcgatgaaaga

SEQ ID NO: 21670 - DNA, 21 bp, Hordeum vulgare
gccggcgttarcagagccagg

SEQ ID NO: 21671 - DNA, 21 bp, Hordeum vulgare
agtaggccatrctggctggcg

SEQ ID NO: 21672 - DNA, 21 bp, Hordeum vulgare
tccagtttgcsaaggacggct

SEQ ID NO: 21673 - DNA, 21 bp, Hordeum vulgare
ctataaacacraacaagactc

SEQ ID NO: 21674 - DNA, 21 bp, Hordeum vulgare
tcgcaaatatwagaaagaagc

SEQ ID NO: 21675 - DNA, 21 bp, Hordeum vulgare
gatggatggcrgaagggcggg

SEQ ID NO: 21676 - DNA, 21 bp, Hordeum vulgare
ttattgtggtyggggtggtgg

SEQ ID NO: 21677 - DNA, 21 bp, Hordeum vulgare
cgagcttcctytggaggagag

SEQ ID NO: 21678 - DNA, 21 bp, Hordeum vulgare
tgttggacagsaaatcgtacg

SEQ ID NO: 21679 - DNA, 21 bp, Hordeum vulgare
gtacgtgacarctgacaagac

SEQ ID NO: 21680 - DNA, 21 bp, Hordeum vulgare
gcgctctcccrgagctccagc

SEQ ID NO: 21681 - DNA, 21 bp, Hordeum vulgare
aaacaacacgrccgagacggt

SEQ ID NO: 21682 - DNA, 21 bp, Hordeum vulgare
tgcttctgcayatatgtctta

SEQ ID NO: 21683 - DNA, 21 bp, Hordeum vulgare
gctcacatcartgaccgccgc

SEQ ID NO: 21684 - DNA, 21 bp, Hordeum vulgare
gtggaggcggkgctccatggc

SEQ ID NO: 21685 - DNA, 21 bp, Hordeum vulgare
ccgcctccgtyttctcggcca

SEQ ID NO: 21686 - DNA, 21 bp, Hordeum vulgare
cccgctcgtgmgccagctcac

SEQ ID NO: 21687 - DNA, 21 bp, Hordeum vulgare
ggctcccaatkcccaggtacc

SEQ ID NO: 21688 - DNA, 21 bp, Hordeum vulgare
atcaagccggmcagcagccag

SEQ ID NO: 21689 - DNA, 21 bp, Hordeum vulgare
cctcctcttcrtcatcatcaa

SEQ ID NO: 21690 - DNA, 21 bp, Hordeum vulgare
taaacaaaaawcaaaagggta

SEQ ID NO: 21691 - DNA, 21 bp, Hordeum vulgare
acagatcaggktaaggcattt

SEQ ID NO: 21692 - DNA, 21 bp, Hordeum vulgare
caatttacaaycttccaaaga

SEQ ID NO: 21693 - DNA, 21 bp, Hordeum vulgare
ggggcatgacyaatatgaaca

SEQ ID NO: 21694 - DNA, 20 bp, Hordeum vulgare
attgcttctcagatcaaacc

SEQ ID NO: 21695 - DNA, 21 bp, Hordeum vulgare
attgcttctcggagtcaaacc

SEQ ID NO: 21696 - DNA, 21 bp, Hordeum vulgare
cagcgtgcggkatgccacatc

SEQ ID NO: 21697 - DNA, 21 bp, Hordeum vulgare
catccttttaygttgattcat

SEQ ID NO: 21698 - DNA, 21 bp, Hordeum vulgare
tgcttgcccamcagcagcgcc

SEQ ID NO: 21699 - DNA, 21 bp, Hordeum vulgare
  MISC_FEATURE (11): n is SNP, in which the one is t and the other is a or g or c
taccgtcgctnaaataccatc

SEQ ID NO: 21700 - DNA, 21 bp, Hordeum vulgare
tcttcacttamacaaatccag

SEQ ID NO: 21701 - DNA, 21 bp, Hordeum vulgare
aaatagctcayaccagtgatt

SEQ ID NO: 21702 - DNA, 21 bp, Hordeum vulgare
catggtttgcyatgttagata

SEQ ID NO: 21703 - DNA, 21 bp, Hordeum vulgare
taatttgcaartcccaagtga

SEQ ID NO: 21704 - DNA, 21 bp, Hordeum vulgare
gggtgacgackcgtgaaaaac

SEQ ID NO: 21705 - DNA, 21 bp, Hordeum vulgare
acacatgcatrcgcatcctgg

SEQ ID NO: 21706 - DNA, 21 bp, Hordeum vulgare
tcatctgggcrcctctatgcc

SEQ ID NO: 21707 - DNA, 21 bp, Hordeum vulgare
caacttctacktacatacttg

SEQ ID NO: 21708 - DNA, 21 bp, Hordeum vulgare
atgactccggmgctttaccaa

SEQ ID NO: 21709 - DNA, 21 bp, Hordeum vulgare
aagcagcacarcgccgtgaac

SEQ ID NO: 21710 - DNA, 21 bp, Hordeum vulgare
tgggggtctcygctgcgcctt

SEQ ID NO: 21711 - DNA, 21 bp, Hordeum vulgare
gtgctagctaktaatatgcag

SEQ ID NO: 21712 - DNA, 21 bp, Hordeum vulgare
aaaaaaaaaamaaaaaaaaaa

SEQ ID NO: 21713 - DNA, 21 bp, Hordeum vulgare
ttttacaactsgcaacacaat

SEQ ID NO: 21714 - DNA, 21 bp, Hordeum vulgare
acccacaaaakcctccaatta

SEQ ID NO: 21715 - DNA, 21 bp, Hordeum vulgare
gcgtttagagyatttacacca

SEQ ID NO: 21716 - DNA, 21 bp, Hordeum vulgare
acaaatgtaakcaaaaaccag

SEQ ID NO: 21717 - DNA, 21 bp, Hordeum vulgare
acattgtttawtgtgacaaat

SEQ ID NO: 21718 - DNA, 21 bp, Hordeum vulgare
acccacaaaakcctccaatta

SEQ ID NO: 21719 - DNA, 21 bp, Hordeum vulgare
ttcagacactratgctccgta

SEQ ID NO: 21720 - DNA, 21 bp, Hordeum vulgare
atgtaactctrcatggcaaag

SEQ ID NO: 21721 - DNA, 21 bp, Hordeum vulgare
ggttgactaayagaactccag

SEQ ID NO: 21722 - DNA, 21 bp, Hordeum vulgare
ctaatgctacmttaagtccca

SEQ ID NO: 21723 - DNA, 21 bp, Hordeum vulgare
ccagagattascagccaaatt

SEQ ID NO: 21724 - DNA, 21 bp, Hordeum vulgare
ttaagtcccaygtaagccatt

SEQ ID NO: 21725 - DNA, 21 bp, Hordeum vulgare
acagctctggmctgtggtggc

SEQ ID NO: 21726 - DNA, 21 bp, Hordeum vulgare
gcagagagcaraaataggtgc

SEQ ID NO: 21727 - DNA, 21 bp, Hordeum vulgare
tccttttgatrccgaggtcgg

SEQ ID NO: 21728 - DNA, 21 bp, Hordeum vulgare
agtgcctcctmgccagcgaca

SEQ ID NO: 21729 - DNA, 21 bp, Hordeum vulgare
tggctctatgwaggaatcttc

SEQ ID NO: 21730 - DNA, 21 bp, Hordeum vulgare
atttagatgartcgactatac

SEQ ID NO: 21731 - DNA, 21 bp, Hordeum vulgare
cattcctcatrtaccatttag

SEQ ID NO: 21732 - DNA, 21 bp, Hordeum vulgare
aaaataattcwgtacttctgg

SEQ ID NO: 21733 - DNA, 21 bp, Hordeum vulgare
gttttacctgytgcggccctt

SEQ ID NO: 21734 - DNA, 21 bp, Hordeum vulgare
atgagtttagkgcgtcgagct

SEQ ID NO: 21735 - DNA, 21 bp, Hordeum vulgare
taaggaaaaawttcgcacttg

SEQ ID NO: 21736 - DNA, 21 bp, Hordeum vulgare
tggtcaccttrcacatgtctg

SEQ ID NO: 21737 - DNA, 21 bp, Hordeum vulgare
gatcgcaagaygcgaactgct

SEQ ID NO: 21738 - DNA, 21 bp, Hordeum vulgare
gcgctacagakacagccggcg

SEQ ID NO: 21739 - DNA, 21 bp, Hordeum vulgare
tcgctctaggwctaggactag

SEQ ID NO: 21740 - DNA, 21 bp, Hordeum vulgare
actaggacagratggccgggt

SEQ ID NO: 21741 - DNA, 21 bp, Hordeum vulgare
aggttggtacraaattttgaa

SEQ ID NO: 21742 - DNA, 21 bp, Hordeum vulgare
ctgtgttgggkgatatacatg

SEQ ID NO: 21743 - DNA, 21 bp, Hordeum vulgare
cgacgacgacratgaggtttt

SEQ ID NO: 21744 - DNA, 21 bp, Hordeum vulgare
atgcatgcacrgactgaggtg

SEQ ID NO: 21745 - DNA, 21 bp, Hordeum vulgare
ataataataayataatgataa

SEQ ID NO: 21746 - DNA, 21 bp, Hordeum vulgare
cgcgatgtcayaatctcgtca

SEQ ID NO: 21747 - DNA, 21 bp, Hordeum vulgare
acaaaactggrattagaatgt

SEQ ID NO: 21748 - DNA, 21 bp, Hordeum vulgare
ctagaccgctsatctcagttt

SEQ ID NO: 21749 - DNA, 21 bp, Hordeum vulgare
tcttctgttcmatgaccgcct

SEQ ID NO: 21750 - DNA, 21 bp, Hordeum vulgare
tggagaagccwgttcactatg

SEQ ID NO: 21751 - DNA, 21 bp, Hordeum vulgare
ttcttaagaakgtagtcggtg

SEQ ID NO: 21752 - DNA, 21 bp, Hordeum vulgare
ctctaccaatrcctaggggcc

SEQ ID NO: 21753 - DNA, 21 bp, Hordeum vulgare
gacattccgayggaactagcc

SEQ ID NO: 21754 - DNA, 21 bp, Hordeum vulgare
taggtacatckatacgcaact

SEQ ID NO: 21755 - DNA, 21 bp, Hordeum vulgare
ggaaccgcccrtccgaggagt

SEQ ID NO: 21756 - DNA, 21 bp, Hordeum vulgare
gacaccgtccrggtgccacgc

SEQ ID NO: 21757 - DNA, 21 bp, Hordeum vulgare
gtcccacaccyggcaggtctt

SEQ ID NO: 21758 - DNA, 21 bp, Hordeum vulgare
tgcaacagatscgtctaactt

SEQ ID NO: 21759 - DNA, 21 bp, Hordeum vulgare
gacgaggtgayggctactggt

SEQ ID NO: 21760 - DNA, 21 bp, Hordeum vulgare
tactggtcatsgtctgaactc

SEQ ID NO: 21761 - DNA, 21 bp, Hordeum vulgare
gtccattggayttcgattgaa

SEQ ID NO: 21762 - DNA, 21 bp, Hordeum vulgare
agactccgtcracttccagca

SEQ ID NO: 21763 - DNA, 21 bp, Hordeum vulgare
tcgatctgcawtttcagtaaa

SEQ ID NO: 21764 - DNA, 21 bp, Hordeum vulgare
gtttcaggaarttctacagtt

SEQ ID NO: 21765 - DNA, 21 bp, Hordeum vulgare
cgaagatgatygccgcacatc

SEQ ID NO: 21766 - DNA, 21 bp, Hordeum vulgare
tcgggacatakctggtggcgg

SEQ ID NO: 21767 - DNA, 21 bp, Hordeum vulgare
tttttacaggygacttgcttc

SEQ ID NO: 21768 - DNA, 21 bp, Hordeum vulgare
catctgcaagyataaagacaa

SEQ ID NO: 21769 - DNA, 21 bp, Hordeum vulgare
ataaagacaayggtcagtcaa

SEQ ID NO: 21770 - DNA, 21 bp, Hordeum vulgare
cgggccgtagstggcctggtt

SEQ ID NO: 21771 - DNA, 21 bp, Hordeum vulgare
ctccttgagcytgaacggtcc

SEQ ID NO: 21772 - DNA, 21 bp, Hordeum vulgare
atgcacactgsatgaaggatg

SEQ ID NO: 21773 - DNA, 21 bp, Hordeum vulgare
aggtaaatagrgtgtgcgagt

SEQ ID NO: 21774 - DNA, 21 bp, Hordeum vulgare
ttgaaaccagkgagtgtgttt

SEQ ID NO: 21775 - DNA, 21 bp, Hordeum vulgare
agctaagggcrgtctacttct

SEQ ID NO: 21776 - DNA, 21 bp, Hordeum vulgare
acttttattayggaattgaga

SEQ ID NO: 21777 - DNA, 21 bp, Hordeum vulgare
atgctcagatsatgagcattt

SEQ ID NO: 21778 - DNA, 21 bp, Hordeum vulgare
tcttgtgcctkccacctcgcc

SEQ ID NO: 21779 - DNA, 21 bp, Hordeum vulgare
tctacacacamaaaaaatact

SEQ ID NO: 21780 - DNA, 21 bp, Hordeum vulgare
atgacacagayggattcaaca

SEQ ID NO: 21781 - DNA, 21 bp, Hordeum vulgare
agttggataaygtgttcatga

SEQ ID NO: 21782 - DNA, 21 bp, Hordeum vulgare
agaaagaatgracacatgtat

SEQ ID NO: 21783 - DNA, 21 bp, Hordeum vulgare
tctccattacsagcttcatgt

SEQ ID NO: 21784 - DNA, 21 bp, Hordeum vulgare
cctcttcactrggatctccac

SEQ ID NO: 21785 - DNA, 21 bp, Hordeum vulgare
tagtcttcatrgcctctgact

SEQ ID NO: 21786 - DNA, 21 bp, Hordeum vulgare
tatttaagcastcatgtgatc

SEQ ID NO: 21787 - DNA, 21 bp, Hordeum vulgare
tggtttgctcrtgcaattcta

SEQ ID NO: 21788 - DNA, 21 bp, Hordeum vulgare
racatgacttrgaactatcct

SEQ ID NO: 21789 - DNA, 20 bp, Hordeum vulgare
gtgtacctgagcattcagaa

SEQ ID NO: 21790 - DNA, 21 bp, Hordeum vulgare
gtgtacctgaccatttcagaa

SEQ ID NO: 21791 - DNA, 21 bp, Hordeum vulgare
tcagcctctcygagtagagct

SEQ ID NO: 21792 - DNA, 21 bp, Hordeum vulgare
ttgctcccctsatcagaggwa

SEQ ID NO: 21793 - DNA, 21 bp, Hordeum vulgare
cgatcactcgycctttggtta

SEQ ID NO: 21794 - DNA, 21 bp, Hordeum vulgare
acctgcacggmagatgcgccg

SEQ ID NO: 21795 - DNA, 21 bp, Hordeum vulgare
tagcggcgtcrtcacgtgatc

SEQ ID NO: 21796 - DNA, 21 bp, Hordeum vulgare
gtgtaagcaasttactgttat

SEQ ID NO: 21797 - DNA, 21 bp, Hordeum vulgare
caggacatagkccctcatgag

SEQ ID NO: 21798 - DNA, 21 bp, Hordeum vulgare
tctgtaaaacyaacatcaggt

SEQ ID NO: 21799 - DNA, 21 bp, Hordeum vulgare
taggatcctgygtgtagaagg

SEQ ID NO: 21800 - DNA, 21 bp, Hordeum vulgare
ggggtatctgyctgcggccat

SEQ ID NO: 21801 - DNA, 21 bp, Hordeum vulgare
cgccaaactartaggacaaaa

SEQ ID NO: 21802 - DNA, 21 bp, Hordeum vulgare
taaaaagaagyacaatatgat

SEQ ID NO: 21803 - DNA, 21 bp, Hordeum vulgare
ggcagtacacragcttccgag

SEQ ID NO: 21804 - DNA, 21 bp, Hordeum vulgare
agtctttttaragattccact

SEQ ID NO: 21805 - DNA, 21 bp, Hordeum vulgare
gtaagaaagargattgtcact

SEQ ID NO: 21806 - DNA, 21 bp, Hordeum vulgare
ttttatttccygctttgtaag

SEQ ID NO: 21807 - DNA, 21 bp, Hordeum vulgare
tcgtgcaggcytgaacaggtg

SEQ ID NO: 21808 - DNA, 21 bp, Hordeum vulgare
gtctcgtctcscccatcctgc

SEQ ID NO: 21809 - DNA, 21 bp, Hordeum vulgare
ccctggactastgaggaagac

SEQ ID NO: 21810 - DNA, 21 bp, Hordeum vulgare
cagttcctctrgaacagagct

SEQ ID NO: 21811 - DNA, 21 bp, Hordeum vulgare
tatatgaagcrctccagcacg

SEQ ID NO: 21812 - DNA, 21 bp, Hordeum vulgare
tgtcctgagtygcagcccttg

SEQ ID NO: 21813 - DNA, 21 bp, Hordeum vulgare
atctcttcctygggaaccgct

SEQ ID NO: 21814 - DNA, 21 bp, Hordeum vulgare
caaattcagcrtaaggcggta

SEQ ID NO: 21815 - DNA, 21 bp, Hordeum vulgare
ttcgtgtagtrgcgagatgtg

SEQ ID NO: 21816 - DNA, 21 bp, Hordeum vulgare
gacgcttagcytctctctccg

SEQ ID NO: 21817 - DNA, 21 bp, Hordeum vulgare
agtcaaccgaracgcacacaa

SEQ ID NO: 21818 - DNA, 21 bp, Hordeum vulgare
cagttcctctrgaacagagct

SEQ ID NO: 21819 - DNA, 21 bp, Hordeum vulgare
cgggtgtagtkgcaccagccg

SEQ ID NO: 21820 - DNA, 21 bp, Hordeum vulgare
atgttcatgcrtctctctata

SEQ ID NO: 21821 - DNA, 21 bp, Hordeum vulgare
tctatatacaractaaatgtc

SEQ ID NO: 21822 - DNA, 21 bp, Hordeum vulgare
acttgaaaaaraaaatgtgat

SEQ ID NO: 21823 - DNA, 21 bp, Hordeum vulgare
cttacctccakaccgcagtca

SEQ ID NO: 21824 - DNA, 21 bp, Hordeum vulgare
gtacaaagtcygaatgttcat

SEQ ID NO: 21825 - DNA, 21 bp, Hordeum vulgare
caacagatcawgctttcgtag

SEQ ID NO: 21826 - DNA, 21 bp, Hordeum vulgare
gcgcagctgasaaatgacatt

SEQ ID NO: 21827 - DNA, 21 bp, Hordeum vulgare
aagctcaaccmtagccttctt

SEQ ID NO: 21828 - DNA, 21 bp, Hordeum vulgare
gggcttcatamcatcaagctc

SEQ ID NO: 21829 - DNA, 21 bp, Hordeum vulgare
ccaacatcaargtgtggttcg

SEQ ID NO: 21830 - DNA, 21 bp, Hordeum vulgare
catcgaggcaracttcttaaa

SEQ ID NO: 21831 - DNA, 21 bp, Hordeum vulgare
caatgcggtayccctcgacgg

SEQ ID NO: 21832 - DNA, 21 bp, Hordeum vulgare
tatttcaacaygcagtgcaac

SEQ ID NO: 21833 - DNA, 21 bp, Hordeum vulgare
gaaatattacsaatagcacac

SEQ ID NO: 21834 - DNA, 21 bp, Hordeum vulgare
cggctaggccragtgggtcaa

SEQ ID NO: 21835 - DNA, 21 bp, Hordeum vulgare
tcgctcccacrtctgaagttc

SEQ ID NO: 21836 - DNA, 21 bp, Hordeum vulgare
caggtgctggktcagtgctca

SEQ ID NO: 21837 - DNA, 21 bp, Hordeum vulgare
catcgtcaaarttattaaaca

SEQ ID NO: 21838 - DNA, 21 bp, Hordeum vulgare
aaaagtgagtkacaagatttc

SEQ ID NO: 21839 - DNA, 21 bp, Hordeum vulgare
tgattgggcgyttcaagtggg

SEQ ID NO: 21840 - DNA, 21 bp, Hordeum vulgare
catcaaatatkgtctgatcag

SEQ ID NO: 21841 - DNA, 21 bp, Hordeum vulgare
gccggtaggcratgtgctgga

SEQ ID NO: 21842 - DNA, 21 bp, Hordeum vulgare
ggcataccgckgacgaccggc

SEQ ID NO: 21843 - DNA, 21 bp, Hordeum vulgare
agaaaaggacscggcataccg

SEQ ID NO: 21844 - DNA, 21 bp, Hordeum vulgare
gcgcgtcgcakacgaactccc

SEQ ID NO: 21845 - DNA, 21 bp, Hordeum vulgare
cgaagaagttkgtcttgccct

SEQ ID NO: 21846 - DNA, 21 bp, Hordeum vulgare
atcactccgtstaactgtcac

SEQ ID NO: 21847 - DNA, 21 bp, Hordeum vulgare
gactcaagacrcagataaatt

SEQ ID NO: 21848 - DNA, 21 bp, Hordeum vulgare
ttattgacggscaagcgaagc

SEQ ID NO: 21849 - DNA, 21 bp, Hordeum vulgare
aacacaccttscacattcatt

SEQ ID NO: 21850 - DNA, 21 bp, Hordeum vulgare
acttacagcgsctacagaatg

SEQ ID NO: 21851 - DNA, 21 bp, Hordeum vulgare
caagaaagtamttttggaaaa

SEQ ID NO: 21852 - DNA, 21 bp, Hordeum vulgare
ttaatctggaytttttgaagg

SEQ ID NO: 21853 - DNA, 21 bp, Hordeum vulgare
ctgattacaasgcaccaatta

SEQ ID NO: 21854 - DNA, 21 bp, Hordeum vulgare
acagcaggtaytgtgattaag

SEQ ID NO: 21855 - DNA, 21 bp, Hordeum vulgare
tcgggcatcamcagtcacagc

SEQ ID NO: 21856 - DNA, 21 bp, Hordeum vulgare
aaacctgatayccaaatgagg

SEQ ID NO: 21857 - DNA, 21 bp, Hordeum vulgare
agaagaaatcragtcgtcttg

SEQ ID NO: 21858 - DNA, 21 bp, Hordeum vulgare
agagttttacragatacccat

SEQ ID NO: 21859 - DNA, 21 bp, Hordeum vulgare
caactctacaktttttttgta

SEQ ID NO: 21860 - DNA, 21 bp, Hordeum vulgare
acctaacagtyggcgccaacg

SEQ ID NO: 21861 - DNA, 21 bp, Hordeum vulgare
tgagacatctyaaaccttcac

SEQ ID NO: 21862 - DNA, 21 bp, Hordeum vulgare
ccccaaactartagatgaaaa

SEQ ID NO: 21863 - DNA, 21 bp, Hordeum vulgare
ctaccatccawccaacaatat

SEQ ID NO: 21864 - DNA, 21 bp, Hordeum vulgare
tcattgatcarctccttcacc

SEQ ID NO: 21865 - DNA, 21 bp, Hordeum vulgare
tagcacaatcwattaccacat

SEQ ID NO: 21866 - DNA, 21 bp, Hordeum vulgare
aatattttccrcacttttaag

SEQ ID NO: 21867 - DNA, 20 bp, Hordeum vulgare
gtcaatagatcacggcgtgg

SEQ ID NO: 21868 - DNA, 21 bp, Hordeum vulgare
gtcaatagatacacggcgtgg

SEQ ID NO: 21869 - DNA, 21 bp, Hordeum vulgare
tgtgggaggaygcgtcttcct

SEQ ID NO: 21870 - DNA, 21 bp, Hordeum vulgare
ttcaaacatcsgcggaagatt

SEQ ID NO: 21871 - DNA, 21 bp, Hordeum vulgare
tctcgccggcrtcctcctcca

SEQ ID NO: 21872 - DNA, 21 bp, Hordeum vulgare
gcaccgggagytcttggctcc

SEQ ID NO: 21873 - DNA, 21 bp, Hordeum vulgare
taaacttggtkctcctgtaac

SEQ ID NO: 21874 - DNA, 21 bp, Hordeum vulgare
caatgaggatyctatgtggtg

SEQ ID NO: 21875 - DNA, 21 bp, Hordeum vulgare
ttcaaacatcsgcggaagatt

SEQ ID NO: 21876 - DNA, 21 bp, Hordeum vulgare
ctggaccatcratagaccata

SEQ ID NO: 21877 - DNA, 21 bp, Hordeum vulgare
gaatttctcamagcatacggt

SEQ ID NO: 21878 - DNA, 21 bp, Hordeum vulgare
atgcagcgtcsgaggggttgg

SEQ ID NO: 21879 - DNA, 21 bp, Hordeum vulgare
aattgtagtcycagagatgtg

SEQ ID NO: 21880 - DNA, 21 bp, Hordeum vulgare
accatctatayagtttcctta

SEQ ID NO: 21881 - DNA, 21 bp, Hordeum vulgare
tacttatgcgmgcgtagatta

SEQ ID NO: 21882 - DNA, 21 bp, Hordeum vulgare
tctcgccggcrtcctcctcca

SEQ ID NO: 21883 - DNA, 21 bp, Hordeum vulgare
cccaaagccgycgctctggca

SEQ ID NO: 21884 - DNA, 21 bp, Hordeum vulgare
caaccgaagcwgacaccctac

SEQ ID NO: 21885 - DNA, 21 bp, Hordeum vulgare
atctccgaagycgtcacttcg

SEQ ID NO: 21886 - DNA, 21 bp, Hordeum vulgare
ccctgctgtcyaagcaaccga

SEQ ID NO: 21887 - DNA, 21 bp, Hordeum vulgare
gggtcagaagragcattcata

SEQ ID NO: 21888 - DNA, 21 bp, Hordeum vulgare
tgaccatgacrtcctgcttca

SEQ ID NO: 21889 - DNA, 21 bp, Hordeum vulgare
ccttgaggagraacggcttga

SEQ ID NO: 21890 - DNA, 21 bp, Hordeum vulgare
tgtccttgagmgtcgtctcct

SEQ ID NO: 21891 - DNA, 21 bp, Hordeum vulgare
gctgatcgcaygttttgcggt

SEQ ID NO: 21892 - DNA, 21 bp, Hordeum vulgare
tcagcgtggaygtggtggagt

SEQ ID NO: 21893 - DNA, 21 bp, Hordeum vulgare
agcatgtatcratgcagcaca

SEQ ID NO: 21894 - DNA, 21 bp, Hordeum vulgare
catggtggttyacacttagat

SEQ ID NO: 21895 - DNA, 21 bp, Hordeum vulgare
tatgaaacatrggatatacat

SEQ ID NO: 21896 - DNA, 21 bp, Hordeum vulgare
agagaatgtcwtagtgaccag

SEQ ID NO: 21897 - DNA, 21 bp, Hordeum vulgare
tcgaatctgcmatccgtaatc

SEQ ID NO: 21898 - DNA, 21 bp, Hordeum vulgare
ttcaaaaaatyatgtccacgt

SEQ ID NO: 21899 - DNA, 21 bp, Hordeum vulgare
acatggaatgwtaccctccat

SEQ ID NO: 21900 - DNA, 21 bp, Hordeum vulgare
tttcaacatcrcttacctccc

SEQ ID NO: 21901 - DNA, 21 bp, Hordeum vulgare
ctcacaaacartttgcacaaa

SEQ ID NO: 21902 - DNA, 21 bp, Hordeum vulgare
tcggatatccygggtaaccaa

SEQ ID NO: 21903 - DNA, 21 bp, Hordeum vulgare
ccggctcataytgcagcattt

SEQ ID NO: 21904 - DNA, 21 bp, Hordeum vulgare
agcaactctarcctacctcga

SEQ ID NO: 21905 - DNA, 21 bp, Hordeum vulgare
acatgaacctygcattgcaca

SEQ ID NO: 21906 - DNA, 21 bp, Hordeum vulgare
gtctggagctmccggttgctg

SEQ ID NO: 21907 - DNA, 21 bp, Hordeum vulgare
attcatagcarcttgaagatt

SEQ ID NO: 21908 - DNA, 21 bp, Hordeum vulgare
aaaaaacttcscttccaaaag

SEQ ID NO: 21909 - DNA, 21 bp, Hordeum vulgare
acctccttagkgccaccacga

SEQ ID NO: 21910 - DNA, 21 bp, Hordeum vulgare
agtgcaactgyacataaaaat

SEQ ID NO: 21911 - DNA, 21 bp, Hordeum vulgare
tatacattccwtacaatgtgt

SEQ ID NO: 21912 - DNA, 21 bp, Hordeum vulgare
gctatgcttgyaacacaacgc

SEQ ID NO: 21913 - DNA, 21 bp, Hordeum vulgare
agggtgaaaayaaaggtcaag

SEQ ID NO: 21914 - DNA, 21 bp, Hordeum vulgare
actgaaaatgytgcagggtga

SEQ ID NO: 21915 - DNA, 21 bp, Hordeum vulgare
atatttgccgstccttcgctc

SEQ ID NO: 21916 - DNA, 21 bp, Hordeum vulgare
gttgccatcascctgactgtg

SEQ ID NO: 21917 - DNA, 21 bp, Hordeum vulgare
gtcatagatgytgaatgtcaa

SEQ ID NO: 21918 - DNA, 21 bp, Hordeum vulgare
gggcagcagcratgccacctt

SEQ ID NO: 21919 - DNA, 21 bp, Hordeum vulgare
atgtacagcamaaacgtgaat

SEQ ID NO: 21920 - DNA, 21 bp, Hordeum vulgare
tggaaaaatcrcaacatcgca

SEQ ID NO: 21921 - DNA, 21 bp, Hordeum vulgare
caccttctttygtagcaactg

SEQ ID NO: 21922 - DNA, 21 bp, Hordeum vulgare
cattttttgcrataaattgca

SEQ ID NO: 21923 - DNA, 21 bp, Hordeum vulgare
atcaaaaacgmgatgccacca

SEQ ID NO: 21924 - DNA, 21 bp, Hordeum vulgare
ttatgaattartaatgaatag

SEQ ID NO: 21925 - DNA, 21 bp, Hordeum vulgare
cctagaaatcktcatgttttc

SEQ ID NO: 21926 - DNA, 21 bp, Hordeum vulgare
gtgtggtctasaatagaaaat

SEQ ID NO: 21927 - DNA, 21 bp, Hordeum vulgare
  MISC_FEATURE (11): n is SNP, in which the one is g and the other is a or t or c
caaggtacgtnacatgagaat

SEQ ID NO: 21928 - DNA, 21 bp, Hordeum vulgare
  MISC_FEATURE (11): n is SNP, in which the one is a and the other is t or g or c
gaatgatggcnatgaatgacg

SEQ ID NO: 21929 - DNA, 21 bp, Hordeum vulgare
aacttttttcktaatcaatta

SEQ ID NO: 21930 - DNA, 21 bp, Hordeum vulgare
atttctgtaartaactaatcc

SEQ ID NO: 21931 - DNA, 21 bp, Hordeum vulgare
tgctaggttcsatcatcctgc

SEQ ID NO: 21932 - DNA, 21 bp, Hordeum vulgare
aatcataatcrttgctataac

SEQ ID NO: 21933 - DNA, 21 bp, Hordeum vulgare
tgtcacagacrtgcggatctt

SEQ ID NO: 21934 - DNA, 21 bp, Hordeum vulgare
tagtgatatcwgtgtgcatat

SEQ ID NO: 21935 - DNA, 21 bp, Hordeum vulgare
catccctcctsccaatcatat

SEQ ID NO: 21936 - DNA, 21 bp, Hordeum vulgare
ccaccacctcmatcagcttac

SEQ ID NO: 21937 - DNA, 21 bp, Hordeum vulgare
caccaaatcastatcattcac

SEQ ID NO: 21938 - DNA, 21 bp, Hordeum vulgare
aaagacccaargggcagatca

SEQ ID NO: 21939 - DNA, 21 bp, Hordeum vulgare
tccgcgtccartggctcaacc

SEQ ID NO: 21940 - DNA, 21 bp, Hordeum vulgare
cattctcagtraatgcccagc

SEQ ID NO: 21941 - DNA, 21 bp, Hordeum vulgare
acttgacgcawagataaaaca

SEQ ID NO: 21942 - DNA, 21 bp, Hordeum vulgare
agaaagatgarcagccactgg

SEQ ID NO: 21943 - DNA, 21 bp, Hordeum vulgare
actggttcatwaaaaggctac

SEQ ID NO: 21944 - DNA, 21 bp, Hordeum vulgare
aatcgaggatstgaatcacaa

SEQ ID NO: 21945 - DNA, 21 bp, Hordeum vulgare
gaaaaaacgcrtgagtctaac

SEQ ID NO: 21946 - DNA, 21 bp, Hordeum vulgare
tctggagagawgaaagcgggg

SEQ ID NO: 21947 - DNA, 21 bp, Hordeum vulgare
actgcgcactwaatcgaaata

SEQ ID NO: 21948 - DNA, 21 bp, Hordeum vulgare
ccgtagggctraaataaacct

SEQ ID NO: 21949 - DNA, 21 bp, Hordeum vulgare
ccgccgtgagrgacagcttct

SEQ ID NO: 21950 - DNA, 21 bp, Hordeum vulgare
tatcctgcaaygtcgcgtgca

SEQ ID NO: 21951 - DNA, 21 bp, Hordeum vulgare
gtatgtgacaktagttctcga

SEQ ID NO: 21952 - DNA, 21 bp, Hordeum vulgare
tttcgggcggwcacgatgact

SEQ ID NO: 21953 - DNA, 21 bp, Hordeum vulgare
gcacagactcmagacctctga

SEQ ID NO: 21954 - DNA, 21 bp, Hordeum vulgare
tgaccccatcyagaaaatggg

SEQ ID NO: 21955 - DNA, 21 bp, Hordeum vulgare
gcagaatttgytgaatatgtt

SEQ ID NO: 21956 - DNA, 21 bp, Hordeum vulgare
gaggagaattmaacagagaat

SEQ ID NO: 21957 - DNA, 21 bp, Hordeum vulgare
tgctgtaaatyatctactcca

SEQ ID NO: 21958 - DNA, 21 bp, Hordeum vulgare
gtggcagtgckccgccaatgg

SEQ ID NO: 21959 - DNA, 21 bp, Hordeum vulgare
gtaacttggcytttcatcgac

SEQ ID NO: 21960 - DNA, 21 bp, Hordeum vulgare
acatgttgtayaggtcttcga

SEQ ID NO: 21961 - DNA, 21 bp, Hordeum vulgare
gcaatttcagwgctagattgg

SEQ ID NO: 21962 - DNA, 21 bp, Hordeum vulgare
agcttcgcggmgctatgacct

SEQ ID NO: 21963 - DNA, 21 bp, Hordeum vulgare
ggtcaaatttycccacctacg

SEQ ID NO: 21964 - DNA, 21 bp, Hordeum vulgare
tgtattttgtragggggtttc

SEQ ID NO: 21965 - DNA, 21 bp, Hordeum vulgare
gctgagaaagraaacagtttc

SEQ ID NO: 21966 - DNA, 21 bp, Hordeum vulgare
tatcataattkgggcttgcat

SEQ ID NO: 21967 - DNA, 21 bp, Hordeum vulgare
tagtgtcgcastagatgctgc

SEQ ID NO: 21968 - DNA, 21 bp, Hordeum vulgare
atccaagtatragagccacca

SEQ ID NO: 21969 - DNA, 21 bp, Hordeum vulgare
gggatatcagwctctgaatca

SEQ ID NO: 21970 - DNA, 21 bp, Hordeum vulgare
caaatatactkatacacatag

SEQ ID NO: 21971 - DNA, 21 bp, Hordeum vulgare
atagtcaagaraaactttcat

SEQ ID NO: 21972 - DNA, 21 bp, Hordeum vulgare
cagaataacamattagtgaaa

SEQ ID NO: 21973 - DNA, 21 bp, Hordeum vulgare
ggatggttacstctcatcrct

SEQ ID NO: 21974 - DNA, 21 bp, Hordeum vulgare
acstctcatcrctcccaattt

SEQ ID NO: 21975 - DNA, 21 bp, Hordeum vulgare
cgactgttcartgttactagt

SEQ ID NO: 21976 - DNA, 21 bp, Hordeum vulgare
gatacctgacrtcagccttgg

SEQ ID NO: 21977 - DNA, 20 bp, Hordeum vulgare
actgttcctgatgtcgagaa

SEQ ID NO: 21978 - DNA, 21 bp, Hordeum vulgare
actgttcctggatgtcgagaa

SEQ ID NO: 21979 - DNA, 21 bp, Hordeum vulgare
gagaaacctgrcgaaaccgca

SEQ ID NO: 21980 - DNA, 21 bp, Hordeum vulgare
ttcattcacasgccagcttgg

SEQ ID NO: 21981 - DNA, 21 bp, Hordeum vulgare
gaacaggctcrcctcctttcc

SEQ ID NO: 21982 - DNA, 21 bp, Hordeum vulgare
caaggaaggaraccctagata

SEQ ID NO: 21983 - DNA, 21 bp, Hordeum vulgare
gttcagggccrgcccagcaga

SEQ ID NO: 21984 - DNA, 21 bp, Hordeum vulgare
caagaccgaaytaatcttgct

SEQ ID NO: 21985 - DNA, 21 bp, Hordeum vulgare
cctcctctggkccgtcgacgt

SEQ ID NO: 21986 - DNA, 21 bp, Hordeum vulgare
ctttggtccgygagtttgctc

SEQ ID NO: 21987 - DNA, 21 bp, Hordeum vulgare
agatggtctcmgatcggtggg

SEQ ID NO: 21988 - DNA, 21 bp, Hordeum vulgare
tttgagcatakctaacagtga

SEQ ID NO: 21989 - DNA, 21 bp, Hordeum vulgare
ggggaggtccrgcgcaccctc

SEQ ID NO: 21990 - DNA, 21 bp, Hordeum vulgare
tatactgttamtgacactgag

SEQ ID NO: 21991 - DNA, 21 bp, Hordeum vulgare
atcatggagawactgcaaggt

SEQ ID NO: 21992 - DNA, 21 bp, Hordeum vulgare
  MISC_FEATURE (19),(20): n stands for any base
aatgctttsgraatcagtnnw

SEQ ID NO: 21993 - DNA, 21 bp, Hordeum vulgare
ggaaatctcgrttttgaatac

SEQ ID NO: 21994 - DNA, 21 bp, Hordeum vulgare
tgagacctcgygcagcgccct

SEQ ID NO: 21995 - DNA, 21 bp, Hordeum vulgare
cggagaggtcrtggtcaggct

SEQ ID NO: 21996 - DNA, 21 bp, Hordeum vulgare
tcagctgagaraaaaccctgc

SEQ ID NO: 21997 - DNA, 21 bp, Hordeum vulgare
tgattgacacrcatctgatca

SEQ ID NO: 21998 - DNA, 21 bp, Hordeum vulgare
taggtgatatmttccttttgg

SEQ ID NO: 21999 - DNA, 21 bp, Hordeum vulgare
tgtcggctgcrcggcagcccg

SEQ ID NO: 22000 - DNA, 21 bp, Hordeum vulgare
cgaagttgtarttgctcttgg

SEQ ID NO: 22001 - DNA, 21 bp, Hordeum vulgare
agactgagatwtctggagagc

SEQ ID NO: 22002 - DNA, 21 bp, Hordeum vulgare
gtgatggaccmgagggcgaca

SEQ ID NO: 22003 - DNA, 21 bp, Hordeum vulgare
ggggggggggrgggggggggg

SEQ ID NO: 22004 - DNA, 21 bp, Hordeum vulgare
ggcaagttctyaggagcaaag

SEQ ID NO: 22005 - DNA, 21 bp, Hordeum vulgare
acatcgagtcrtcaggaatcc

SEQ ID NO: 22006 - DNA, 21 bp, Hordeum vulgare
ttccgggctgwcgtctggacg

SEQ ID NO: 22007 - DNA, 21 bp, Hordeum vulgare
atgccttgagrgatatatata

SEQ ID NO: 22008 - DNA, 21 bp, Hordeum vulgare
acagtgaatakcccgatcgtg

SEQ ID NO: 22009 - DNA, 21 bp, Hordeum vulgare
attaatcagamcatcgagtgg

SEQ ID NO: 22010 - DNA, 21 bp, Hordeum vulgare
taagcaatcartgaaataaag

SEQ ID NO: 22011 - DNA, 21 bp, Hordeum vulgare
tttaaccataytgataattta

SEQ ID NO: 22012 - DNA, 21 bp, Hordeum vulgare
cacttgaaatrattcaatgat

SEQ ID NO: 22013 - DNA, 21 bp, Hordeum vulgare
ataaaatagcwggtggttaat

SEQ ID NO: 22014 - DNA, 21 bp, Hordeum vulgare
gctcctctccmaacacgccat

SEQ ID NO: 22015 - DNA, 21 bp, Hordeum vulgare
ccatttcccayaggaatagat

SEQ ID NO: 22016 - DNA, 21 bp, Hordeum vulgare
tggcccagacmatagcgaggg

SEQ ID NO: 22017 - DNA, 21 bp, Hordeum vulgare
tctcacatggmtgctgtcttt

SEQ ID NO: 22018 - DNA, 21 bp, Hordeum vulgare
gtctataatcktttttgatgt

SEQ ID NO: 22019 - DNA, 21 bp, Hordeum vulgare
tttattttacsaagtaacaat

SEQ ID NO: 22020 - DNA, 21 bp, Hordeum vulgare
tattaatataracctctataa

SEQ ID NO: 22021 - DNA, 21 bp, Hordeum vulgare
cagttagtaaycacgcctgca

SEQ ID NO: 22022 - DNA, 21 bp, Hordeum vulgare
tgccggaatcmccaggttggc

SEQ ID NO: 22023 - DNA, 21 bp, Hordeum vulgare
agcgccagagscccatcttga

SEQ ID NO: 22024 - DNA, 21 bp, Hordeum vulgare
actttctagcscgtgcttctg

SEQ ID NO: 22025 - DNA, 21 bp, Hordeum vulgare
tcctggcagcygtcaactatg

SEQ ID NO: 22026 - DNA, 21 bp, Hordeum vulgare
cagcaaacttyaaatgttttt

SEQ ID NO: 22027 - DNA, 21 bp, Hordeum vulgare
aagacagtgcgtcactcactg

SEQ ID NO: 22028 - DNA, 20 bp, Hordeum vulgare
aagacagtgctcactcactg

SEQ ID NO: 22029 - DNA, 21 bp, Hordeum vulgare
atattgagtctgaggtaacaa

SEQ ID NO: 22030 - DNA, 20 bp, Hordeum vulgare
gaattgagtcgaggtaacaa

SEQ ID NO: 22031 - DNA, 21 bp, Hordeum vulgare
atcaatactcrgaaggcgtta

SEQ ID NO: 22032 - DNA, 21 bp, Hordeum vulgare
tgaaatcctcstcttgcattt

SEQ ID NO: 22033 - DNA, 21 bp, Hordeum vulgare
aaccaagaaayattattagtg

SEQ ID NO: 22034 - DNA, 21 bp, Hordeum vulgare
gagaaggaggkttgctgatgg

SEQ ID NO: 22035 - DNA, 21 bp, Hordeum vulgare
ctaaggaaaarcatacctagt

SEQ ID NO: 22036 - DNA, 21 bp, Hordeum vulgare
atgacatttcraaattttgct

SEQ ID NO: 22037 - DNA, 20 bp, Hordeum vulgare
aaccacacaacgaagggcta

SEQ ID NO: 22038 - DNA, 21 bp, Hordeum vulgare
taccacacaagcgaagggcta

SEQ ID NO: 22039 - DNA, 21 bp, Hordeum vulgare
gagaacaaacragcagacagg

SEQ ID NO: 22040 - DNA, 21 bp, Hordeum vulgare
acccaaaagcyctatcctacg

SEQ ID NO: 22041 - DNA, 21 bp, Hordeum vulgare
cctacacccgmgcgtaatgga

SEQ ID NO: 22042 - DNA, 21 bp, Hordeum vulgare
tcagttcatcrctagcataga

SEQ ID NO: 22043 - DNA, 21 bp, Hordeum vulgare
cctttgtcacrgcaaccgggt

SEQ ID NO: 22044 - DNA, 21 bp, Hordeum vulgare
tggtgttcacsggcgcgctgg

SEQ ID NO: 22045 - DNA, 21 bp, Hordeum vulgare
cgatctcctcyagcttggaga

SEQ ID NO: 22046 - DNA, 21 bp, Hordeum vulgare
taacctgcccsgcgatctcct

SEQ ID NO: 22047 - DNA, 21 bp, Hordeum vulgare
gcctcctgcarttgagcctga

SEQ ID NO: 22048 - DNA, 21 bp, Hordeum vulgare
ctgaccagcgmgtcctgcgac

SEQ ID NO: 22049 - DNA, 21 bp, Hordeum vulgare
gctgaggtacmcgcgctggag

SEQ ID NO: 22050 - DNA, 21 bp, Hordeum vulgare
ccaatttatastcagccattc

SEQ ID NO: 22051 - DNA, 21 bp, Hordeum vulgare
caataggaaarcagtaggaag

SEQ ID NO: 22052 - DNA, 21 bp, Hordeum vulgare
tcactggaggwtggagtggat

SEQ ID NO: 22053 - DNA, 21 bp, Hordeum vulgare
tcgtgcttatyacatcaacct

SEQ ID NO: 22054 - DNA, 21 bp, Hordeum vulgare
acatcaacctmgtatcgtgtg

SEQ ID NO: 22055 - DNA, 21 bp, Hordeum vulgare
acgggagatgmtgggattcac

SEQ ID NO: 22056 - DNA, 21 bp, Hordeum vulgare
ctactcctacrccagtgcctc

SEQ ID NO: 22057 - DNA, 21 bp, Hordeum vulgare
gcctgttagcrttaggcatga

SEQ ID NO: 22058 - DNA, 21 bp, Hordeum vulgare
caagttgggcwgcggagaggc

SEQ ID NO: 22059 - DNA, 21 bp, Hordeum vulgare
agatttacttkggacgcttgc

SEQ ID NO: 22060 - DNA, 21 bp, Hordeum vulgare
tggatcatcartttcatcaca

SEQ ID NO: 22061 - DNA, 21 bp, Hordeum vulgare
cggggtcttgytcggggatgt

SEQ ID NO: 22062 - DNA, 21 bp, Hordeum vulgare
gtagagctctwgctggaagga

SEQ ID NO: 22063 - DNA, 21 bp, Hordeum vulgare
gtctacatgcraagaaccctg

SEQ ID NO: 22064 - DNA, 21 bp, Hordeum vulgare
gttaactgtgrcacgcgtctg

SEQ ID NO: 22065 - DNA, 21 bp, Hordeum vulgare
ccctttggtcraggctcagac

SEQ ID NO: 22066 - DNA, 21 bp, Hordeum vulgare
gtcgatctccygcatacggtt

SEQ ID NO: 22067 - DNA, 21 bp, Hordeum vulgare
gaaagtatgcmacaggaggat

SEQ ID NO: 22068 - DNA, 21 bp, Hordeum vulgare
tgccagctaayaaaaataact

SEQ ID NO: 22069 - DNA, 21 bp, Hordeum vulgare
aggcagaaaaygtgaattgta

SEQ ID NO: 22070 - DNA, 21 bp, Hordeum vulgare
tctaagaaggrgactcgtgtc

SEQ ID NO: 22071 - DNA, 21 bp, Hordeum vulgare
cattttgccasacatagtgag

SEQ ID NO: 22072 - DNA, 21 bp, Hordeum vulgare
ggtcttggtcrcgtcgtcgag

SEQ ID NO: 22073 - DNA, 21 bp, Hordeum vulgare
attccaagttygcaccacaca

SEQ ID NO: 22074 - DNA, 21 bp, Hordeum vulgare
aggtagcagawaagaggtgat

SEQ ID NO: 22075 - DNA, 21 bp, Hordeum vulgare
gcttgcatgcyaatgccatcg

SEQ ID NO: 22076 - DNA, 21 bp, Hordeum vulgare
tttggagaacyatgagattaa

SEQ ID NO: 22077 - DNA, 21 bp, Hordeum vulgare
tttccacttgrgcacttctcg

SEQ ID NO: 22078 - DNA, 21 bp, Hordeum vulgare
gctgtgaatgwgtttccagct

SEQ ID NO: 22079 - DNA, 21 bp, Hordeum vulgare
tccatctgacratgagttccc

SEQ ID NO: 22080 - DNA, 21 bp, Hordeum vulgare
tatatataccrtgcttgctat

SEQ ID NO: 22081 - DNA, 21 bp, Hordeum vulgare
acccgaagcawcggtcgcata

SEQ ID NO: 22082 - DNA, 21 bp, Hordeum vulgare
ccacctcaaaratgaatgact

SEQ ID NO: 22083 - DNA, 21 bp, Hordeum vulgare
ttcccctgatytctgcgatcg

SEQ ID NO: 22084 - DNA, 21 bp, Hordeum vulgare
atgaatgactkggtgggatca

SEQ ID NO: 22085 - DNA, 21 bp, Hordeum vulgare
acgtagaacakcgaatgacca

SEQ ID NO: 22086 - DNA, 21 bp, Hordeum vulgare
gcaacccggtrcttcaagtcc

SEQ ID NO: 22087 - DNA, 21 bp, Hordeum vulgare
atttgcctatrcaagaaagat

SEQ ID NO: 22088 - DNA, 21 bp, Hordeum vulgare
ccacaattgcsaatttgccta

SEQ ID NO: 22089 - DNA, 21 bp, Hordeum vulgare
tactgactgcratgtaccgtc

SEQ ID NO: 22090 - DNA, 21 bp, Hordeum vulgare
aacaggttacrttcaagttac

SEQ ID NO: 22091 - DNA, 21 bp, Hordeum vulgare
gccagatgctytgtaggattc

SEQ ID NO: 22092 - DNA, 21 bp, Hordeum vulgare
gagataatgtraacgctagaa

SEQ ID NO: 22093 - DNA, 21 bp, Hordeum vulgare
tgtgacccagwaagaaggggc

SEQ ID NO: 22094 - DNA, 21 bp, Hordeum vulgare
attgttgcatyagtaaaaaga

SEQ ID NO: 22095 - DNA, 21 bp, Hordeum vulgare
gtacaacagcraaaagttaac

SEQ ID NO: 22096 - DNA, 21 bp, Hordeum vulgare
gccgaggcgcstgtgccgtgc

SEQ ID NO: 22097 - DNA, 21 bp, Hordeum vulgare
tggagaatgtwcaagacaccg

SEQ ID NO: 22098 - DNA, 21 bp, Hordeum vulgare
gatacgaaaargacgagaatg

SEQ ID NO: 22099 - DNA, 21 bp, Hordeum vulgare
tgtctccratkgtcttctcta

SEQ ID NO: 22100 - DNA, 21 bp, Hordeum vulgare
gataaacrtasttgcatttat

SEQ ID NO: 22101 - DNA, 21 bp, Hordeum vulgare
cactgtctccratkgtcttct

SEQ ID NO: 22102 - DNA, 21 bp, Hordeum vulgare
aaagataaacrtasttgcatt

SEQ ID NO: 22103 - DNA, 21 bp, Hordeum vulgare
agatgaagcgycatcgacata

SEQ ID NO: 22104 - DNA, 21 bp, Hordeum vulgare
ccgtttcctcrgagatcgcat

SEQ ID NO: 22105 - DNA, 21 bp, Hordeum vulgare
ccagactcagygtccctactg

SEQ ID NO: 22106 - DNA, 21 bp, Hordeum vulgare
tggacagcaascccagactca

SEQ ID NO: 22107 - DNA, 21 bp, Hordeum vulgare
atacagagaarcaaatgatat

SEQ ID NO: 22108 - DNA, 21 bp, Hordeum vulgare
gcctcagcagsagctccacct

SEQ ID NO: 22109 - DNA, 21 bp, Hordeum vulgare
caccagcagcrgcaccaccac

SEQ ID NO: 22110 - DNA, 21 bp, Hordeum vulgare
caccaccaccratcggaccag

SEQ ID NO: 22111 - DNA, 21 bp, Hordeum vulgare
ccacctgcatyaagtttcaga

SEQ ID NO: 22112 - DNA, 21 bp, Hordeum vulgare
gtaatggtccmttagttcagc

SEQ ID NO: 22113 - DNA, 21 bp, Hordeum vulgare
gacaaagttawtcagtaattg

SEQ ID NO: 22114 - DNA, 21 bp, Hordeum vulgare
atatgttctcsacagcccgca

SEQ ID NO: 22115 - DNA, 21 bp, Hordeum vulgare
gtgtccctcckgtgccttctc

SEQ ID NO: 22116 - DNA, 21 bp, Hordeum vulgare
tttcaagcacsctcttgttca

SEQ ID NO: 22117 - DNA, 21 bp, Hordeum vulgare
aatgtatgccmaaatttgatt

SEQ ID NO: 22118 - DNA, 21 bp, Hordeum vulgare
ccgcagcagaratgatgagct

SEQ ID NO: 22119 - DNA, 21 bp, Hordeum vulgare
gattcataggwataggaaaaa

SEQ ID NO: 22120 - DNA, 21 bp, Hordeum vulgare
taaaaacatargaacaagaaa

SEQ ID NO: 22121 - DNA, 21 bp, Hordeum vulgare
tgcttcaggcwgatcggtcgg

SEQ ID NO: 22122 - DNA, 21 bp, Hordeum vulgare
ttcgttctccracggcggatg

SEQ ID NO: 22123 - DNA, 21 bp, Hordeum vulgare
tcacatacccrgcaccgggaa

SEQ ID NO: 22124 - DNA, 21 bp, Hordeum vulgare
tccgccatttkgttcgaatgc

SEQ ID NO: 22125 - DNA, 21 bp, Hordeum vulgare
agcacccgcaycatttagcag

SEQ ID NO: 22126 - DNA, 21 bp, Hordeum vulgare
tgtaggtttcygcctcatcag

SEQ ID NO: 22127 - DNA, 21 bp, Hordeum vulgare
aacaatacacraccctatttg

SEQ ID NO: 22128 - DNA, 20 bp, Hordeum vulgare
atatgttctcgacagcccgc

SEQ ID NO: 22129 - DNA, 21 bp, Hordeum vulgare
atatgttctccacagcccgca

SEQ ID NO: 22130 - DNA, 21 bp, Hordeum vulgare
ctgcgtcgtcractatctgaa

SEQ ID NO: 22131 - DNA, 21 bp, Hordeum vulgare
gggctactgtmtctgcatgct

SEQ ID NO: 22132 - DNA, 21 bp, Hordeum vulgare
ggaaaaaattkcttgtcaaat

SEQ ID NO: 22133 - DNA, 21 bp, Hordeum vulgare
ttcccaacatrattgcaatgt

SEQ ID NO: 22134 - DNA, 21 bp, Hordeum vulgare
gaccgaatgayagatctcata

SEQ ID NO: 22135 - DNA, 21 bp, Hordeum vulgare
gcattgatttratctatgtta

SEQ ID NO: 22136 - DNA, 21 bp, Hordeum vulgare
catagcccgaygccacgacat

SEQ ID NO: 22137 - DNA, 21 bp, Hordeum vulgare
taaagggcagsggaaaatatc

SEQ ID NO: 22138 - DNA, 21 bp, Hordeum vulgare
cacttccggcsctggatttgc

SEQ ID NO: 22139 - DNA, 21 bp, Hordeum vulgare
cgactctatgrgcagccaccg

SEQ ID NO: 22140 - DNA, 21 bp, Hordeum vulgare
ccacgtaaggsaaatctcctg

SEQ ID NO: 22141 - DNA, 21 bp, Hordeum vulgare
cagacagcagytcttagtcga

SEQ ID NO: 22142 - DNA, 21 bp, Hordeum vulgare
cactatacagwttgtaaaacc

SEQ ID NO: 22143 - DNA, 21 bp, Hordeum vulgare
atgacgccatwatataaatca

SEQ ID NO: 22144 - DNA, 21 bp, Hordeum vulgare
cttgtatgtcragcgacaacg

SEQ ID NO: 22145 - DNA, 21 bp, Hordeum vulgare
gcgcttgctcratggaggatg

SEQ ID NO: 22146 - DNA, 21 bp, Hordeum vulgare
tgcagtagttrtagatcatgt

SEQ ID NO: 22147 - DNA, 21 bp, Hordeum vulgare
actaatctacsaatatttgcc

SEQ ID NO: 22148 - DNA, 21 bp, Hordeum vulgare
gcattctgtgscctaactaaa

SEQ ID NO: 22149 - DNA, 21 bp, Hordeum vulgare
atggagggttygttggaggct

SEQ ID NO: 22150 - DNA, 21 bp, Hordeum vulgare
catacacactycttcatgcat

SEQ ID NO: 22151 - DNA, 21 bp, Hordeum vulgare
atacggcatgygattaaacag

SEQ ID NO: 22152 - DNA, 21 bp, Hordeum vulgare
cagccgcctcrtccagcgccc

SEQ ID NO: 22153 - DNA, 21 bp, Hordeum vulgare
aaacagtgtgyccatcaggca

SEQ ID NO: 22154 - DNA, 21 bp, Hordeum vulgare
cctgcaacgcraagttctggc

SEQ ID NO: 22155 - DNA, 21 bp, Hordeum vulgare
atgcatctagrttctagatac

SEQ ID NO: 22156 - DNA, 21 bp, Hordeum vulgare
gcctgatcgtsctggagcgtc

SEQ ID NO: 22157 - DNA, 21 bp, Hordeum vulgare
ccacgctcccsatgaagaaga

SEQ ID NO: 22158 - DNA, 21 bp, Hordeum vulgare
tagatgctagycatgcatcta

SEQ ID NO: 22159 - DNA, 21 bp, Hordeum vulgare
ctgctcatgcygagaaggctg

SEQ ID NO: 22160 - DNA, 21 bp, Hordeum vulgare
gcttaccagcraagatcaggc

SEQ ID NO: 22161 - DNA, 21 bp, Hordeum vulgare
ccacctccaasgtgatggtct

SEQ ID NO: 22162 - DNA, 21 bp, Hordeum vulgare
caccacgaagrcggaggacaa

SEQ ID NO: 22163 - DNA, 21 bp, Hordeum vulgare
tcgccttcacrttgtcaatgg

SEQ ID NO: 22164 - DNA, 21 bp, Hordeum vulgare
ccacagaagasagctggtgat

SEQ ID NO: 22165 - DNA, 21 bp, Hordeum vulgare
tgtgcttggayttcaagttca

SEQ ID NO: 22166 - DNA, 21 bp, Hordeum vulgare
ggtatatatgygagtgtgcaa

SEQ ID NO: 22167 - DNA, 21 bp, Hordeum vulgare
tggcattggaygtctcgaaca

SEQ ID NO: 22168 - DNA, 21 bp, Hordeum vulgare
acccaatggcrggcagtttgg

SEQ ID NO: 22169 - DNA, 21 bp, Hordeum vulgare
tgcagggaatyctcagcaagg

SEQ ID NO: 22170 - DNA, 21 bp, Hordeum vulgare
ccactcgtagyagcgtgtgtt

SEQ ID NO: 22171 - DNA, 21 bp, Hordeum vulgare
acgatcatatkgcacttatat

SEQ ID NO: 22172 - DNA, 21 bp, Hordeum vulgare
ttttacaagcracataaggaa

SEQ ID NO: 22173 - DNA, 21 bp, Hordeum vulgare
cttgttcacasgaagtctact

SEQ ID NO: 22174 - DNA, 21 bp, Hordeum vulgare
tttttaggacrctcatagcct

SEQ ID NO: 22175 - DNA, 21 bp, Hordeum vulgare
aaaatcagaargagaatttga

SEQ ID NO: 22176 - DNA, 21 bp, Hordeum vulgare
ctgactaatcktccggggtag

SEQ ID NO: 22177 - DNA, 21 bp, Hordeum vulgare
gcttaccagcraagatcaggc

SEQ ID NO: 22178 - DNA, 21 bp, Hordeum vulgare
ggccatcctcragctgcttgc

SEQ ID NO: 22179 - DNA, 21 bp, Hordeum vulgare
gcaaagattargcgctgctgg

SEQ ID NO: 22180 - DNA, 21 bp, Hordeum vulgare
tcaacctccartgtgatggtc

SEQ ID NO: 22181 - DNA, 21 bp, Hordeum vulgare
gctggtccggrgggatgccct

SEQ ID NO: 22182 - DNA, 21 bp, Hordeum vulgare
tggtcttgccsgtgagagtct

SEQ ID NO: 22183 - DNA, 21 bp, Hordeum vulgare
gcttaccagcraagatcaggc

SEQ ID NO: 22184 - DNA, 21 bp, Hordeum vulgare
gcgcttycccrgatcccttag

SEQ ID NO: 22185 - DNA, 21 bp, Hordeum vulgare
gagtaaccgcyggcattgttg

SEQ ID NO: 22186 - DNA, 21 bp, Hordeum vulgare
gttgatctaamggcagatcca

SEQ ID NO: 22187 - DNA, 21 bp, Hordeum vulgare
ggtcgtctgayggaggactgt

SEQ ID NO: 22188 - DNA, 21 bp, Hordeum vulgare
ctctttcgggktcatcgccag

SEQ ID NO: 22189 - DNA, 21 bp, Hordeum vulgare
aatcagcactsaactgacctt

SEQ ID NO: 22190 - DNA, 21 bp, Hordeum vulgare
gaaatcgtgaygcctaacgcc

SEQ ID NO: 22191 - DNA, 21 bp, Hordeum vulgare
caaaggactcratgacgggga

SEQ ID NO: 22192 - DNA, 21 bp, Hordeum vulgare
tgcttgagaayccaaaggact

SEQ ID NO: 22193 - DNA, 21 bp, Hordeum vulgare
catagccttcsacgctagcat

SEQ ID NO: 22194 - DNA, 21 bp, Hordeum vulgare
gtcggcaaccrcatttccctt

SEQ ID NO: 22195 - DNA, 21 bp, Hordeum vulgare
tattgagcatygagccctctc

SEQ ID NO: 22196 - DNA, 21 bp, Hordeum vulgare
tyaagaacttygaatcatcac

SEQ ID NO: 22197 - DNA, 21 bp, Hordeum vulgare
gtgtgcacatygtctgatcag

SEQ ID NO: 22198 - DNA, 21 bp, Hordeum vulgare
cttttgggaaygttaactgat

SEQ ID NO: 22199 - DNA, 21 bp, Hordeum vulgare
ggtgatccgarcgtgtgaata

SEQ ID NO: 22200 - DNA, 21 bp, Hordeum vulgare
ctttgatctgygcagtagtcg

SEQ ID NO: 22201 - DNA, 21 bp, Hordeum vulgare
ccatgccctcscctgtgtacc

SEQ ID NO: 22202 - DNA, 21 bp, Hordeum vulgare
ctatcaccacstgacagcacc

SEQ ID NO: 22203 - DNA, 21 bp, Hordeum vulgare
gcttatcatcmcggtcgtatc

SEQ ID NO: 22204 - DNA, 21 bp, Hordeum vulgare
acagagactasggcatcactg

SEQ ID NO: 22205 - DNA, 21 bp, Hordeum vulgare
ccagcagctcyaggcttgcgc

SEQ ID NO: 22206 - DNA, 21 bp, Hordeum vulgare
agcatgagccwgcttacatcc

SEQ ID NO: 22207 - DNA, 21 bp, Hordeum vulgare
cgccttctgcrgggtcttcga

SEQ ID NO: 22208 - DNA, 21 bp, Hordeum vulgare
cctagagcatratatgcgggt

SEQ ID NO: 22209 - DNA, 21 bp, Hordeum vulgare
ctccatgcctraaccagcaac

SEQ ID NO: 22210 - DNA, 21 bp, Hordeum vulgare
cagatatatcwttgccaaatc

SEQ ID NO: 22211 - DNA, 21 bp, Hordeum vulgare
cagtgtttcaractattgtta

SEQ ID NO: 22212 - DNA, 21 bp, Hordeum vulgare
ggcttattttsatctgccaca

SEQ ID NO: 22213 - DNA, 21 bp, Hordeum vulgare
gccgtcgctayccaagctccc

SEQ ID NO: 22214 - DNA, 21 bp, Hordeum vulgare
actgcccaccrgtcgtcccca

SEQ ID NO: 22215 - DNA, 21 bp, Hordeum vulgare
agggctgcggyccctactgcc

SEQ ID NO: 22216 - DNA, 21 bp, Hordeum vulgare
gatcaacacgytgaagctggg

SEQ ID NO: 22217 - DNA, 21 bp, Hordeum vulgare
acaccagctgrctgactgact

SEQ ID NO: 22218 - DNA, 21 bp, Hordeum vulgare
tctacatacamttcgctaacc

SEQ ID NO: 22219 - DNA, 21 bp, Hordeum vulgare
gatgcccgtcrgagtcaggcg

SEQ ID NO: 22220 - DNA, 21 bp, Hordeum vulgare
ttcgctaaccrcaagaacaag

SEQ ID NO: 22221 - DNA, 21 bp, Hordeum vulgare
acacaaactcyggtgaagcaa

SEQ ID NO: 22222 - DNA, 21 bp, Hordeum vulgare
acgcaaaaaaragagtaataa

SEQ ID NO: 22223 - DNA, 21 bp, Hordeum vulgare
tacaacagtgyataagaaggc

SEQ ID NO: 22224 - DNA, 21 bp, Hordeum vulgare
ttcttcttagsggctaaatga

SEQ ID NO: 22225 - DNA, 21 bp, Hordeum vulgare
actttaagcakatgtgcttag

SEQ ID NO: 22226 - DNA, 21 bp, Hordeum vulgare
tgcaagccatyatagatctat

SEQ ID NO: 22227 - DNA, 21 bp, Hordeum vulgare
ctcataaagtkgacattcagg

SEQ ID NO: 22228 - DNA, 21 bp, Hordeum vulgare
aagcttaagamagacaaactc

SEQ ID NO: 22229 - DNA, 21 bp, Hordeum vulgare
ctcctcatcartcccaatggc

SEQ ID NO: 22230 - DNA, 21 bp, Hordeum vulgare
caggagatgtkacaaacaaat

SEQ ID NO: 22231 - DNA, 21 bp, Hordeum vulgare
tcatcgtcccragaatcgatc

SEQ ID NO: 22232 - DNA, 21 bp, Hordeum vulgare
acttgccggcrgagtatcagg

SEQ ID NO: 22233 - DNA, 21 bp, Hordeum vulgare
tgagtgcttcyttctcaggct

SEQ ID NO: 22234 - DNA, 21 bp, Hordeum vulgare
ggctaacatckacactgaaag

SEQ ID NO: 22235 - DNA, 21 bp, Hordeum vulgare
tgaaaggcccracaagtgtga

SEQ ID NO: 22236 - DNA, 21 bp, Hordeum vulgare
aaacaaatcawcctacatttc

SEQ ID NO: 22237 - DNA, 21 bp, Hordeum vulgare
tatctagaagrccagaacata

SEQ ID NO: 22238 - DNA, 21 bp, Hordeum vulgare
ctactccttcsgacattcccc

SEQ ID NO: 22239 - DNA, 21 bp, Hordeum vulgare
tgccgatgtcsgggtgcacct

SEQ ID NO: 22240 - DNA, 20 bp, Hordeum vulgare
agccccttgtcagaccgctg

SEQ ID NO: 22241 - DNA, 21 bp, Hordeum vulgare
agccccttgtacagaccgctg

SEQ ID NO: 22242 - DNA, 21 bp, Hordeum vulgare
gccaccctcgygatgatgtct

SEQ ID NO: 22243 - DNA, 21 bp, Hordeum vulgare
gatctcactgyaccgcgagcc

SEQ ID NO: 22244 - DNA, 21 bp, Hordeum vulgare
aaaataataaraggaacccac

SEQ ID NO: 22245 - DNA, 21 bp, Hordeum vulgare
ttgatcaaatraggccaaaat

SEQ ID NO: 22246 - DNA, 21 bp, Hordeum vulgare
agtcaaactgrttgcacattt

SEQ ID NO: 22247 - DNA, 21 bp, Hordeum vulgare
atcaaaaacaktatagaactt

SEQ ID NO: 22248 - DNA, 21 bp, Hordeum vulgare
aggatgccacrgccttttgta

SEQ ID NO: 22249 - DNA, 21 bp, Hordeum vulgare
gaccatgcacwatctcttcca

SEQ ID NO: 22250 - DNA, 21 bp, Hordeum vulgare
tcccctccttkcccacagtca

SEQ ID NO: 22251 - DNA, 21 bp, Hordeum vulgare
cacctaatgtwgatggagcca

SEQ ID NO: 22252 - DNA, 21 bp, Hordeum vulgare
cactggcattyttgccatggt

SEQ ID NO: 22253 - DNA, 21 bp, Hordeum vulgare
actcttatcgkcagtagctga

SEQ ID NO: 22254 - DNA, 21 bp, Hordeum vulgare
atttcagccakggtcatcatc

SEQ ID NO: 22255 - DNA, 21 bp, Hordeum vulgare
agtcaatcacrattcaaggcg

SEQ ID NO: 22256 - DNA, 21 bp, Hordeum vulgare
cctttgtttcracaacatgtc

SEQ ID NO: 22257 - DNA, 21 bp, Hordeum vulgare
cttctcatcgwgcagaacaag

SEQ ID NO: 22258 - DNA, 21 bp, Hordeum vulgare
agccctcgacyccgatgatgt

SEQ ID NO: 22259 - DNA, 21 bp, Hordeum vulgare
tcgagcaatcragcgcgatga

SEQ ID NO: 22260 - DNA, 21 bp, Hordeum vulgare
ttctgtttgckggtgtgttga

SEQ ID NO: 22261 - DNA, 21 bp, Hordeum vulgare
gcaactctatkccccaacgaa

SEQ ID NO: 22262 - DNA, 21 bp, Hordeum vulgare
atatggtctcraagagttcct

SEQ ID NO: 22263 - DNA, 21 bp, Hordeum vulgare
tgtattaagargtgcatgcta

SEQ ID NO: 22264 - DNA, 21 bp, Hordeum vulgare
ggtactcctgyccactgttta

SEQ ID NO: 22265 - DNA, 21 bp, Hordeum vulgare
acttcggtcgstgtcctgcaa

SEQ ID NO: 22266 - DNA, 21 bp, Hordeum vulgare
tgtcctgcaamcccaaaggac

SEQ ID NO: 22267 - DNA, 21 bp, Hordeum vulgare
tcgaactcctytggtcgctag

SEQ ID NO: 22268 - DNA, 21 bp, Hordeum vulgare
actgcaggacragctgcttca

SEQ ID NO: 22269 - DNA, 21 bp, Hordeum vulgare
ctgctcctggkactgcaggac

SEQ ID NO: 22270 - DNA, 21 bp, Hordeum vulgare
agtagattttkcagttcagat

SEQ ID NO: 22271 - DNA, 21 bp, Hordeum vulgare
cagcgcgtagktgttgatctg

SEQ ID NO: 22272 - DNA, 21 bp, Hordeum vulgare
cgccctatccsacggccaaca

SEQ ID NO: 22273 - DNA, 21 bp, Hordeum vulgare
actctcaatcmccaagggcca

SEQ ID NO: 22274 - DNA, 21 bp, Hordeum vulgare
cgatggcggckccgtagtgcg

SEQ ID NO: 22275 - DNA, 21 bp, Hordeum vulgare
cgggcacgcgkgtgaggtaga

SEQ ID NO: 22276 - DNA, 21 bp, Hordeum vulgare
ttctccattayaaacctatta

SEQ ID NO: 22277 - DNA, 21 bp, Hordeum vulgare
tttcctggtcyggattggact

SEQ ID NO: 22278 - DNA, 21 bp, Hordeum vulgare
ggtgaggctcrcgtcttcgct

SEQ ID NO: 22279 - DNA, 21 bp, Hordeum vulgare
tcagctgcgcrttgtcgatga

SEQ ID NO: 22280 - DNA, 21 bp, Hordeum vulgare
acaatcatcayatatgagtgg

SEQ ID NO: 22281 - DNA, 21 bp, Hordeum vulgare
gggcccatagktaacccaact

SEQ ID NO: 22282 - DNA, 21 bp, Hordeum vulgare
ctaagttgttstataggcatc

SEQ ID NO: 22283 - DNA, 21 bp, Hordeum vulgare
taacccaactycttgggggaa

SEQ ID NO: 22284 - DNA, 21 bp, Hordeum vulgare
tgttccatatytgatcgatga

SEQ ID NO: 22285 - DNA, 21 bp, Hordeum vulgare
gttttgccgcrcgatatagtg

SEQ ID NO: 22286 - DNA, 21 bp, Hordeum vulgare
gtaataaattraatgctcttc

SEQ ID NO: 22287 - DNA, 21 bp, Hordeum vulgare
tgtcttaattrttagtcttca

SEQ ID NO: 22288 - DNA, 21 bp, Hordeum vulgare
aaactaaaacwtacctgtggg

SEQ ID NO: 22289 - DNA, 21 bp, Hordeum vulgare
atttcagcctrttaaaaaacc

SEQ ID NO: 22290 - DNA, 21 bp, Hordeum vulgare
ttcgacaagaragccacaaac

SEQ ID NO: 22291 - DNA, 21 bp, Hordeum vulgare
cagtccaacayttctttctaa

SEQ ID NO: 22292 - DNA, 21 bp, Hordeum vulgare
ccttggccgcygcagatgcgt

SEQ ID NO: 22293 - DNA, 21 bp, Hordeum vulgare
cacagccatcytatggcatgt

SEQ ID NO: 22294 - DNA, 21 bp, Hordeum vulgare
ccgagcaaacyacattttgct

SEQ ID NO: 22295 - DNA, 21 bp, Hordeum vulgare
cggcgaggtaycctcctccac

SEQ ID NO: 22296 - DNA, 21 bp, Hordeum vulgare
agtgacaatgycatgcttttg

SEQ ID NO: 22297 - DNA, 21 bp, Hordeum vulgare
caagaaaaatktcctaaaagg

SEQ ID NO: 22298 - DNA, 21 bp, Hordeum vulgare
caagtacctcrgtaaaatcat

SEQ ID NO: 22299 - DNA, 21 bp, Hordeum vulgare
catcaccaagyaggggrttcc

SEQ ID NO: 22300 - DNA, 21 bp, Hordeum vulgare
ctgggtctcaraagtgacaat

SEQ ID NO: 22301 - DNA, 21 bp, Hordeum vulgare
tcccctggaaracctcgccgc

SEQ ID NO: 22302 - DNA, 21 bp, Hordeum vulgare
caaacatgacwggtcctaatg

SEQ ID NO: 22303 - DNA, 21 bp, Hordeum vulgare
gttgacggccyctcgtgaaca

SEQ ID NO: 22304 - DNA, 21 bp, Hordeum vulgare
taggttcatasattcacgtat

SEQ ID NO: 22305 - DNA, 21 bp, Hordeum vulgare
tgctcgcgcayctctccacca

SEQ ID NO: 22306 - DNA, 21 bp, Hordeum vulgare
tcaaagaacasaggaaggatg

SEQ ID NO: 22307 - DNA, 21 bp, Hordeum vulgare
cagtctctatkctttgatcca

SEQ ID NO: 22308 - DNA, 21 bp, Hordeum vulgare
atccataactkttggccaccc

SEQ ID NO: 22309 - DNA, 21 bp, Hordeum vulgare
ccacttcctcrtccgcatttg

SEQ ID NO: 22310 - DNA, 21 bp, Hordeum vulgare
cttgcaagctrtcgaactggc

SEQ ID NO: 22311 - DNA, 21 bp, Hordeum vulgare
acatgaaacaractcagacct

SEQ ID NO: 22312 - DNA, 21 bp, Hordeum vulgare
aacagagcacygttcgtttca

SEQ ID NO: 22313 - DNA, 21 bp, Hordeum vulgare
gtggttttttscgctacttca

SEQ ID NO: 22314 - DNA, 21 bp, Hordeum vulgare
agagcccgctygagtttacac

SEQ ID NO: 22315 - DNA, 21 bp, Hordeum vulgare
agcttattatkctcatgttca

SEQ ID NO: 22316 - DNA, 21 bp, Hordeum vulgare
  MISC_FEATURE (11): n is SNP, in which the one is a and the other is t or g or c
agttggatacnagagacagta

SEQ ID NO: 22317 - DNA, 21 bp, Hordeum vulgare
gaccacctctrcatgatagag

SEQ ID NO: 22318 - DNA, 21 bp, Hordeum vulgare
cagcacgttcsaaacaatagg

SEQ ID NO: 22319 - DNA, 21 bp, Hordeum vulgare
ccccctcgcckgctcttctcc

SEQ ID NO: 22320 - DNA, 21 bp, Hordeum vulgare
acttcttgccrtcagtgcttg

SEQ ID NO: 22321 - DNA, 21 bp, Hordeum vulgare
ttaagccaagytcagtactgg

SEQ ID NO: 22322 - DNA, 21 bp, Hordeum vulgare
atctgctgacygattcaccaa

SEQ ID NO: 22323 - DNA, 21 bp, Hordeum vulgare
agcataccaaratttttaggt

SEQ ID NO: 22324 - DNA, 21 bp, Hordeum vulgare
tcatggagtcrtacctcatga

SEQ ID NO: 22325 - DNA, 21 bp, Hordeum vulgare
ccgggcaaaarcatgttgttt

SEQ ID NO: 22326 - DNA, 21 bp, Hordeum vulgare
ataatatgcargaacacttgt

SEQ ID NO: 22327 - DNA, 21 bp, Hordeum vulgare
cctttgatatrtctgcatgca

SEQ ID NO: 22328 - DNA, 21 bp, Hordeum vulgare
acaatccaagrcaccttcata

SEQ ID NO: 22329 - DNA, 21 bp, Hordeum vulgare
aagtaaattarattcagagta

SEQ ID NO: 22330 - DNA, 21 bp, Hordeum vulgare
caaatcaattrcacaaatagt

SEQ ID NO: 22331 - DNA, 21 bp, Hordeum vulgare
tagagagctgmaacgccacat

SEQ ID NO: 22332 - DNA, 21 bp, Hordeum vulgare
catgttaaaayttgtagggaa

SEQ ID NO: 22333 - DNA, 21 bp, Hordeum vulgare
tgccgggcgcwtagcagcagc

SEQ ID NO: 22334 - DNA, 21 bp, Hordeum vulgare
cttgcatattrtgtcggagcc

SEQ ID NO: 22335 - DNA, 21 bp, Hordeum vulgare
tattagtccayaagacaatac

SEQ ID NO: 22336 - DNA, 21 bp, Hordeum vulgare
taatatgattraagttttgag

SEQ ID NO: 22337 - DNA, 21 bp, Hordeum vulgare
gagaatataaratgtatgttt

SEQ ID NO: 22338 - DNA, 21 bp, Hordeum vulgare
ccatttcttcmatcttagcaa

SEQ ID NO: 22339 - DNA, 21 bp, Hordeum vulgare
tagcagtgcasgcatatcatt

SEQ ID NO: 22340 - DNA, 21 bp, Hordeum vulgare
attgtaggtamacattaacat

SEQ ID NO: 22341 - DNA, 21 bp, Hordeum vulgare
cattcaacaayttattgtagg

SEQ ID NO: 22342 - DNA, 21 bp, Hordeum vulgare
ttttgcatggraagagaatat

SEQ ID NO: 22343 - DNA, 21 bp, Artificial Sequence
  Artificially Synthesized Primer Sequence
agatggaggggccctgtgcat

SEQ ID NO: 22344 - DNA, 22 bp, Artificial Sequence
  Artificially Synthesized Primer Sequence
tagatggaggggccctgtgtat

SEQ ID NO: 22345 - DNA, 23 bp, Artificial Sequence
  Artificially Synthesized Primer Sequence
tcagagaggtgaatctgggtcaa

SEQ ID NO: 22346 - DNA, 24 bp, Artificial Sequence
  Artificially Synthesized Primer Sequence
ttcagagaggtgaatctgggttaa

SEQ ID NO: 22347 - DNA, 22 bp, Artificial Sequence
  Artificially Synthesized Primer Sequence
ccatgaccagcaaaagcagtcc

SEQ ID NO: 22348 - DNA, 22 bp, Artificial Sequence
  Artificially Synthesized Primer Sequence
ccatgaccagcaaaagcagccc

SEQ ID NO: 22349 - DNA, 23 bp, Artificial Sequence
  Artificially Synthesized Primer Sequence
ggactacgtacggactgaaatag

SEQ ID NO: 22350 - DNA, 23 bp, Artificial Sequence
  Artificially Synthesized Primer Sequence
ggactacgtacggactgaaacag

SEQ ID NO: 22351 - DNA, 25 bp, Artificial Sequence
  Artificially Synthesized Primer Sequence
tcacaaggtaaccaaaacaattcga

SEQ ID NO: 22352 - DNA, 26 bp, Artificial Sequence
  Artificially Synthesized Primer Sequence
atcacaaggtaaccaaaacaatttga

SEQ ID NO: 22353 - DNA, 23 bp, Artificial Sequence
  Artificially Synthesized Primer Sequence
ccggacttgacaagcggtaattg

SEQ ID NO: 22354 - DNA, 22 bp, Artificial Sequence
  Artificially Synthesized Primer Sequence
cggacttgacaagcggtaagtg

SEQ ID NO: 22355 - DNA, 23 bp, Artificial Sequence
  Artificially Synthesized Primer Sequence
catgggggaggttttggctcttt

SEQ ID NO: 22356 - DNA, 22 bp, Artificial Sequence
  Artificially Synthesized Primer Sequence
atgggggaggttttggctcgtt

SEQ ID NO: 22357 - DNA, 24 bp, Artificial Sequence
  Artificially Synthesized Primer Sequence
ctttttggtcctcagtcctcattg

SEQ ID NO: 22358 - DNA, 23 bp, Artificial Sequence
  Artificially Synthesized Primer Sequence
tttttggtcctcagtcctcactg

SEQ ID NO: 22359 - DNA, 22 bp, Artificial Sequence
  Artificially Synthesized Primer Sequence
gcttctagacgcagacaagctg

SEQ ID NO: 22360 - DNA, 23 bp, Artificial Sequence
  Artificially Synthesized Primer Sequence
agcttctagacgcagacaagttg
